United States Patent 11,001,841 (CCCTC-BINDING FACTOR (CTCF) RNA INTERACTOME) - sequence listing, part 27

SEQ ID NO: 66388 - DNA, 1036 bp, Homo sapiens
gcattcagttttaggagttaactaaaaaaatctcttagtatgattccttctaggttaaggaatacaggcttagtagatagctttctaataggcttattaggtacctttctccttttggttctgtttttttaaagtcctattgatagggaattattgaaagattataaagagaggaggagtaaatgacatagtcaggtttgcaatttagaattctaaccatggtgtcagtgtggagtggacctgagggatgagcctggaagcaatgatttctgtctaatcatttcttaatgtgtctaatcatatctaatctgttctctgactgagagattatttttagtgttaactcattttttggttgttttttcttttatactttttcaaagagataactctgttatagtaagaaaagtaataattctggtttttttctagtatagttttcattgtttttttccccttcttcttcagaaatatcctgcttttgccagtttaataagtggaagtatggtggaaaataaagggctttggtccttcacctaaattccagtcctaaaactgccatgtgtaggtagactggatgcaagactttgagcaagtaacgtcaactttttgtataccttagtctgcttttgtaaaatggggctaatatttgtctcttctattaggaatattgttagaattaaataagataaaatatttgaaagatcttaggatagttactggcatatagtagacatttaataaatgttagttttcttcttcctctttacttacctggtcttggatatagctttctcctctaagccagtattccttttccttgttaccactagcttttctacttttcagcatattttccctttctctccccagcattctagtgttttccatatctgcttttataactgcatgatggattcttcttgctcactgcccagaaaagtcaatgcattgagaacaggttttgcagcaaagaaagagtttaattattacagggccagccaaatggaaggatgggagataattctcagatccg

SEQ ID NO: 66389 - DNA, 1026 bp, Homo sapiens
ttaaattaactgcagtttactaaatgagtaaaccagtagtcaggacttactgatagatctcatagtctttaactaggacctcttataggcaattatgctactaagttcattttctctagtttactgaatgtttaatagagaatggaaatgtaatgggtaagttaaatgagcccttcccaaaacatgttcagaacttttggcttagagcaaaagtcagctttcaaatgttgaaaaggtgaatgaagaataaaataggaagaataaaatcagcgtaaagaagtaaagcattctttgagggcagttaagtatatgtagtcttctgcccaagagatgttctctgtctctgcccctgtcctttaattttggcttgaattcacagagttactggactaagactgctttgtttgagatgtcactgcgaattaaggcttcactgtcacatctctcatagctgccttgtaacttctacattcccgctggtgccaggcatgttccaaggcagcattccaaggtttagtgatttcaccctgatgtctctgccaataaaaataaccagttaccattaaaacctaccccacccataacttgatttttacatgccgttttattaagaaaacttattgatgattttaggagaattaatacattaagtttatcaggatatcaactggcccttggagtaacttttgttctaaaagtggatgtttcaccttggaagagaatctgagactcagcatgtttatctattgagagtggactttgtaataaccttattcctacagttgattctttatgactggaaatactctgttaaaatgagaagccagattattaccttagggatttatattctagtaggacagataacagatacagcaaacaaagggtctttcattcgttgagaaactaataataatttctaaatatgttgtgttctaagaatgagtcagaatccgttccttttctacaaagggcctacacagggggtggagaaggaaaataagatttgaatattaaaaattttca

SEQ ID NO: 66390 - DNA, 1034 bp, Homo sapiens
aaaggtggggaatgcttgcctgacacgttaaatacattcttagagatgtagatcacattcctctgctttaggaagcattgttggatctcacttcgttcctgtacccatattgcacatagaaagtattctgtgccctggatactttgcgttattcaccttacattatcatatagatacctccttatctcctcaatactagtcacaactttttttgattgcctgtcatttgcaaatattgtgctaggtgttgtatatattttatcattctatttaattctttcagcaaccagggacattaggcaaatgaataaattgaggctcaggaaagtttaacaacttgtctaagattgtacactactttcttagcaccttccaaaagcttgaggcttcttctgttccatggtgttttttaacaggatacatacttcagtagaatttgtatgcttaatgaaagtcttttatactttttttaagatcttaccacaattcctttcttttttgttgattatttgatcaaagggccatgtaattctaacacttcttgaaacattggagctgaaaagtaagactggtgaaatagctgactttaaatattgcgttttcaaggctaaaaatgagtgtctaacttactgattcattgtatgataaactaatattatagaactgtttttatatagagcagacagaaaaagttttataattgctctgagaaaaaaatatacttactcaaaatgtgttaagcattccaattttgatgcttcaacacggagctgtcccctgtagccttggagaccataacttcacagtgcttgtttttaaagtaaggttttcttttgaatgtaagcagattttgatggtagaaagaagttgtcgtgtggaattattctgtggagccatttgaatagacttgaaacattgtttatgcataaataaattcaccactctgaaaagtattctgacaaggcacggcatgtgttggcatctgcaagtcagcctgtactgagttttcactacccacaagaggtggtgaaaac

SEQ ID NO: 66391 - DNA, 1115 bp, Homo sapiens
ctgtatcattttctttgtcctctttgttcttgttgaaacttgaaccaatcttatgggaagctgactatgggccaggcagagtagaatgggagttagattcatatgatctgattccttcccatagagaactcagagcttagagttacataatatcctctaaatcatagctcttaaattggtagaactgagttttgaaccatatattttggccttcccgttgaatgtctttttcactatagcagtgttcttgaataacccccatacatatacatacatagactcacacatatgcatacatacacacacacatacacaccctttgtaactcaggaagcctcatgagcatatggtctaaagtgttcacccccttcagattgctttttgcttatcagtgattaaaaggcttgggaggcatttgagaatgtgtgaggctggtaatgaactggaggtccaacgggatgaaaagggaggaaaaaggagagtgtggtgtcttattttttggaacagacttcaataattataattactagtatgctggtataaacttgcctttggagacactgtggtaattttgatttatgtccagttaaaactgcaacaaaactgccaatacagaaggaattctgtgtttactcattttcttcagatagtaggccaaatggagaaattcgttaagccaatcctgaaacactataccaaaaacttaaatgagcaaaattaatcacatgtattggcaataggggattccatgaaaatgtttcaacttctggcagcaacttttaaactttctaatttcagtaataaggctatttgcataactctaaatgtagcaggcaaatggtacaaagaagaaagaagacagtgtggtgtagagaaagaagggaactggaaattaagaaacttggcctttctaaactggcatagctttgagacattggacaagtcattgaatcttaactgtggtttcattttcatatttaaaacgagagcattgaattaaaagacttctaaaataactcctagtactaacattatcatggtcctttgactataaaggtgaccttaattgacttaagagtcagttttctagttatttctaaaactaataacatttt

SEQ ID NO: 66392 - DNA, 1087 bp, Homo sapiens
ttacagtgaaagtcatagtccaggagaactttagatgtggaacttcagggccaggtggaaggccattatgaactcttgcattggctctcttatgatcataagcctgaaagtacagaatcctggaaaaggaggcctctctctgcacccatgtaatttttaaaaaggagagaaagatatgaagggtgctaaagcttgatcctaaaagatcagggcaatgaaaacaaatgataatgaataactagtactagaattaaaaatgtaaggcattttaaagagatggggtgccagttataattcagttttgaatactacattgcaaaagaactatttttgaaaatagttaagggaaaaaatatctgaattgttgaataagttccccctatttattcctggtaaacttcaatcccatcttactgcttcattctaagttcttgtggagtgtgaatatcagcaattttctgaccttcaaagaggaacttgaataatttcattggaactctgtgcgttttttgatagtatgattctttgagtttcttgggatgtgttgtcatttttaccttgcagtgaacctcactattgtcctgtctaatgactttgaataaaatatatattttttctttcttgtccctgaagtccatggtggaagcttttgcctcttgtttagacatgatggtggtggcttttctttcggatctccacaaacagcagattcacagcgggagagtctttctctctgagacttacaaatccatgttttttcttcacagctcaacaccactgctttctgttaagatgtaaacaagtctaataatttctttttcaaatgccgttctgatgaaaacctgagtagttaaaaaatactatttaaattacaatttaaaaattgtacaattattaagtgtacattaaacacttgctaagtgtacagctgtttatcagacacaatacaggaggggatacaaaggaagaagacaagaagcgaattgtctagttgaataagatttagcttgtggaagaattagtgtcaagataaatgtattcaagtgctgaacttcatggtacatatgcttactgaataaagcagcat

SEQ ID NO: 66393 - DNA, 1078 bp, Homo sapiens
tggtctctatgtgatttttattttgatacactattttgaagttacaaatctaggaaactaccacactgatcttccaattaatctcccactgatgtcaaaaatgtcaaattttgggactgtgcttttatgttcagacattaggcattaagccagcaaatacattttgagtccctcctttgtgccacattctgtgcttagcatttggaatacaccttagaagatgaaatttatttttcccccagaaagatctggtgaaataggcaaagaaataaacagttgctgtaaaatagggtcatgtaatatttttgtggtgccatacacatgaagtagcagatttccagaggaaggagcacctctacctgtccgtaatagtcaggaaaggcttttgaagaagaggttgcttgagctgcctcttgatggattaggagtttatttatctgttaagggatgggaagaacttgtaggcacatagaacaactcacacaggggtacagaaggaataaattataaggatatgtttggagagttgccagtagtttagtattgctagagaagatggtgcaaggtaaaaaataatcaggaatgagactggatgtgtcagcagggtctacatcacaaagggccttaccttgatgtaaaattactttagagctgtctttttaagagagtattactgtcaatgtagattaaacacacaaacacacccagaccaagaggcaacaggatggagtataatctcctctattggattccttaggagccctgagggatttgttgaattactggtcccatgaacaaaatagctgtattgagagttggtcctttttatgtgacctaagaaatcatcaataaatatcaggcaatttctaaaagtaaagaatatatcatgaatattttcagggtttagggtaataataataatgttggcagaggtagtgatatcatcaaatgcctaagaaaatgaacctctcatatatatgatgactttcaggttaggattgatgaccaccttttaaaaaccgaggtaaaattcacacacagtgaaatgcacagatcttaagtgtaaaatctgtgagtt

SEQ ID NO: 66394 - DNA, 1068 bp, Homo sapiens
ttagggctgggcgtggtggcccacgcctgtaatcccagcaatttgggaggccaaggcaggtggatcacgaggtcaggagttcgagaccagcctggccagtatggtgaaaccccgtttctactgaaagtacaaaaaattagctgggtgtggttctatagttcattgttttgtatcacgtacgtaagggtaattttttccccctgcatggatatccggttgatttagcatcatttattgaatagtcttttcattccccatttaattgccttgacatgtttgttcaaaatcaattgatcatgtatatgtgcatctatttctggattttcttttctgttccattgatctatatgtctgtatttccccaataccaaactcacttattatcatagatttgtcatcttaaaatttgacagggtaagtcttccaactttgttaaaacttctgtggtttttctgggttctttatatttccaactgaatttgggaatcagtttgtcaatttctacacacacaaaaaaaaggtctgatggaattttgataagaagctgtagataaaattgtggagaattgctatcttaacaatagtgggtccttcaatccgtgaacatggtgtatatctcttttacttagatttctctctaattctctttataatgttgtagctttcactgtagagattttggacatcttttatttatttatttatttaattttgagacggagtctcgctctgtcgcccaggctagagtgcagtggcgcgatctcggctcactgcaccctccgacttccgggttcacaccattctcctgcctcagcctcccgagtagctgggactacaggcgtccaccaccacgcccagttaattttttaaaaatatttttagtagagacgggggttcaccgtgttagcctggatggtctccatctcctgacctcgtggtctgcccgccttggcctcccaaagtgctgggattacaggcatgagccaccgcgcccggcagatgttggacatcttttgttagagttattctgaagtgttttatgggagttttttggcaggggaggcatta

SEQ ID NO: 66395 - DNA, 1118 bp, Homo sapiens
tgtaaagaatcataacaggaaagtttgcacagttttatgccctttatttgattttcatccagtacaatgttggacaaaaaaaatagtaagaacaggaatcctcaccttgttcctggttttgaggagaaacaactcatcatttctctgttaaatatagtgctaagaatgcccttcattaattttaggaagttcctcttattcctagtttctgagagtttttatcacgaatagaagatgaattttgtcagatggtttttctatatccattgcaatgatcatatggttttttctttattctcttaatgtgattaactttttggtttattttcaaatgtttaacattgcatttctggaataaacctaaattgattataatatataattatttttgtattttgttggatttattcttataaatttttttccttcgtattgtcttggatttgctttggtaataatttaaggaattttgcacttgtatttatcagggatgttgtgatacaatgttttgaattgcgttttcagattttggtagtaggattatggtagcctggtaaaattagttgggcagtgttctttttttcctattccatcttgcccaggagcagaaatctggaccttttaaatattttctagttctctgctgatatttcatatccttttattcactataagaatatttcaatttttgtcgacatatatgtatgagtggctttaaagtttttgtaattctaacatctggatcatcttggggttggcatatgttggttttctcctccctagagagtgagtcacattttcctgactcttcatatattgggtaatactgcatagtattctggacattgtgaatgtaatttggtggaatctctggattttgttactttgttccaaaaaatgttgatgtttttattttagcaggtagttaacttggttaggctcaaactgtcatgcctgcaatgaacattggctcagattacagtgtagttcttttactcttaggcacaagcttctttctgtttgtctcatgcatgtgtagtataggattcagtcagagacttaggttgaatttaaacagaatttggggtgcccattctctgccttcctctattctggta

SEQ ID NO: 66396 - DNA, 1055 bp, Homo sapiens
ctatatttgttatccatagtctatatcttctatgagaggaccagtttgttgcatacttattcttttacaccagaagcagagctcctgtacattttattattatatatttttgctgtatcctcctggctaaatccgggttctaagcctgttactgctaagtctgtgaaattaatggataggaaatattttctgcggaaatcttttccttttcttagtggttgactaggtgtaggtccagtagaaacaacctgtaaatgacatttaaaagcagatgtgttaacttttgggacagctgccacaattttaaaaccttttttctgattgttatttattttcaatttggggggaagaattactacaggtgaagataaaatataccctaagctgtcaattctcaaagttattggtctcaagacctctttgtacccttaaaaatctcaaagaattcagtaatacatttttatgaaaaataagcatatttttctgaacaaaaggtttaattagcattacattgcttaaatattttgtgaatttaactgctattaagctaatgtctagcctaataaaagacacctggattttcacatctgcttctgcagtgaatctgttgcaatatcgtaagtctcgcagactctggtaaactccatcatacacttatgagaaaatgagagtggaaaagaggcatacagcttagtaatatgcgaatatgttttatcttacaagactctgtaaagatgtcaggaaccctcacaattcccaggaacatgcttgaggaacttttgacctaaggcaaaaagctttagctccaatatgatcaatgtgaagacacttgttccattactggttgaacatctcaaatcaaaaatccaaaatccaaaacactccaatgagcattttccttgagcatcatattggtgctcagaaagtttcagattttgtagcattttggacttcagattttaggatttggcatattcaacctataatatgttatttatacgttagtcatctttctgaaatgaatgtttaacatttcccatttttttggcagagac

SEQ ID NO: 66397 - DNA, 1029 bp, Homo sapiens
aacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtgtttaagtaatccataacacgagagccttttgtggtaatgagacccagatttccttctgtgtctgtatccctttatgcaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatggtaagagcttttagatcacttattgtacttggatgcgtttgaatattaatagtttgtccaacatataaatcaaaggaacatttgaatgcatttataatgttatggccattgcgtgtttgtggaatttgttgtcataaaaattatacaaaagctacagccttgagtggttacctacattttaaaaataaaccaggaatatttattatgaggaaactgggttttaattttattttcaagccccttaaaagtttgttggaattagcatctttttcacatacctgagtcttaaggttcattcgtgtttctccctggaccgtccactcctgctccaacttctcactaacaaaactattgtctgtgacctttctaacccccagaacagcataaggtacacaaacttctgctctgccttaggtgttagggacgtcattaatgcttactggaaaagcacaccccagagagctgggttttggctgtggcaggtaaaaaaatctttcagatcttgcaatgctggaaaccttaaaccttttggttttttagctaaagtgattggcaacagaatgtgacatctgaggttgcatg

SEQ ID NO: 66398 - DNA, 1032 bp, Homo sapiens
atcactcatagtttctacctatgtggctttgaccaagccatttataccacctgggtctcatttctctcttctccaagttggtagcatcagagtcagtgattgtgaaagtttctcttagttctattattgtatgataatgaatttataatgtaacaaatttataatgtaaagtacttttagtccctaaggtagtctgatgtacgggtttcagcagaaggaaagtgttgtagtagtattcaaggtacttgggtgggactggggcaagaggacacggtctctaaaaataattaggattctagttagttagagcatgactcagtagttggttgaaaattactgctgtttgatttttttccatgggtttgttttagagaacagacattccttgagaagcccattttctgttgagtactatgcaagtcatcgaggactctcagactttttatgtgctctttgctcttactagaaaactgtgaagaaactaaggtggtacacgtgtgtcatatgcttggtacattcgaggctcccaagttaaaaaattgttatatgctgggcacagtggcacaaacctgtagtcccagttacttgggaggctgaggcatgaggattgctcgagcccaggagtttgaggtcggcctgggcaacatagtgagacctcatctttttttaaaaaataattgttatattaatgtttaacaataaatttatgagacagtacagtagactggttaatcgtggaagattgggtgtcaagccaacctgtttactagctgtattactttggaaggattccttaatctctgagccttagtttgtttatctgtaaaaggaatgcaatagcatttaaaaggtgtttaacattgttagtgaatgaatgaatgtcatatataaagtactatagacagttctggacagaaaaaagtatatatataaaaaaatatataaatagttacctatttttataagactaccaaagaaaaacaaatagtctgctatggtagttaagggtagagaattcactgaggaatggat

SEQ ID NO: 66399 - DNA, 1026 bp, Homo sapiens
agagggcaggctgttgtcttcaagacctatgctgagctggagaggagggtggggccaaggcaagtcaaaaagctgcaaaactttcttcctggttttgagtttcttttttcttgatttaatgttcagacaattgatataaacctttgactgttttccggggttttgacaaagttgattttgacaatttttcttgattttttctttttagatgtttccctggagggataggtctttggctatatctactgtaccatttttgctgacatcatttggtttgtttaatgatgaaaaacatggcttataagggatgaagggacgcctagatgattttaagcaaaagagaataccatgaccagatatatacttaagaaagatcaccttgtagttctctggagactgggatatttccaaccagccttctcctagtgccgtaatgttcaaattaagtgtctttccagatttttatcaaaatttttcatgataatcagactttaaaattagttatccaggaaaatcactttgcgagcttgcaggaagggtgttccttgagatggtaaatattcttgctccagatcagttgcacactttaatttgtgaagtagcaacttaatatgtgggcaatttcaagtagcatgccccagtgtgagtagcagcagtgatttattaattgattggttgattttctcgagtgatctggtaaggccagctggttttaggtgattatgttatcccttttttccttggcagccagaggaaccacaggaattgcattttggtgaatgaattttatattcttcctctatcttcctccttttgctgaaacacaaattgtattttgttgattttgatatatacattttgggcattttaatattgataaaaatgagatgcatcttataattaatgggcatgtcatattataattgatagtacttttcttagtgttacataagttaatgatgcattttacaattgatgctgtcttagattttaggaactcttaagtgttttagctggttttatgca

SEQ ID NO: 66400 - DNA, 1031 bp, Homo sapiens
accccaagagttgccctttttacctgattgattctgatttcaagacagaatttctaaagtataaagaaattgtgatgtgttcaaaatcagataatattgggccaagatcatagtcattgcatgtggacctgattctcattagagtggaatggtctaacaccttttttgtgactaggtgcataaggcggtcatatatcctatgtataaagaggttggccaaacaggtccccaagtcttatgacctgcgttttttattattcttgcagccacatagacaggtcaagaggattatggaccttcccgttctgcatagctagtttgcattttaccaagagggaagagacaaaggagttttcagagtagcagtgagcaggctgattccttatctctgtattccctcagcctacctcttggctgagcaacactaacttgataaataaatgaatgaaaatgtctttctgatggcctcttcttgaaacaattagaataccttgagctttatttgtataagtaataagttttctgtagaaatagtgagtggcacccagaattttattggtaaaaagcttatattgaaaacataaatgaaaattccagaactctagttttcagactgctgtaattctgactcctcatttctattattacctgcttcaggcatacttaaacacctgttgacaacatcttatattaagaattacatattccttcctataaaaattctcagcttctgtttgttaatcaagctattttagtgcagagagttcagaaatgattgttgttttcactagattagcatctgtttgctttcatggcatccaattaaatctgatggccttcttccagaaatggggaattttcatatcatgcttaggcttaaatgctatggccttcatttccaactctcttctgtgtatcctataaattagaacatttcttataacctttcatcttcattttattgtaggttgttgctcagatgttggcatttagagcactcagtagacccagaccctaaacctttaaattgg

SEQ ID NO: 66401 - DNA, 1918 bp, Homo sapiens
tgatacattatatggctctgctcaaaaaaataacatggttataatactgtaatgttgcatactgatttaaccaaaaattatgatgttgaccctagtgaatggattggaggaaggggaagtgtaggtattttggaagaggtggggaagcagtgtgtaagagagctatatcctcatcttccccagtatattgtcagtagatcatttttaaagccatagggtcgagaaacaggaataaaaggatattaattagaaacatagagggaaaataccagggggaaaaagcagcctaaagtgatgagaataataagcttggaggtctaggaatggagataaagctctagggtattttaactaataaacatgtaaactaatgtttttagtatcaggcttgtagaacattttgttttttcaaccatgtatatgttttattttgataaaaaaacattgatttttaagtgtgcttttggtggcttcatttgtacaaagtctttgcaaactaacaatacaattcagtgaacatttattcaatacctgctctgttagaccattgtacaagagacagacatgtaaacatatgattgtaaaacaaagcctaatgtgattacctgctcccaaatgatgaataaatactgatatctcatagaagcacctcacttcttttgggactaggggaaggcttcagagaggatagaacatttgcactgggccctgaagggtgggagcaatctgaagaggaggttcagtgccagctgtggccagtgttgtccaatcccaccatcactggaaaaggagatgtgtttaggaaagaagtctggtggagctgtgggaggctgttttgacttctctgcctctcctagacatttatattagtcatttcttcctgaggattttctcctccctgccctatcacccagacacccttaattttagtattgactttaccatgctgagttatattgtggttctctccccactggcaccctgcctcttaaacttttggtctaatttagagaaggacaagggaagggaaaagaaaatattggtttcacctggccagatgtagattcccgaatataaagataggaactctctttcctaacctcataggctactaggtatagctgttatcttttttgaggcactaagattaaactgtcattttcacagtttgaacgtaatttttagaaccctcaagagtaatataggacacatctaattttttcaaagaagtataattgtttcacaactataaaatatttctctgtgaagatgcttttcagaagtaactgggcaagtcattatggtgtgtgtacatgtgtaacatcctccaactttagaattttgtgccctggatttgttttcttttatattgttgggtccaaaagaggaaaggctggcttagaactaaatagcagaactaaaccatatgttttataccaaattagaaacaggtgaaggttgttaaaatccagcaagcacttagaaaagcttgagacacaagtttgtattaaaggcaggtggttatatgtacaataaaaaacagtcaccagcacactggctgattgatacatatgtgattgatctttttggataaaaacaaggaggagttaataaatcactgcacatagctataaagatgtttgggcttgaaagcctagcctgtaagagcaaatgtgggccctgaaggaaatttatgaagcctagatccttttagctttacttaacagctaacatctgactgacccagggggaccatggaaatttattgctgggccattcaaatatttaagctgttgtgtgatgcagaacaggtaaagattagcccaataacaaatatgaggctataaaataaaatgagatttcgatgacttgtaagtacttgtcagaggtcagctccaaatgactggtcagaaatggt

SEQ ID NO: 66402 - DNA, 1039 bp, Homo sapiens
caggttcatgctattcccctgcctcagcctcctgagtagctgggactacaggtgcccgccaccacacctggctaattttttgtatttttagtagagatggggtttcactgtgttagccaggatggtctcgatctcctgaccttgtgatctgcccacctcggcctcccaaagtgctgggattacaggcgtgagccactgtgcccggccagaaatatacaaatcttaaatgaactattctgagttccatcaaatacataggcatctgtgcagtccagcacgtcaagatacagatcattgactctcccctgaaacttccctctctcttttttctagtgaatcactgtctttcccagtcccctgcttaaccattgtttaaccgtaagcatgcagtatgaacttctttacataaggcttctttcacttggcatattattgtaggttctttcatcctcaacacttaggtggttttcagtttttggctattgtgagtaaagttgctgtgaacatttttgtacatggtatttttgtgggcaaatgttttcatatttcttgggtaaatacgcaggaacagaattgctacatcataggataagtgtatgtttagttttataagtaactgccagacctttttccgtagagcgtaatgtacattttatactcccactcaacaatatataagagttctggttgctccacatcttaagtctcttttaatctgaaggttctctccttctttatttttccttgcatttttttccttgttgtataagttaaacttactctgcagatccctgtaaagttcctcacattttgaattttgctgatggtattaacatgtttatctttcccctgtgttacctataaactggagataaaaacttagttgatcatattcagttttcttggcaagaatacttcataggtgttactgatgctcccttttatatcacatttggaagcatattatgtctagttatcttttttgtgtgtgtaatgttaaaattgattagtacccctggccactcttagtctaatctgc

SEQ ID NO: 66403 - DNA, 1492 bp, Homo sapiens
caaacacacttctttcttctcaagggcccaaaaggatggtatgccaaaagatcatataaagtgttgctaagaataccacagcttgctttgggagcaagaccaagatggaggctatgtgcaggggaaaacttagcaaagtcagccctcctcatcagactctcaactctagggcctgtttgatccccacttcccaagaggcctctgactttattattaactgaaccagggccacaagtatgctgacctagttttactcatctgagaaatggattgcttgtagtaattgtgtatcctctccagctttatatatgctctttgaaaattgagagaacaatcaataggttaactactctgaatccatagggagcaagtatcctcctctgtggattttctttttttaatcacactggaggcagttttaaaaggaggggacagtaaacttcttaaaaactggcttttttatatttcaaaatgtattcgggaagccctttaagcagttagaaacttttagaacagttgtgacctttcactttttttgcttcagctctgtctgttctgtctctcgctgtttctcagggaagctttcattttgtctttgaccttactgccatcactttttcacgttttgatttgtaacaaatgaaagaaccattaattgttatggctcctaagcgagcattgtagcaatcaggtatttccagcttttgaaggtttatttttatagacatatagactaatatatgttgtcaaaggggagtttgtcttctcagccagttccatatgtacccatcttttaagatgtgaacaaatcatactattaaaatggcctcacctcagtaatttataagccacattagtggaggtggatgaaagcattggcatgtgttaaagtgccagagaaaaaggagtgaagtcatttaatactgcatccataacttggttgaggatttgaatagtcaataggacctttcatcacaaccagaagtagtagtaaaatcacttttttggtagaggaaatgacagaatttagtaatatttgttacttcagtatttgggatcagtccagcccaagttttgaaagcacaagcttagagagacaggccttcaagtagaaatcctcaagtgttgtttgaagagctgagagcactggtaaggcctgcttgccctcttcatgtcactgctgtctaaaggtgtgtgtgtgtgctggattaagtactgagagtgagtgaagcaaaatgccttgttttcagcaccatatattaatatttgttaagtgccagcctcttcagttagaaatagccttccttcttggctagcatgtaatgctataggaatgggcctgtcaaaattcaggtgcagtataattgacgttgactttaaaaaccagatcctgccataatttcagttagttcataagtacattatattagaatttgtatagagaacagaaatttgcttttaattctcagagcataaaaattaaatggaaaac

SEQ ID NO: 66404 - DNA, 1050 bp, Homo sapiens
tgagagccatcattagctattaaccaatgtgctagacatttttaatgtcattgactatgattactgtactctttgattgctgaaagtgtaaattgataaaactttttatctcagttggacattttttccttttaaactgaaactacaaatacagtgccaaaaatatatttccaaatgaaaaataaaacaattgtaacttacatatatagcttattttagggcacagggccctttcacatatattatttcttttatcctttgcagaaacccttaaagtgttggtattattatcttcattttacatttagataaactgagcctctgaagggtgagtcttttgctcatagtcacacagctgttagataaacaaagaaattcagaccctaatatctgactctaagttcaggagaccgtacttgctgctttccttttgtcagacaggaagaaacatcttacataacaggcttccctttttttctgtggctaatagctcaatataaatttagcaccttacttggcttaccatctttgataacatctatctcttcctttatcctagttgttttaaaagattcactttagcctttttacttgttcagtaataagattagccttttccaaagcaccaccatgagtgacatcttttgctgggaggaaaatatttaaagaatgtacctcaactgaaatgaaatatgcagtgctagctagttcagagaggatggcatataaattctcactatactttttatgattaagcatcatgaaatgaattatgagctatatgaaaaatgaatttggtctgattttagttggcatcaaagtgaccggcatagcttaggtgtaagctctttaaagagatgagctccaaaaaaatggtttatattgcctgattcaaaacccaaagtctctagattttaggggaaggtagcacagtagatttgaaattctaaattttggaacttttaatgatgttatgttttgctaatttatctttttgaaagagagactactttcaccaacatacccacagttatctgtggatagacccat

SEQ ID NO: 66405 - DNA, 1015 bp, Homo sapiens
ctctgttgcccaggctggagtacaatggcgcaatcttgactcactgcaacctccacctcctgggttcaggccattctcctacctcagcctcccgagtagctgagattacaggcacctgccaccacgcccaactagtttttatatttttagtagagacagagtttcaccatgttggccaggctggttctgaactcctgacctccaatgatctgcccgcctctgcctcccaaagtgctgggattacaggtgtgagtgaccgaccgcacctggccaagttagtctctaatttttctaagccttggctccttctaaaataagaaacttgaagtaaataatcttttcatttccttctaacagtaatattctacaatttctcccagtctagttttgagcacatgtatgattttaaaaaaaaacaataataaaccggttactcttaaattagaggtgatgggagggtagattgatcatttaaaaaaataatttgacattatgcagtgaaattgaagatttgtatatgagaatgtttatagcaccactattcataatagctgaagattagaaacaacttaaaatatatcgacaatatgttcatcattaattaaggtatatttatgtaatcaaatactgtgcagccatgaaaccatagcaatgatagggacgaatttcaccagcatgatgtagagtaaaagaaccaaagcaaaaaaaaaaaaaaaaatccacaatcatcctctatttatgtatagttcaaaaccaagcaagattaaacgatattatttaggaatgaaaactatacaaaaaaacaagggtagtgactaactacctctggaagtgagaaggggttataatgagaaaggggcttgtggaaggcttctggggcaccagcagcattgtatttcttgaccgagtggtggtaacacaggggtttgctttataatcctgatcctttaaacaatgtgtatgtgtgtttcatttatttttctatatgcatattatatcttgccattaaaaaatc

SEQ ID NO: 66406 - DNA, 1048 bp, Homo sapiens
tgtcttctctctcacgtttcagcctcaactcctgcaaccacttaccccaaaacctccgccactggccctttatgccaggaaagctgaacatcactgaaaggcccatcttctgcttttgcttttatattccctttgcctgaaatttccttccccttttgtccatgtggtaaactcccactcattctccaggatccaaccaggccaacttctcttctgtgaagcctttctttgccctcctgaacagagttatcacccatcttctattcttcctgctcaccttgttttaaaaaacaagtaatcgatcaaatatgtgaatattcttacatttctgttgttattttgcatgtatgtctcccctactaaattaataagttccttaagggccagagactgaggttcattcatctctttatccagacacagtagctagcacataacatggactcaggaaaggtttgcacatgcatgatagactgaaccagtgaccttcctgcatggactaaaaacttaagaactcatctctgaaaggaatagccttccatttaaaaggcaaagggagttcacatttgtatcaaatgaaattacagtcttacttatagatatgcctggctttgcttgtgtctaggaagataatgcagggctttgagaagtggggtgagattaaggagaaattatacagtaagcgaacattttccccaaaatatatgcctgtggtaataagttgttatatgttgagtgactttttctcttctagtcagagagctgacaaatattttcaaagtgttatagtgttttctaagtgttattctttcactgacaattttatttaataattttagatacagtagtggctctagagctaactgaattactggcttatatgtaattcagctagtatattcatattgacagtataggagagatgattaccagctcacaaagaatgcatgacgcgatgccatttgaagaattgaaaatggaaggaagggggtatgtgaatttagataactcaaccctagagttctggcctattagccctttggtttta

SEQ ID NO: 66407 - DNA, 1028 bp, Homo sapiens
caagatggtccttacccttgtttatacaaaggggagggctgaatggaagctggcaatatctaaaaagaaacactggttttctggtatatgtccctggagttggtgttagcaaaccctaccagggtctgggggtagaaaagaaggctagatacaggggtctttgaaatatcctcattccacagttggtcactcttagtcttctctaagtttagggggcaagagaacagtaagtagatgaagaggctaccttaaataccatcgtaatttaagtgggtgtgcatactcatacacgtgcttatctatatgtcaaatacccagtaagtggaaagtactgtgaggctgataatagtatcaaacatttacatttcctcttttagagttcaaaaaaataacttgtttagtggttcatttttccgaagcttataatctgccaaaatatctttaattctattttttcaccttcacagctaagatatcaacatggactagggactccagacttgcggcaaacccttcccaacctgaaaaacttcatggagcatggactaatggtcaggtggtgagtacctttatctctgataaccagaaactgtaatgtggataggatcctgaaaatcttttctgacttccacattgctccacacctgcctctgagttttcttctgtaatgagatatgggaggaaaatgaaaggcgccatcacagttggggagatctaagctcccgtctggctaaggaggatgtagcccccttggagggaggaggggccaaggggatattgcttgaactttgggaaggtggctgagcaaggagcccttgagggcattgctgagacaaactggaagacagccagtatgattcatggtaagggagacccagagccccttggacctttccaaagaacaggtgaagggcctgattatagaatgagcatcaggaccatggctgtgagcattaaaggaagaaagcagataaggaataggtcagggggtcaggacttagtttgagaccagtaggtacattctgaaa

SEQ ID NO: 66408 - DNA, 1052 bp, Homo sapiens
agtttattagagagctgatggtaggtcagtgttagtagtatctttcaaagacttcatctcacagattctgtcactggccctgggagtctaatgcatcctttagctcccttccaagtctagtttttaaactctgaaagcattctctgaccagggttttaatttccctatcgagttccttctgggggctgggttctgtgagattgttgttcctctggtttccctggcaaaggcagaggttttgggtttttttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgacatcaagatgggctatgtctgtttctacagaccattttacagtcctcataatgttggttgcctgactgtgattttactacattaatttgtatgatgatttcttaaagtgaaagctgatgagtgaagtggttgacttgacccctcccaggacctctctttatctccgtggaggatcactgtgtattccctgatcccatggagctcagcctggagcctgagctggcctccagatgggctctcggcaataggcaccccctcatcctctgtccactggcccaagctgggccatggaggcctgatggccaagacctcacatcacaaagcctggtgaactggatttcttcagcttgcttattttgtcttttgcctgtggaactttctctttcaccaattcatctttccatcactacttggtttaaataaaatccaaaggctgccttgttcagttatacctttttatactctgtttttatttagacagactttggtaggaaaccttccaagcaaagccccgggggaaaagtgaccattggcacagatttcagcctgtgcttttggcccaatattgtttctatttttattttgtttcatgtttttgttaacatccagggcaaagattaagtacttacactt

SEQ ID NO: 66409 - DNA, 1120 bp, Homo sapiens
tttcttttctagggcacttcttgctattgtaatttgaaaatgtattatttgaataatgagggatgtctttctcctgcaggactggtagctccttggaggaagggcctactggtcttgcatctgtctccctaccccaaggccaggcacatatgggaactatttgttgggtgtgtgtagtttcaagttctgcctctacccctgcctagtggttgcccttctgcaagccacttaaccctctatgcgtgtttcctcatctgaagcacgcaagtcaaatgatctgtgtgtgcctccctctgcctctggacccaatctgttcatatggttgtattgaagctaatttcatccacatacaagaatgtctagagctagcatagtgtataacatagccatcatttccaggatgtagatactctatttccattaactgattattatttattatttcagactttaccctgctttctctatagggtttttgtaaagactaagtgaaatgatgtataggaaattacttcagaaattataaagtttgtataactgaacaatgattgttattgctggcccaaagataccctcctgagaagaaactcagacccaaaagacagcattgcagaccaagtattgtaaaacatatgtgtggctagccccatcaaagaatgtatttcccaagttagtttttcattttaaaaaaaaaaaaggaacccctcaaaaattttttttaatttttaaaatataaccttgactctctctctctccctccctccctccctccctccccctctccccctccctccctccctccctccctctctctctctctctctctctctctctctctctctccctccctcctctgccagtcctctaatgcaaggtggttagcatttgggtgttggcaaggttgttggtcatgaaatccttctcactgcctcactgagcatgggcaagtcatgtaaattctctgccagatgaggatgcctgcttttcaaagctaaaataagaattgaattgaatactaaaacaagaatgagattatggatagcccttcagaaatatgaagttagttatatccttcacatgtttttcttgctagatccagcctgtccagttacttcacctc

SEQ ID NO: 66410 - DNA, 1067 bp, Homo sapiens
gccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttcacccgacctgatttttttttaccagcttggaaattcctcttgaacctacgtctccatatgtcacatcatgacaggactagcctgaacaaaagccatgtctatctaagcggaggctgttgacttcattcagtttgcatattgtatatagcaacacaaacacttgacaggtatatactccagtcgccacatttgtcctgcataacagcttcactcacaggcctcaccgtcactttattttgtgtccaagcattcctgggctcaagtttaatgtatagctacattgttgttt

SEQ ID NO: 66411 - DNA, 1037 bp, Homo sapiens
tgcagggtttgtgggtcctctactcgttcttgtttgtcattcatccatccctccatccctccaacagcagccaagcccgcccctggagctgcatgacccagtacgggcactgtgaggcttagagacccttagaggtgacgggggcaccacccctccatgtccacatatgagaactgaggtccagaaaggggcaggagggagccctaggatgatctgagacagccccagagcctcaaactgctcagggtgacctctgcccctgccctgggtctgccggggtctctcaggcttggggtgagtccagtgggatggggtccaggccaccttacaggctgggagtaacccagctcctgccgtatagctcccattcagggcccagggtggggcgcccaagcagggacagcgtggggagggggtggggtgtggaggaggtggggggttgtccgggggtggcgaggctccgccccatggcgctgcagcgcacatgatattatctctggcctgggctcagcctccagcaggatgcggctttcaacaccttcctcccctcggacaggccggggctttttgagtttctcacacatggatggaggggctgggcctgggcagaggaggcccccagctgaggcgcccccaccctgagcccccgtcatcagtcacagcccctcgagtgagagagggaagggccgtggtgcgtgagaggcagagggttgcatgcatggttcccctgagcgtctcccccaccccctcccctctgctctgttgtccataatcctgggcgcctgttcaaggaattctccacccgtgtgttagtgatttatttagactcggctcatcccgccagcctgcccggcgggtgacaggcccccactccccacccccaccacagaccctgggaccattttcatctccagcacggcaggcctggctctgctccaggccactccagatggtaggggctctgcttgagtctgcaggctttcatgggaccctggaatctcacttttgggggcccaggtaaccgcttcatgttcgtg

SEQ ID NO: 66412 - DNA, 1044 bp, Homo sapiens
cctgacccgcgagctcaggcggaaggtgaccccgtggcctgcgcggctgtcccgggcgctcgtacaagggacaggaacagtccgtcaggacccagaggctcgggccaggcgctgcctccccgcgcgacgagcttgggcggcggagggagagccttgggacagccggggctgcaccgaaagagctgggcggggctggaggcctgggtccccgtccgctgtgcgacctagggggctcctcctctccctgggagaccaggctggacacagatcccccgctgtgagtccgcgcgcctccgtcctcttgcagcccccgccccctccccacccaggaatgccgggtgccttcggggggcggcgcactttgggagaggggaagacggtgactggagttttgattcccccctccatatccagcggatatttttctcgttctgagaagtgcaagaaacttgcaggaccaggaagacaaaggatttggatacaggctgggtgggaggacgggactgggttacaccgagaacccctctgagacccccagccttgacggcatgtttgtcgcaggcgcccctgtgctgggcgctagctgcggggctctgcggaggaaaaaaactgtacgatccaggcttctcctcgccttcctgtgggttttgccgacaggctccagaaaacagtggggcttcccatctctgcgtgctgactacccacgcgcaggaacgcgccacgcaggtggcgtcgcggtgcaaatagcagaggggcgctgagccccgcaggctgcagggagacggggtcctcgggggacgcacggcgaagccccattcctcgttcttatggaaggggacaccgaggctggggtggctgagggcttgcccaagctcacagagccagataagaacgtcccttttctgctccagcgcccccactaccgtgggcgcctccttttccaactccccaaacccttagaaaggaatccctttgtctctgctcctcccgaggggagaggggctggggctgtgtctgactccgggcgaacgccaggtgttggta

SEQ ID NO: 66413 - DNA, 1047 bp, Homo sapiens
actccccacctctgctttgctatacccagaggggctggctgtgagaccctccctctccaagggcttcagagccacctttcacttcacctccagagcctgccccagctctggccttgcatttccgctgtaagccatggcctcagcccttccattcctcctttcctggtcttggcttcaccttccccttatcccctagggcttgttatgccccccaaggatggcgattccccaccctgcttccaacccaaagcaggaaacattcctcagtgaacgggtcctgggatcctagagctcttgggttcctcagtgactgaggggcagaggacagagggagtatagaggtagaattgtgttactcctcacctcccacaaaaaatacgttgaagtcctaacaccaaatacctgtgaatttggccatacatggaaatggggtctttgcagctataactagttaagttgaggtcatactgctgtagggtgggccctaagaagagaagacagagagacacagggtagaatgccatgggacaacaagcagagactggagccatccagctgcaagcaaaggagtgccaaagattgctaactaccaccagaagctagaaagatacaaggagagctcttccctagaaccttcagtgagagtatggtgcagccaacgccttgatgttggacttctagcctccagaactgtcagaatacgttctgttgttgtaagccatccagtgtgtggcactgtgtatggcagcccttggaaagtaatacgagaccgtacagctggctgcaggcttcacccagctgccctcccggcctgagtgctctttgtagtgggggaatcagagctcgtccctccccagctcaccactcttctctggctccctgtttcactggcttccacgcgccacttcatagctgatccagccaccttctctggcatcctctcgcactgctgtctgccttctttcagttctgggtaccccaaatgatagctgtggttctctcctccatgtctttgcttatgctgtgccagaaaacacatctttaccc

SEQ ID NO: 66414 - DNA, 1850 bp, Homo sapiens
tgaagagaaggaaaacaaagaatacctaaaatctctatttgaaatcttgattctgatgggaaagcaaaacatacctctggatggacatgaggctgatgaaatcccagaaggtctctttactccagataactttcaggcactgctggagtgtcggataaattctggtgaagaggttctgagaaagcggtttgagacaacagcagttaacacgttgttttgttcaaaaacacagcagaggcagatgctagagatctgtgagagctgtattcgagaagaaactctcagggaagtgagagactcacacttcttttccattatcactgacgatgtagtggacatagcaggggaagagcacctacctgtgttggtgaggtttgttgatgaatctcataacctaagagaggaatttataggcttcctgccttatgaagccgatgcagaaattttggctgtgaaatttcacactatgataactgagaagtggggattaaatatggagtattgtcgtggccaggcttacattgtctctagtggattttcttccaaaatgaaagttgttgcttctagacttttagagaaatatccccaagctatctacacactctgctcttcctgtgccttaaatatgtggttggcaaaatcagtacctgttatgggagtatctgttgcattaggaacaattgaggaagtttgttcttttttccatcgatcaccacaactgcttttagaacttgacaacgtaatttctgttctttttcagaacagtaaagaaaggggtaaagaactgaaggaaatctgccattctcagtggacaggcaggcatgatgcttttgaaattttagtggaactcctgcaagcacttgttttatgtttagatggtataaatagtgacacaaatattagatggaataactatatagctggccgagcatttgtactctgcagtgcagtgtcagattttgatttcattgttactattgttgttcttaaaaatgtcctatcttttacaagagcctttgggaaaaacctccaggggcaaacctctgatgtcttctttgcggccggtagcttgactgcagtactgcattcactcaacgaagtgatggaaaatattgaagtttatcatgaattttggtttgaggaagccacaaatttggcaaccaaacttgatattcaaatgaaactccctgggaaattccgcagagctcaccagggtaacttggaatctcagctaacctctgagagttactataaagaaaccctaagtgtcccaacagtggagcacattattcaggaacttaaagatatattctcagaacagcacctcaaagctcttaaatgcttatctctggtaccctcagtcatgggacaactcaaattcaatacgtcggaggaacaccatgctgacatgtatagaagtgacttacccaatcctgacacgctgtcagctgagcttcattgttggagaatcaaatggaaacacagggggaaagatatagagcttccgtccaccatctatgaagccctccacctgcctgacatcaagttttttcctaatgtgtatgcattgctgaaggtcctgtgtattcttcctgtgatgaaggttgagaatgagcggtatgaaaatggacgaaagcgtcttaaagcatatttgaggaacactttgacagaccaaaggtcaagtaacttggctttgcttaacataaattttgatataaaacacgacctggatttaatggtggacacatatattaaactctatacaagtaagtcagagcttcctacagataattccgaaactgtggaaaatacctaagagacttttaaaaataggctttcttatatttgat

SEQ ID NO: 66415 - DNA, 1563 bp, Homo sapiens
tatgctctgtgtatctcttccatgctggtactttcaccttctgcttctcagggatttctcatcacttttgtgttgagtcctgagattcagcaacctccttcttatgggacatctccagggttaaattgggaagtaagatgatttgtgtcctcttgaatttaactccaagtgccatggtgtatttttgtgcctttcattagccagtaaacacttataacccaaagttacgatgatttaggtagaaaataagcaaaatgatgtattcttttttccctaagactttgttataaccttggagtcattaacagcttattctggttttctcattgtctgtttgtttgaagaatgtgtactatataaagaatttatgctcttgaaagaattaaattgactcagaataggcatttgtatttgtgagtctaagatgatacactagaggtcagttttttaaagatgatttgtttttttctttttttttcttgacatttagagtgaagatgaaatcaggacactgaaacagaaaaaaagtaagtgatagtgttaatgactcaacttctgaatgccttttaaaaaggccttgacctggtaaggacaaataaatatgttctgtgttgaaaacctaccttgagaatgaatgtaggagtgtgctcaattttgtcctgtgttttggaattatctatgagactaaagtctaattttagtttgtctttattgagtgctgcaatgccacacactatgctatatgcaggcctcatggaggtgacgcctcctctctcagtgtggtaggggtggcaggcacacagtgctccattgtagggaaggaagggcaacagtagaggcatgcactgaatctctttttctgtccacccagttgtggtatgtaataaattctttgtaaatgtttaaggactaaatgctgtgggggcacatagtgccattgtgagtagtggtcacaacagcctttctggaggtgctgatgtccgaattatgtcaccaaaggacgagggctagaagctgtttttcttcttgtcagttattagttactcctcctcctctgtttcttcctcctattgctgttattattaacgtagcattttattgagtgcttactgatgccaaatcattgttctaagtgctttacttgtattaattaatttaattctcacaatagccgtgagataagtactgttatttccctctttatggatgaggagatatggacttgggcaaagagagggaaaggtattctgtgcacgaaacagggtgctgttttggggaactacactcattttagtgttgttaaagtttgtgataacccattatggttagaaaatagcctagagaggaccccagaggccagaacttgcagacttgtgggctattagcaatagggaaccactgaggggtttataagtaggtgataacagggacctgatttccatggtacatagagtactctgttggattagaaaaggtaacactggaggcatggaggctagttagactgtcaactgaccaaataaaagttgaaaggccttgaattaaggcaatggtagagagagt

SEQ ID NO: 66416 - DNA, 1391 bp, Homo sapiens
ttgtagagatggagttttgccgtgttacctaagctggtcttgaactcctggggtcaagccgtctacccggccaaggcctcccaaagtgttggaattacaggtgtgagccaacattcctggccaaaataaatatttgtaaaatgtcatttttttcattcatacattctgttttctgatctataatatctttgctttatttgcaaatagaaaatcaatttgatttgacttttaaaaatttgttaaaatgttttattcctcccctccttatttaataattagtaagatatcaagaattgactgtgtatgtgtttttgcttattttggggacatttgctcggtgtgaaagatgggggagctttgaatataataacttgtactcccttcagtgattgtgtccctaaccaattcctcattcagcctccctagtagactcaggatcacgagcccagcactagaagttgagtgttactaggaagtcagagaatcatctttgtgttttctattatggcatggaattgaactagaaaatattgactctgaatagaaattcatcccaaatgtgtttaacaactctttgggtacaacccaagatagtgtgttccatttagatacatgttttcccttcatgtcttcccaacctcccttccttgggtgaacaaatttagaagttgttatttttgtttggcatgttctttgagcatgcttagatattttgaaataatcactgcttcaaagaaagcttatttaaatgaagtatgtcttatctttatcattccaaattcaggaagaaattaaaggcactattctttggactgtctgaggggagtgtaatagcagttatttattactgtccctcttaataagcttcttgtcttttactcagcctcctcagggctggcagtaggaccgttaccatctaagtatgcatccagcttctagccaagttggatgaaattaacaggaagtagggtagagtatgatcattctttcataagatgattaggacttgaaagagatacagaaatacctagattagcatttgcaaaaatgtgattatgtatatcagtatcacttgtggcgtgagagttggtttcatgtggcagatgaatcaatttttattttagaagttttgtagtatgtgttaaaaacatgtttaaaaacttttttaaaaacataagataacatcagatcattcttcctacagttttattacttaagacagtgttaactaaaaaatgagtagattgtgtaaaaatacagatggtaatataactgaaatggcaagcattgtgatcattagtatgtgaataatttcattttaggaaatgttgatctagttcaataccagaattttattcagaaaaagaaactggggcccaaaaagggaaagt

SEQ ID NO: 66417 - DNA, 1128 bp, Homo sapiens
gattacaggcgtgacaacacgcccggcctaattgctgattttctacagtgacagtgttgttttgtatgcttgttgaagttgaaatcctgaagggaatgttaagctgtgagccttgtggctgtgcatgcagctttctgcttgttctgctgatggttgaatcttctctgatgttttgggagttggaagatgcaggtttcagttctagttctgctgatgattttgtacttccctccaaacaagttacttcttaaccttgtctgtaattgaaatgttggtactaaatgacttctaaggttttttccaactgttattttgttattaatcaaattctccaaattatgttctcagggaggggagcaggaatccgttgttattaatgtatgtttgccttaaaactgaaggctgaaatttaaatgctgagctcattttcataattgtattttggttttatttatagatgccagaagtgggtggagaactgtaggagagcagacttagaagataaaacacctgatcagctaaataaacattatcgattatgtgccaaacattttgagacctctatgatctgtagaactgtgagtaatagaagagcttggtgtctctctgtttgacttgatttctctctctcactgtgtctggttggaaatgtaagtatttaccaatgttggaaggtattcctatatcctgccactttaagatgaagacagatttggagctgaaaagtatctgttttgttcttaaaatcctgattttgccgggggcctataatcccagcactttgggaggccgaggcaggaagaccacttgagctcaggagtttgagaccagcctgggcaacatggccagatgccgtcgctacagaaaataccaaaaaaactagcgaggtgtggtgacgtatgcctgtagtcccagctacttgggaagctgagatgggaggatacttgagcccatgacgtcggggctgcagagagttgtgttcatgccactacactccactctgggcgacagagtgagcgcttgtctggaaaaaaaactcaaaatgattaaaacaaaacaaaacaaaacaaaactcttcggttcctggtgccccatttctactcacccaaggtaactactttttttttt

SEQ ID NO: 66418 - DNA, 1015 bp, Homo sapiens
cagtgccagaatgagtgaccgctatttagaacaaaggattagtatcaaattttgcgtgaaattgaacaagtctgcaagtgagacccaccatcttttaaaagaagcttatggggatgaagtcatgtcaagggccagagtttttgactggcacaaaaggtttaaagaaggacgggaagatgttcgagatgatgcccgaagtgggcgtccagtcacccaccgaacagatgacaatatccagaaggtcaaggacttggtttgttcaaacaggcagttaaccgtgaggatgatggctgaagagttaaatttagacaaagaaactgttaggctcattttgaaagaaaacttgaacatgaggaagatttctgcaaaagttatttcgggtgttttgaagggtgagcctaaaccacgaaaacttgactttcggtccgatctttcaaaggaaactaggaaaaatagctcatgtttgaggaaaaaggtaacaggttctgaaacatggagttatctccagggtgaagctggtggggaaatgcccctgccggtatcccatcccagagtccactactctgccagtcagcttctgcaggcgtcatcttcaacaagccttccccccagggtagctgagaattggttcaccccatggtgagaggaatgtgagttagctgaaccagaactaggatgctgcctcactgttaggcaccttctttggctgctcacgtatttttcagtcttcaccactcctccctatgtgccatggccctcctcattactctttgctggactcttggaccattttccttgctgttctccataactttgaaaaacttttggctgttcccttctggtatttgcttgttcttgatttcttttgctcaacaagtttggatttcttctctgcccagaccttagcttgttgtggctgtcctgttcctttgttctcaaccttctgcctcagaggatcatgccagtgagaagagaggaacaggatctcctggaatctgtatctctgtgcccaggg

SEQ ID NO: 66419 - DNA, 1010 bp, Homo sapiens
tagtaggagagatataaaataaacaaatgaaaaaataaaatattgggttataaatgtcaagaaggagccagctttggaaaatttaggggaagaactttctatacaaagagaacagctagttccaagatcctatgggggtaactcctgtttgctctaggaacaaaaggaaggaaactgtggccttgtgcatggaaaatgctttcttctttatctgtaaatgaaaatattcttatgtgtcaggatgtagttcaagcattgcctctttagggaaatctatcctgatttctcaggtagaagtgaccactatctcctttcctcctcaccgcccctgagtagacttctgtgagcacacctgtgacactttgccattcttaccacattaaatcattgtgacttcctagtggacctcagtctcattcaagggcaggactgagcttcctaactaaatccctaatgttcaggatagaacctggcacagagtctgtgatcagtaatggtttgttcctagaatactgaactgtcacccagcaccctatcagagcctcactagtgatgcttatttggaattgaaaacaatttattgatcagtgccaggccctgtgctgggtactttccaccctgctcattcttataagtctcacagtcaacatgtccagtaagtatcactattttattctataactaaaactcaggccagactcagtggctcatgcctgtaattccagcactttgggaggctgaggcaggaggatcacttgaacccaggagttcaagaccagcctgggcaacagagtaagaccccatctctacaaaaaaataagaaaaactgggtatggtagtgcacacctgtagccctagctagtcgggaggctgagatgggaggatcacttgagcccaggaaatggaggctgcagtaagctgtgattacaccactgcactccagcctcccaaagagggagaaagttagagaattaaagtgattatctgaggtggctcagtaagaagaaaca

SEQ ID NO: 66420 - DNA, 1021 bp, Homo sapiens
aggagtcaacttgccccaggttggtagtaccacctgtttattaaatgaaatgccagccactatgaaagaactttatatatagtgttctttaatacgcgtaacaaactgggtggtattacctctgttttatagatgtgtaaagcttaggcttaaccagtaagttgaaaagttgggactagaaacctagaggtgtctggctctaaagcctgtgttctttccactgtgatagttcaaatgacttaattcttgatttctcaaaagttggaaagtgtggtggtgagaaaggattgtaaaatagtaatatctttttggtttacttcttagcctgtgactggatctccaggtgagtggccccttgaatgtactttggtactttggtaatttgactttttttttttgttctggtagggaggacaagctctttggggctaccaaacagaagcagcaatgcctgttgtgtggccaacccttctggatctcagcagggatgaatgcaaaagaattcttcgaaaattgggtatgacgttcattgtttgttttttacctctctctgataccttttttccctttctgcctaggtcatagctgtttgcatggatgtcatatctcacgctacatcagaaattctttggagatacagttcccatcttactcattgttgtttccctcagtgcctaacatagtgctttgtaaatagtaggtgtgtgaattgtaataatactagtagctaagatttattgagggctacttggctattctgagtcttttttatacaacatctaatttaaatattttaagaattagctttgtcctttgaaagcctaaaaggtaggtgttttttgtttgtttgttttgtctcgtctccattttacagatgaagcttagaagccaaggtaatggtgatagacatggagtcagtatttgaaccagggagtatgctttcagtctcactttaacatactcttaaccttcatgattgtatgtgtcaattacatactatttctgaattctaagttgatgt

SEQ ID NO: 66421 - DNA, 1060 bp, Homo sapiens
gctggagtcagaatattttgttccaatattttttccattgcatactatttacagtactttcgattacacaggagggaggtagaatatagtttgaattcttaggcaagcctaaggaattattttaagagttgattaatgaagataccttttagtaatgctgaaaacgtctcagccttgttacatcagttggtgcctattcccagttgttggtatcatttgtgttatatgttttttagtgacaatgtgtgaaacaaaatatctactgttagatttttctacctaaacattttatatacatgacttctgtgaggcaatgaaaaacaaaatataaaattataaaagtcacattttaatgttattagataaaatttttgaaaggaatttaaaacaatatttttatttaattatttttagtttttttgccctgaagtttcactatacatagccatagtattaaaatattaaaggcctatcttgataaaataattttcttcttttagaattggaggcatatgctggagttatcagtgcacttcgggcacagggggatctcaccaaggaaaagaaagatcttcttggagaactatcaaaagttcttaggtaaattattgtaaatgtttgtgagactctagaaatttcattttgggggattttattacttatcactctcaaattaagtaactgtcaaattaagttgaagaacagaggtgttcaaattgttggtgctaagagactccatcccagttgtgtgctctgttacagaaaattgtataatttaccatttattgtgtaatccagaatgaatataatccagaatgaagagcgtgcaaactcttcagaaagacttgaaggcagtttatcttacttttagcccacctggataagggaggtgcttttgacataggtgaaggaaagaagagcagtaactggatgtgatgatctagagtggcatttgttggagggaagaggtgatgtgaggaagatgccttaatttacataaatgggtagtgattatgtggtcatggccttaaacatagtcttttttaagtgaaaatatgga

SEQ ID NO: 66422 - DNA, 1488 bp, Homo sapiens
ggaaaggtattgtggggcaactagttgtaagttgatgcatcagtttcatacttaaaggataacatttatttagtctccttttccttttttcccctttaaagaatgaatttatccttatatttgggtgaaagaccaagttacaggtatgcaaataggttattattatttcaggctttttcttgtatttatttccaaattgaagctctcaattattcaggggcacattattccatttatgaattaaccatgccccttgctttccttctcttcccctcctccccctcctaatactgcccaccctttagccattttgctgcttgggagtacctctagtcagagggtgggaagggagaggaggtgaaaattttaattagtcattttactacttgttagttgtcctggaaaaggtttggtggaagaatttacaagtatttgccaaaatatttttggataatatatgagtttctttaatctatttgacctctccctttccctcctctctccatcagcatggataattgagagttggcttttatctgcctgtgtttcctcttttttctctcctttctgatttctttaatacataaatttcatttttttgaaaagagtttacttcagtgtataattttgagcttcttaggtttttctatattcttgttttaatatattattgttttagttggatcagatgttttatctacttgttgagctcaaggggtcagtgagtggggattggtgaggaaggaatagatctctcattctttccatctcctctgccctcttcccctcagaagtagcaacagagcctagttccaaagattatctataggagggcttcatactccaagcctagaaaaacaactaaaggaatgcgcctgaactgactgcattccctttctcctcccctcccctccccccactcaaaataggagttaaggcctgaaggaatgtggttgaaaggtgatgagaaagctgagaagattgagcacaaaggagggggaaacaaaaggagtgggatatctgggatcaaagaaaagcctttcttgtggcttgaaacataacacgtgtttattgtttggcaccaggccacttattaagtagtttgatactcttaattcagtttttaattatgtcagaatgttacagtattaacgccttggatgtcaaggagcttcggattttttaattggaccactcttgcccatgttgtctctagattcaggagaaagtgtctatctggaatttctgctctcttaatcctttccccatcactcagacattcacaggatactgggtcagtttctgtgtgaggatgaggatttcttactggtgccttatacaccaaaggatatgtgggccaaggtagtttcattagtataatcttagatttctcagaaaagggactggagcaaggtttcccctgtcatacttagtataaatagagagacacttttatactcacactaaagtatctcagtgaagccctcc

SEQ ID NO: 66423 - DNA, 1010 bp, Homo sapiens
gtttgcttagagagttgaattgtctcaattccttcttagagtgaagggtggtataaataaataaaattaatggtgcgtttcttctagtgtcgttagatctagtctgtttttaacaggaaggataataacaatacattgtcagtgacacatacggttatatatacagcactcttctgttcttttctacttaggctcccttgtttactgcctcagtttcccttgtttgaaagccttagaacctctggccatgcaggcagttagataattttcaaaaggttcagtgaattccatccttaattaaggaaaatctgacttttaaaattataagtgctttttactttcttgtgttaattataaaattaacttctaaaaattagttgaaatactagttttcattagtgatagcagatttaagttaatgaaaccaaggccgatatttatttagaaggcataggaagatttcttgtagtttcagttatgttcatgataagattcagattatagaataaactgtgtaagaacctaagtgtgtgacattccttgaattataattattcataattttgatcttgcttgcttaaaataaagcctctcctattcactcagggcactttttataatttaaaaagttatatatgtttgagcatatatgtttgatttgtttttagtgattgaaaacccttgtagcagcgctttcttttttgtttagtatgtctggacctaatagctcttcagaatggtccattgaaggtcgtcgattggtaccactgatgccccggctcgttccccaaaccgcctttactgtaacagctaatgctgttgctaatgcagctatccagcataatgcatctcttccagtgcctgcagaaacaggaagcaaggaaggtgagtagaaaaatatgcctgtgttagagattacttttcttagaatcttcaagaaaatttcaagaaaagttgtcttatttttcatctacttttattctagtgtttaaaggttatgaaacatagta

SEQ ID NO: 66424 - DNA, 1004 bp, Homo sapiens
tcatctgaggtcaggagttcaagaccagcctggccaacctgacgaaacctcgtctctactaaaaatacaacaacaacaaaaagttagctgggcgtggtgacacatgcctgtagtcccagctactcgggaggccgagacaggaaaattgcttgaacccgggaggcagaggttgcagtgagccgagattgcgccactgcactccaccctgggcgacagagcaagactctgtctcaaaaaaaagaaaaaaaaaaaagaaaagtggttaatttggctcacgattctgctggttggaaagtccaagtttgggtgaggatcttatgctgcttcaactcaaggcagaaagtggaaagagagcaggtgtatgcagagagatcccatggtgagagaggaagtgagagacagaaactgaggaagccagaatcttcttaaattttattttttgctttgtttttcctgtcaactggaggtgattaatatttgattttcatttttctcaatatggttataaacttgatttctttgtaacttagaggtaaagtttgctgttttagacaggaacaattctaggtctttgtcggccctgtttaaattaaaagttaaaaaattgaaggtgtaggggttatattttattactaatttcatgagtcatgctatataattgtttatgtctgctctgcagagattttctatgttaagttgctgtgtttcatgtttctcacttgatttttaaaaagtctacaaaaacagttgaggctttagttcataaagaaaaaacgcagaatctaggactattaattaaatttatatctgatttctgcagatttagccaaggtggtcttttaaaataactgtagagacctactttttgatcatttttaaaacactaggctggagccgggctcagtggctcacgcctgtaatcccagcactttgggaggctgaggtgggtggatcagttgaggtcaggcgttcgagactaacctggccaacatggtgaaactctg

SEQ ID NO: 66425 - DNA, 1039 bp, Homo sapiens
catataatatgtagttttaagtaacaggaagattattgctttatgctcagaagtcataccaacaacattagtttgagatgtaattgtttatttacctaactttgtatgtgcaaggcactatactggggaaacaaaccaataagacttagtcattaccctctgggagccccttactaatgggagatatgtagacaatcacattgccatctggtaagtggtacagcttaggggagaggtggattagctttgcttagaggaataagggaaagcttcactaaggagatggcttgtaggatgatgattgcagaatgatgaagaggtcattgatgttaggtggtattccccaaggaacaatagtatatggatactcagagatggatagaatgtggttaaggtggctttggggaatggttagcagttcagaatcccaagattataggggtacatggggttggatgtaacaggtattgtgttcttggaaagatatggagtcttgaatgatatggtaatgattttgtgcctcatcttgtagggagataaaaactactaaaggattttaggcagtgcataggcatgatgagatgtgaaattttgcaactagtagtaggattgagggtagatagaagtggacagactggaagcatggacatcttttaggtgattgttgctaagatacaggcaggagataagaaggcctgacatggccataggtttaaagaaaggagggaaggccaggcacggtggctcacgcctgtaatcccagcactttgggaggccaaggcgggtggatcacctgaggtcaggaggtcaagaccagcctgggccaacatggtgaaaccctgtctctactgaaaatataaaaattagctgactgtggtggcgggcatatgtaatcccagctacttgggaggctgaggctgaggcaggagaatcgcttgaacctgggaggcagaggttgcagtgagctgagatcacaccactgcactccagcctgggcgacagagtgagactttgtcttaaaagaaaggagggaaggcag

SEQ ID NO: 66426 - DNA, 1112 bp, Homo sapiens
aaaaaaaaaaaaaaaaaaagaaaggagggaaggcattcagagaccacttctctgagggaagattgatagaacttattggctaatggcttaagacagagagaggacaaggatgatataaagattttaaaaataaagtgtataatgcaagattagtttggtatacatatagcagtattgtcattgcccttcaggtgtaagctgttcagatgaagatgaaaaacccagaaaacgaaggcgaacaaactcttccagctcctctcctgttgttctaaaggaagttccaaaggccgttgttccagtctcaaagacgatcactgtgcctgtgagtggtagtcccaagatgagcaacatcatgcagagcattgccaactccttaccaccccacatgtctcctgtaaaaataaccttcactaaaccatcaacacagacaacaaacacaacaacacagaaggtatgtggtggagggagtctctgcctgccaattgtttctttcagacagtatgattcagatttaataaacatgcactgagtgcttactatgtgcttggcattatgctggggatgttcacatcttttactttgtttaattttccagataaggctttgggataggtattattatttcagttttgcagatgaggctttgcgatgttaaatgacttgcataatatgacacagccgaatctcttctaagaattgtgctctattttatagttgtaatcctatttggaaaaaatttaaaatagaaaaaaattttaacctatatttgtatgaccttccctgtagcaactcaggttttaatttgccaaagtagtaaagttgtcaggtgtttcatagaagaaaggaaggatataattaagtgaataacttttgttatcttctttttaaattctttgtatgctgttattaattcattcctaaactcttctctaaatatgttgaagtcattattattttgtcagtttcatgtttttagacccctctgtcttcccacactgatctggatggaccataatggctctctaggcttgttgtacacctatatttctgggatctctctttaaccatcattctgatcttctttgttagtttctttgcttattttgccagag

SEQ ID NO: 66427 - DNA, 1290 bp, Homo sapiens
ctttttttatggtttaactaggaaaagtattctaggttggaagtgattttccctgtgaatttttgaagatgttgttgctctgttggcttccggcttccattattgattttgggaagtccagtaccattctaatttcagatactgtttttctctttacaaactttcagtaactttcagaattctgaaatttcaaggtaatgttccttggtgtgggtctttatttcatcgattaggttgtatactcagtgggcccttttattctgaatatttatgtccttcaattctgatacatttcttgagttatttgatttgtctctgttttctctttttggatcacctgttatttgcctattgaactgcctggattgatccatttatctttctcatttccattttccatttgtttgcattgttttcctactctaatataatggaaaaagcctgtattttggaattggacttcttggattcagatcccagcttttgccacttactagctgcgtgactgtgggaaaactaaactctctacccgagttttctcgtctataaaacagagaaaacaatgtatttattttataggatttttgggtgtaaatacatgaaataatatatgaaaaattgttacagccttgcacgtagtaaatgttcagtatttttattttctttatcatttaattttatttttcactacatttatagagtttttcatttttgctctcatactttaaatttctagtaactctttttctctcaaagttcctttaaaaaaaaaaaaagcatcctactctttcatagaagcattgtattctcttacctaatgagattcatgacaattttttaaatgttttcttctttcatgttctctctgtaagttccttttatctatttgttttgatctcttttatttagttttcttaagtgtctggctgtctgcttacgaatgaaaataggcactaaaaaggtgacagaaagctctgtgtgtatgggtgggacatgctgactggtgactttcatcgtaaattgacctagctggactattttgttcaggaacatccactacccctttacctccaccatttgtcactgtctttagggcttttgtttggactggtaggattgttcagaaatatcccagtctcctgcctcgagtaatataagcctggttggcagtgttttgtttgggggttaaatagagggaaagggctgggtgggctcaccattcatgatatatatactttacttatctcctctgtttttagcgtagtacctggccccccagatgtgcctgat

SEQ ID NO: 66428 - DNA, 1067 bp, Homo sapiens
taaaaatacaaaattagccgggcgtggtggcacatgctactcggtaggctgaggcaggagaatcgcttgaacccgggagacagaggttgcagtgagccaagattgtgccattgcactccagcctgggcagcaggagctaaactccatctcaaaaaaaaaaaacaaaaaaaaaaacttaacgtagtacatacagtgagtgctcagtaaatgtcacctaacactattaacttttcagtcttcttcggtggacttagctaaaaatacgtgtagtagatgaggactcagtgaagtttgtgaactttttttaagttcattgactttaccatatatttatttttattttttttcttctgaattttcaattgagaatggatagttgaggttttcagacttgggatgtttgaaagagggcatatttatctcccaagttatatatgagccataccatgagagttcaggttcagaaccttagatttggcttactatggttaaaaaaaacaaatgtttaaaacaaattaaattaaaaataagactcattcattccacaaatatttattgagcacctactatgttccagatgtaaaactgtactcttttacttcttgtgtactcaatgccattacttttattattttgtggacaagctgatatgggtaggactaataaatgttcttggagttttatgtttttcttttgcttgggtaattggatttttctgaaatctatccaaggctgttgccattattgcattcactttggatttgtcacaaatcctgtataaggcaacttaggaattattgtaggtgaagtgatttttatattaagtataattatttatgaatttgtggactttattcaaattcaaataggtaatatattttcagggtagacacatttccacctgtgttaatgtggtgccttcattttaaatataacattgatgcagcacttatatatcagagcagcagaatttagctttatgccttcatgtgcttgattgatatttttcattttgtccttagggtgcaagtcccagcactcttaaggagtttttgtgagtgctagaa

SEQ ID NO: 66429 - DNA, 1114 bp, Homo sapiens
gtacacgtatcatagaattgttaggagatttaaataagccaatacatattagccctaggagctattcttgattccgttcttttccttaaccctgccattttcattcatcaacaaatcctattctctctacttttcaaaataatctgactttgatcacttttctttatttctactactaacactccggtgcaggcagcctctatcattttctgcttggtctgatgcaatagtttaagtggtctcactgcttcccctcttgcctcttatcatgtagcagctagagtgatcttttaaaatatacatcaaattttgtttttcttcctacttaaaatattcctgtggctttctattatacttagtataaaaatctaaattccacatttgatgtagcctctgcttacttttccaactcctctttgccctatgtgctttttgctacactgctttcttttctgtttttaaatttatcaagctacttctgacattagttcctttccttcatactattctctctgtctggaatgatttgtcactaaatcatctacagttttctagttatactggcaaaaccttgacatctctttcctgcctctctttttctccattcttcatatcaatatacaagcaaatcctgttggctttacctttgcagtgtattcagaatctgttcactttttacttcttccaccacaaataccttgttcaccatcatccctgcctggtttgttacaggagcttcttaatttgtctccctgtttctaccttcattgccctactgtactttttacctaataggtagagtaatgattttttaaaaaatggactttattttttaaaacagttttagatttacagaaaaattgagaagatagtacagagttctcatatactctgcacccagttttctcattctctttgttttgttttttaccaacttcctgataagtctcctttattctgaacattttacattggtgtgatacattgttatagctaataaagactattaatgcattaatgttaattagatccatggtttattcatatttccttggtttttacctattgtctttttctgttccaggataccatattatatttagttgttatttct

SEQ ID NO: 66430 - DNA, 1334 bp, Homo sapiens
cttgacaattttgaggagtactggtcaagtatcttgtagataccccaactgttagaatttgtctgatgttcttctcatgattagactatgattatgggtttttggacagaagacctcagagagaaagtacctttttcatcacatcatataaagggtatatactgtcaacatgctcttacatggtttagtccttcattacttctctgcagttgtctactactactttgtaccctatacatttctatcccgttcactagatctttgaagtttcttgaacataccaagcttgcttctgctttagggcctttgtatttactgctccctgtgctgatggatggtcttctgggtagcaccatggttcatatccctacttccttctggtttctgttcatatgtcaccttactgagaggtctttattgaatacattacttaaaaaatcatacagtgctcccatcattctttattctcctaccatacttttttgtctcttccatttgtctctgcgtgacatatacttacatttctgtttatttctctcccactactaaaatgtaagctacttgaaggtatcagctttgtttcttttgttcattcttctattctccagcgtctagaaccatgcctggcacatagtaggtgctcaataaatatttataaacgaatgaatgtttaaattactttctagaaagagtgtgccaatttatactccctaagtagtatgctgaaatgtctactttcctgtatcttatacagcgttgatgttatcttttaaaatatttgatttgtaaaattgttgcttataaatgcattttgatgattactagtaaaggaaaattttaatatatttttagttgtatattctctgttgaattgcttcttcgtttttcataagctatttttaaattatatataactaactgtgagtctagatacattagtagtttagtaggtacataaaaataacttattttttattccttaggttattatagtcaccacatcaccaagctcaaccttcgtgcccaacattctctccaaatcccataactatgcagcagtcactaagcttgtaccaacgtcagtcattgcttctacaacccagaagccaccagttgttataactgcttcacagtcctctctggtcagtaatagcagcagtggcagcagcagttctacaccatcacctattcctaatacagttgcagtaacagctgtggtgtcctctacaccatctgtggtcatgtcaacagtagcacaaggtgagtgctgtttcacaatttaattctgtcacagttgctatatggaattttgaagaaaacttggtgggtatgtt

SEQ ID NO: 66431 - DNA, 1095 bp, Homo sapiens
ctgcctcccaggttcaagcgattctcctgcctcagcctcctgagtagctgggatacaggcgcgtgccaccatgctcagcaaatttttgtatttttagtagagaaggggtttcaccatcttggtcaggctggccttgaactcctgacctcatgatccacctgcttcagcctcccaaagtgctaggcttacaggtgtgagccaccgcgcccggccgtgaataatattttttacatatttggaataaaaagttcatattctatttggtagcatgctttcttcatatatcgttgcttcgttaacatttttctataaatatcctaattattttcagagctgtttaatatttttattattgttgcataatttattaaatttattataatatataatgtataataatttattaaattattcccttattgttgggtatccagtgtgtttccagggtttgatattctagatttaactatagtgaacatctttgtgaatttaattgagccttccattttcttagaaccagcactcaggagcaggattaccaaatagaagaattggaatttttttgtagagtttactaaataccgtattttgtccccatgaactatataccctttcagaatatttcattagtatctggccactattaagtccttattcttcttgttttaaaaaaaaaatggggcagagggaataattttggcgattaaagaaaaattgagtagcatactgcttaaccagtacagtttgatcatccctaatccgaaaatctgaaatctgaaatgctctaaaatctgaagctttctgagtgccagctgatgccacaagtggacaattccacacctgacttcatgtggtaaattgtaattaaaacacaggtgcacaccacacagtttattcagcgttcccaagggaaaaaagactccttctgccttctgtagcagtgatatatcttttccttgtacacccagattcccctcacacaagcacttccacagagggtaataaaatggcatgtatgcaggctggatgcgccaataacaggttccccgcaatgccccacatggggccaagacctatgtgcatcacttactgtgt

SEQ ID NO: 66432 - DNA, 1483 bp, Homo sapiens
caaacatggattaatgtctttgtttcagtgatattcacagtagcccatttttttgtgtgtatttaaatgtttcataaatttaggctgagtgcattggctcatgcctgtaatcccaacactttgggaggccaaagagggagggttgtttgaagctaggagttcaacatcagcctgggcaacgtagcatgacctcatctctacaaaaaatgcaaaaattagccaggcgtggtggtgtacacctgtaatcgtagctactcgggaagcctgagtcaggaggattgcttgagcccaggatttggaggctgcattgagctatgattgtgccactgcactctagcctgggcattaaaagaagactgtctcaaaaacaaaaacaaagtttaataaagttattgttacagagcccatggattatttatgctattttttttttgtttttttttttattttttagctggatctggagattcttatatggattgttaatatccaaacttacttgcaaaatacgatgtgattgaatgaatatctttacataaatctgcattgatcaagtgattggtttttcacaataaaatttattatctcacaaaaccagaagtccagaagggaggctcaagttaggcattagctcatttgagccatcaaggaatttcttttcacctttctctttgcttttcttggtaattcttgggtaactcttggggcttttttcttgggtaattctcatcctgggcaagttgagtacatttcaggttctacatctagctgtgacaatgtcagagaaaaaagagagaatccccttctgtgggtctgtcttaggaaagaaaaaatctttcctagaagtcttccatgagattctccttatattatgctggccacaactgtgtcatatgtcctacctaaactagttctttgcaaaagtaatggggccaccatgactggcttagatcaattaggaattgcctgtatggctggcttagggccagccctctgaaagtacatgccaatgccttgtggattcttcaggaaagacaacagattctattagaaaagaggagggcagaggagaaaggaaattaggacaggcaaccaagagtgtatgctgcattcgattatttaataaatggttttagaataattgacttttcatttggttctgtgcatgtccatgttacttggttgatggacttgatcagattcttcttgttttctttttttttttttttttggtctacttgttatgtcagttactgaaagggaagtgtaaaagtctgtagctatatttgtggctttgtacatttctccctttaattctgtcagtttttatacacacacacttaggattattgtgtcttcttgatggattaacccccttttcattatgaaccattcctttttatctctggtaacccttgatgttatcaccagtgtttccatgtctgtcttttctgatgttaatatagccactccaactttctta

SEQ ID NO: 66433 - DNA, 15344 bp, Homo sapiens
aaaatctgagaacaatggttacctcccttgaagagtttgaagactagatatcagatatgtaaggtgccacacattttatctgacacttactaggtgctcaataaattgtactttttgttgatttccctattctttaaactattatctactataataaccagaagtaactttaattttgctttcctatcaaattctcttttcccttactccttttctacaggtgtatctacatcagcaatcaaaatggcatcaaccagacttccttcccccaaaagcttagtgagtgccccaactcagattcttgcacagttccctaaacaacatcaacagtctcctaagcagcagttatatcaagtgcaacagcagacacagcaacaagtggcccagccttctccagtatctcatcagcaacagcctcagcagtctcctttgccacctggtattaaacctaccatccaaatcaaacaggagtcaggtaactggaaaatgtttataagatatggtaattcttctttattcaccagtttttttagtcttccagtccatgaacacggtatgtctcttcatttatttaggtctttgactttttcatcagtgttttacagctttcagcatatagattctgtatatgttttgttagatttgtacctaagcatttcattttcttgtcgtgattataattggtattatgattttaatttcaatgtctacatgttttttgttagtatataaaaatagtattgatcttgtatcctttgaccttgctgaactcacttgttctcagagtatttacatagattccttgggattttctgtgtatgcaactatgtcatctataaatagggacagttttgtttcttcctttccaatcaattgctgtttatttctttttggtgttttattttattgtctagaacttccaatactatgctgaatgaataagagtgaggaaagtggacatccttgctttgttcctaatcttaaggagaaaacattcagtttttcaccattaagtacaataccagctgtaggctttttatagatgctctttatcaggtagacggagtgcacttctgctactagtttttggggagtttttatcatgaatgagtgttggattttgtcaagtgctttttctgttcaattaagttttttcttgtttagtctattgatatgctggattatattgattgattttctgttaaaccagccttgcatatttgaaataaatcccacttggtcatgatatataatttttaaaaatacattgctggattcaatttgtctctctattcatgagacattttggtctgtaatattcttattttatactgcctttgtccaattttggtcaggataataccggcctcataaggtgagtttggaagtatttatttcctttctattttttggaaaagactatgtaagattgatgttaattctttaaatgttcagtagaattctccaatgaagccatctgggcccggagagttctgtttttagaagcttttaattgatgaattccatttctttattagttatgggacttttcagattatctgtttcatcttggttttggtagtttatggttttgaggaattgatccatttcttctaagttgtcaaatttttgagtgtaaatttgcttgtagtagttctttactattcttttaatggctataggatcgatattaatgtcctgtttcatttctgatattggtggtttgtatctttctttgtcagacttgctatttattgcatttaaaaatttattgaattttttaagaactagatttttgtttcattgatttttcctttgcttttctgtttttaattttattatctttattatttctgtcctactttctttaggtttattttgctcttctaatttcttaaggtgggaacttagattattgattcaagacatactctcttttctaattacttagcatttagttccatctatgtaaagacatttgtcacaaatttctctcggcactgtgttagctgccttccacatattttaatatgttctgttttcatttttattcaattttttgtgtaagacttcttctttgacccatggattatttagaattgtgttgcttaatttctaatggagatttttctgggtttgtttgtttgttttgctattgatttctagtttgatttcattatggtctgagaacacactgtatcatttcaattcttttacgtttattgaggtttgtttcttcacccacaatatgttcaactttggtgggtggtccatggtgctcgtaaaatatctatgctgccgatgttgggtggagtattctatatatgtatatcaactagattctgttggttgattatgttgttcagttctcctatatctatgctgaattttctgcatagtagttctattagttgatgggagtgaagtaataaagtccccaactaattgttggattctagtactgcaaaaacagctatctcagtttttgctacatgtattatattttgatatatctattgtttgatgcatacatatttagaaacattgtgtcttcctggtatattgatcctgtctcattatgtagcgttcctttttttctgcaattaattctctattttttttaaatataaaggctgattttaaaaaatttccattcttaaaatttaattccaatttaacttgtaaagtctgccatataaattaatgatggtaactagcctgcattagtatatttagtgcatgtaatagagaactatactgactggaggggagtgagttctattgccttgtaaagtatactttatctgtaattaatatagccactcctattttctttttattcatgttcacatagtgtatttttttctcatcctgttactttcaacctacttttattgttgtatttgaagtgagtttcttgtagacagcatacagtgtagttatatatttttatatcaactttgccaataacttgtttttgtttttgagacggagtctcgctttgtcacccaggctggagtgcagtggcacaatctcagctcactgcaacctccgcctcctgggtttaagcgagtctcctgcctcagtctcccaggtagctgggattacaggtgcacactaccacgcccaggtaacttttgtatttttagtagagacagggttttaccatgctggccaggctggtctcgaatgctgatctcaagtgatccgcccacctcagccttccaaagtgctaggattacaggtgtgagccactgcatctggccaaccaatcttataacttttttttttttttttttttttttttttttgagatggagtcttgctgtgtcgcccaggctggagtgcaggggcgctatctcggctcactgcaagctccaccttctgggttcacaccattctcctgcctcagcctcccaagtagatgggactacaggcgcctgccaccacacccggctaattttttgtatttttagtagagacggggtttcaccgtgttatccaggatggtctcaatctcctgacctcgtgatccgccctcctccacctcccaaagtgctggtattgcaggcatgagccactgcgcccggccccaatctttaacttttaaatgatatatttagatcatttacatttaaggtaattgttgatatggtagtggttacatgtgccgttttattttgtttgtttcttttgtttcttgtttcttttttcttgcctatttgtagtttacttgaagaatttttagggtttcatgttgacttattattttaaagtatattgttttgttctgttttcttagcgtttgcttatggtattacagtatacatgtgttggccatgtgaggccaggagtttgagaccagcctgggcaatataacaagacctctgcccttttgtagagaccattttttggtctctacaaaaaatttaaaaattagctagaaatggtggcatgtgcctgtactcctaggtacttgggagggagcaggaggattgcttgagcccagaagtttgaggttgcagtgagctatgattaaaccactgcactccagcgtgggctacagagtgagagcctatctcaaaaaaaaaaaaaaaaccaaacccaaaacaataaaaaaaatacttatgtcgcctatcacatttgaccttttcactgcaaattactctatatttgaaataattttatctttctagtaaaaaagggagatttcaccatatctaatgttacttaatataatacttaatgttacttaatgttaatataatacttaatgttactggctcagagactttgccaaaggatagaaataattcataaaacagatagctcctaatctcttcccaaaggaactaactccatttataccagagcatggagaagttcaagactaagggcattctcaagaacagtgaaggaagtggtgaaaggcaaccagaaggagattcatggatgtaatgaacatatagtctagactgcagacagtttatagagaagaagcagataatataaaagctgggaagagccttcatgaggttagaagaaatatcaaaaatgaaccccagaaactgttccttcaaaggagccaaaattcggattacagagtaatgtatgctccaaagctttcctgaaaacaacagagtaatcaaccagcagttaatagagtttaacagctgggtgtcgtcaaggaaagaatagaaaaaagccaaactaataccactgtcatcccaaagtgactgtaagtatacccagagcagtgtctccatgaggaataatatcagatgcttagatgaaggagcatgggctggagagggaataaaaagacttcactaaaataactgatcccatcactaaacaaataactatgcaaataacaataacaaatccctggtgaggggaaaccagtacccaggtactgcatggtcatccctcagtatccgtggaagattgcttccaggaccctgttgatactcaaatctgtggatgttccagtcctttataaaaaatggtgtagtatttatgaaacctatgcacaccctcctgtatactttaaatcatctctagattacctataatacctaatacaatgtaaatgctatgtagctgttatactatattgtttctgtacttgtattattttttactgttgtattattatttttgttgtctttttcctaaatatttttgatccatggttgcttgaatctgaagatgtagaagttacagagggctgtatgtatattatctaaaatgtctaatttctaacaaagacataaggaggcaggtaaagaaacaggaaaatattacccatacattagaaaaacaaacaaacaacagaaactataagagcaaccagatgtcagacttaactgaaaagtactttgaagtagccattacaaatatgttcacagaactaaagaaaaacatgattatagaagtaaaagaggctatgaggacaatattacatcaaataaagatcaataaagagatagaaattagtttttaaagagagccaaacagaaaatctggaggttaaaagtaaagtcactgaactaaaaaatgcacgagaggggttcacgtgtagatctgaactggcagaagaaagaatttgcaaatctgaaaaacgatcaatagaggttatgtgagctgaagaacaaagagaagaaacaatgaagaaaagttaacagagcttcagagaaatgtgagacattaaatacaccaacatacatataatggaagtacgagagttgggaagagagaaaagaaaagaaatattcaaagaaataatggctgaaaacttttccaaatttattgaaaagcagtaacatatgtttaagaagcttaacaaattacaaataagataaacaaagatcataaacagacacatctcagtaaaattgctgaaattcaaagacaaaaagaaaatcttgaacacagcaagagaaaaacaacatatcacttacaaggaaattgcaataaagttacgtaagagctgacttcccagtggaaacaatgaagccagcaggcagttggataacacatttgaaatgaaaaaaaaaaaaaaaaaacccaccaactaagaatcctatatccagcaaagctagctttcaaaaatgaagaaagactttaccaaataaacaaaatctgcaagagtgtgttgctagcagacccaccttacaagagacactaaaagaagttctatgaatagaaagaataaggaaaaagacagtgatgtctgctgttgacacttatattccatattataccagaggctcaagtaagagaaaatgggcaaaaaaaaaaaaaaaaaaaaaaaagcatccagattgaaacagaagaaactctaccccgtttacagatgacatgatcctttatattatttttttttaaaaaaagcatccagattgaaacagaagaaactctaccccatttgcagatgacatgatcctttatattattaaaaaaaaaaaagcatccagattgaaacagaagaaactctacccctatttgcagatcacatgatcctttatattattaaaaaaaaacaaaaaacaaaaaaaaccactaaggaatctactaaaagatattagaactaataaatgagacgtgtttggaaaggttgcgggatacaaagtcaacacacaaaaatctataaattagcaatatacaatctaaaaagtgaaactaacaattccatttataatagcaccaaaagaacaaaataggaataaatttaacaaaagaaatacaaaatgtatactctgaaaactacaaaacattgaaagaaattaaagatctaaataaataggaaagcataccatgctcacagatcagaagatttaacattgttaagatgacagtgctccttaaattaatctatagattcaatgcaacctatatcagaatctcagcagacttcttcgtagaaattgacaagctaactccaaaattcatatggaatttgatagccatatggttagccaaaacaatctttaaaaaaaagaagtaaaaatcacaggcaggagccccagcatggtggctcctcccggtaattccagcactttgtggggctgaggcaggtggaccacctgaggtcaggatttcgacatcagactggccaacatggtgaaaccctgtctctactaaaaatacaaaaattaactggccatgatggtacatggctgtaatcccagctactcgggaggctgaggcaggagaatcacttgtacctgagaggcggaggttgcagtgagctgagattgcaccactgcactctagcctgggtgacagagcaaggcgtggtctcaaaaaaaaaaaaaaaaaaaaaaagaagaagaaggagaggactcaaatgcttcctgatttcaaaatttactacaaaccaatggtaatcaaaacagtatggtaccggcataagacatatagatcaatggaacagaattgaaagtccagaaataaaaccgtacaactatggtcaactgctttttgagaaagatgccaagatcattcaatgggggaaaaatagtctttttaacaaattctgttgggacaaatgaatagatatgtgcaaaggaatgaagtgagacccttacatcacaccgtatacaaaattaactcaaatgaatcaaacatttacacttagaggtaaaactatcaaactcttagaaaaaaacttagggtaaatctctaacatactggatttggcaaaggattcttggatataacaatgaaagcatgagcaacaaaaagaaaatagaaaagttagatatcaaaaactgctgtattcaatttaatttatttatttatttgagacggagtcttgctctgtcacccaggctagcgtgtagtggcacggtcttggctcactgcaacttacgcctcctgggttcaagcaattctcctgcttcagcctcccgagtagctgggattacaggcgcgcaccatcacgcccggctaatttttttttttttttgtagagatgggttttcaccatgttggccaagctggtctcaaactcctgacttcaagtgatccacctaccttggcctcccaaagtgctgggattacaggcgggagccactgtgcccagctaactgctgtgttttaaaagataccatcaagaaagtaaaaagacaattcagagaatgggaaataatacttgcaaattacatatccgaagcaactgtaccattttacattcccaccagcaaatataaactgtaccattttacattcccaccaccagaaataaaaccatacatgtacatgtaaaatggtacagatatatgagtttttatatatatataatatatatatataaactcttataactcaatggtaaatagacatataacccaattttaaaatgggtaaaagatccgaatagccatttcttcagggaaaatatataaaagatacaaaaagcacatgaaaacatgctaaacatcattagttatcaggtaagtacacatcagaatcacagtgaaatatactttacacaaagcagactgcctagaatcaatgtaacagaataacaagtgttgacatggatgtagagaaacaggaatcctcatacactgctggtgggaatgtaaaatggtactgttgctttggaaaacacgtcagtttatcaaacaattaaattaaacaaagaattaacatatgatcctgagattccactcctaggtatatatacaagagaactgaataccaaaaaacttgcatacaaatattttcagcagcattattcgtaatagccaataggtgaaacaatccaaattcatatcaatggacaaacagataaacaaaatgtgaattttaattagccataaaaggaatgaagtactaacacatgctacaagatggatgaacctcaaaaagattacattaagttcaagaagccagttacagaagaccacgtattatatgatttatttcatatcaaagtccaaattacagaaatctacagacagaaaataactagtggttacttggggctgggggtaggaaactgaatgaatgggtgcaaggagtagtagatcatattatggggtttccttttgaagtgaagtgttctaaaatcaattgttatgatggctgaacatatctgtgaatatattaaataacattacattgtacattttaaatgtgttcattgaatgcttagtcaattatattttgataaagctctttaagaaaagaaaattcggccgggagcggtggctcatgcctgtaatcccagcactttgggaggccaaggcgggcggtcttggctcactgcaacttacgcctcctgggttcaagcaattctcctgcttcagcctcccaagtagctgggattacaggcgcgcaccatcacgcccggctaatttttttttttttttttttgtagagatgggttttcaccatgttggccaagctggtctcaaactcctgacttcaagtgatccacctaccttgttgtaaaactataaaaatatacaatagcgtgataaataccatattccagatagtggctctggggatgtggagagaagaatagtggtattacttcatagaaaataatctaaaagaaatatggcggctgggcacagtggctcacgcctgtaatcccagcaccttgggaggctgaggcgggtggatcacgaggtcaagagatcgagaccatcctggctaacacggtgaaaccccatctctactaaaaatacaaaaaattagctgggcgtggtggcaggcgcctgtagtcccagctacttgggaggctgaggcaggagaatcgcgtgaacccggggggtggagcttgcagtgaaccaagatcacgcccctgcactccagcctgggcaacagagcgagactctgtctcaaaaaaaaaagaaaaaaaaatttcaggccgagcacagtggctcacacctataatcctgacactttggtaggccaaggcgagagaatcacttgaggccaggtgttcgacaccagtctgggcaacatggcaagaccccaactctacaaaaaaaatttttttaattagccaggtatggtggcatatgcttgtagtctcagctgaggctaaggcggcagaattgcctggtgtacttaagcctgggcaatagagcgagaccttgtctctaaataaataaataaaatttaaatataaaaaatattccagggcattaaaaaaaaactttcaaaattctttcttggaaatacacataatgctcaaagaaaaacctggcaaaccctgcacacaaaaaagaaaattacagactgaaatcacatttggttatcaatatattgtattgtctaacctcataccagtttaaattccaaaagacttaaatacaaaaattataaactgtgatggaaaatctggaagcattaaagaccacactgataaattcaactacatataaacaaatagtgttttgcacagaaaaccccatgaagtcaaaagacaaataaactggaaaaaaatctgcaaatcatgaaatgcacagaataccaattatcctgacagtgtaagaattcccagaaattgatccaacaggaaagtggaaaatggatacagatagcacacaaaaagtgaattacaaagggcactaaaacatataaatagtttctcaaactcactcttaataagggaaatgaaaaatgaaaaaaatactgagataacatccacccgcccctatcacattggcaaaaatccaactgcttgaaaatatactggtgggaagggggcactgtgaggaagctgggactcgtacattactggtaggaaaataaatcgaaaatcccgataagatgaaaacttggcagtatctgtcaaaactgacatagcagtcatacttctggaaatttatcctacagatacacatacaaaatgacactatataggcttattcactgcattttgtttgaattttaaaaaaagaaagactggaaacaaccttacaggggattcattacataaattacgattctggcgtactttatagagtttacaggttcagttccagaccactgaaataaagtgaatatcacaacagaggaagtcacaccaaagttttggtttcccagtgcatataaaagttatgtttatattatactgctgtctattatgtgtgtaattgtattatgtctaaaaaatgtacataccttaatttaaaatacttcattgctaaaaaatgctaatgaccatctgagccttcagagaggtgtaatctttttgctggtggagggtcttgtctcaatgttgatggctgttgactggtcaggttggtggatactgaaggttggggtggttacagcattttcttaaagtaagacaacagtgaagttggctgcatggattgatttttccttctgtaaaagatttctttgtagcatggaatgctgttttacaacattttacccacagtagaacttctttgaaaatggaagtcaatcttttaaacgtgccattgctttatcaactaagtttatataatactccaaattgcttgttgttatttcaacaacatccacaggacagggcactattatttcattagaagattccatctcaagaaaccacattcgttgttcatccatgagaagcaactcctcatctagtcaagttttatcacaagatagttatttctctcactgaagacctaaaccactcaaagtcatccatagaggttggaatccacctcttccaagctcctattaatgttgatattttgacctcctcccatgattcaaaaatgttctgaatgcatctagaacagtgaatcctttccagaagattgactttgcccaaatccattagagaaatcattatggcagctgtagccttacaaaatgcatttttttttctttttctttttctttttcttttttttttttttcttttttttgagacatagtctgtcagccaggctggaatgcagtgacacaatcatagttcactgcagcctcaacctcctggctcaagcagtcctcccacctcagcctcccaagtagctgagactacaggcatgagccatagcatgcctggctaatttttttaaaaaaatttttgtagagacagggtctcaccatgttgcccagactggtctcaaactcctgggctcaaacaatccacctgccacagcctcccaaagtgctgggactgcaggcatgagccaccacacccagcctaaaatttatttcttaataagacctgaaagttgaaattattccttgtttcatggcctgcacaacggatgttatgttagcaggcatgaaaacaatattaatcttgtatatctccatcagagctcttgggtgactaggtgcattgtcagtgggtagtaatattttgaaaggaatctttttttttttttatgagcagtaggtctcaatagtgggcttaaaaccttcagtaaaccatgctgtgaacagatgtggtgtcatccaggctttgttgtttcatttatagagcacaggcagagtagatttagcatcctttttaaggaccctagcattttgcgaatggtaaatgaacatcagcttcaacttaaactcagcaactgcattagtccctaacaagagagtcagtctgttctttgaagctttgaagccaggcattgacttctttatctatgaaagtcctagatggcatcttcttccaataaaagtctattttgtctacattgaaaatctggtgtttagtgtagccaccttcatcaatgatcttaggtagatctactggataacttgctacagcttctccgtcagcacttgctgttttgttttgcactttgacattctgtagatggtttctttccttaaaccgcatgaaccaacctctgctagcttccaacttttcttctgcagattcctcactctcctggccttcatagaaatgaagtttattaactggcctaatttcagtatcattgtgtctttggaaacaagcaggcccaaggagagggagagagatgggagaatgtccagttcgtgaagcagtcagagcacacacaacatttattgattaagtacatcatcttacacgagcatggtttgtggtggcccaaaacaattataatagtaacatcaaagatcactgatcaccgattaaagtaacagatataataataaaaaaaaactttgaattattgtgagaatcatcaaaatgtgacacagacataatgtgagcgcacactgttggaaaaatggtgcctatagacttactcgacgtggggttgccagaaccttcaatttgtaaaaaacactttgggaggccaaggagtgcagatcaccggaggtcaggagttcgagaccagcctggccaacatgatgaaaccctgtctctactaaaaatacaaaaataaaccaggtgtgttggtgggtgcctataatcccgctactcgggaggctgaggcagggagaattgcttgaacccaggaagtggaggttgcagtgaaccaagattgcaccactgcactccagcctgggtaacagagcgagactccgtctcaaaaaaacaaaaaacaaaaacaaacagacaaacaaaaaaacacactagtactgagaagcacaataaagcaaagtgtaataaaacaaggtatacctgtatcactgtagaatgaagaagcaatttaattttatgtactgactatattaaaaagatctctaagatacattgttaaaggtgggggggaaagcaaggtgcatgtgttatgttttacaagtgtgtaaagaggggaggtataagaatccatatttaaattttcttgtatttgtggagactctgacaatatataagaaactaagcttttgttaatggcaagggagaactagacagaggacaaggaaagaggacaagttattcactctaactttttatactggtcagtttttaatgaatgctttctctattcaaaaaaataaaatatagaccaggtgcagtggctcatgcctataatctcagtgctttgggattctgagatgggagaattgctttagctcaggagttcaaggttacagtcatcatgccaccgcacttcagcctgggtgacagaacaagacgctgtctctaataaaaaaattaataaactggctgtgtttggtggctcatgcctgtaatcccagatctttgggaggccaaggcagggggactgcttgaagccagagttcaagatcaccctggactataaagcaagaccctatctctacaaaaatagtaaaattagctgagtgtggtggcatatgcttgtattcccagctactctgaaggttggggcaagaggattgcttgagcctagaagatcaaggcagtgagccatgatcacaccattgcactctaccttgggtgacacagcaagaccttgcctaaaattaattaatatagtataatgtaataattgattcacaaataaaaatgccattgatacagaccttagaaactggaaccttgcagaaataggaagtatctagggtggggtaagtgacagacttctctgacagacccctgctttacgcactgagtgctcacagagtcggggtaaggggttggggagcagccaaaggtcctcacagtttgcctcgcttggtggtggagtcactgcctcacaagccagggcaagggctatcagtacttcagtatactcagtggtactgtgcccaaggtagagctttgtccacaaactgggggctgggcagaataagagagctctcacatccatactgctcttgcccagaacttagccttagtagtaggtagctgagtgcaggatgatataatctgaagtctggtttctcctgagaagaaaacctttcaactgggagctggcagagaaggaatcccgagttcttcttcactgcagccatctggaatggaatgtaccccttgctgagctagtagtggggaaggaggaaatgctcttggtttaaataccacagattttgcctttctcaatgaattttttgagattttattgagtagatgttttttcatttattatttgcccttggcacgatttctggaccctttcaatggtggttttataatttttaccagcttcactgggttagggggccagcagagccgatgccgccgtgccagatatcaatatttggaatggctttaagtacattggaattactttctttttaagagactgtagaattctccaatgcaactatctgagcctgctactttttggcaaaggggtacagctcctgaaatttttatctgtggaaatttgtctatttacattttttctcttttctggggtcaatattgataagtaataacttcctagaaaattacctatttgatccagattttaaacttatttgcatataattgagcaaagtcattt

SEQ ID NO: 66434 - DNA, 1052 bp, Homo sapiens
ggtggttagcagtaatggtgcaattatgacaactaaactggtaaccactcctactggtaagttctcttgagcatcagttcatttattcatcatacattcatcaaacagtttctctgtaccagcaatatgcttgacacttgggatatagagattaatgggacagtttttcaaagaggcctttcttgattctcacacccctactgactgccctgacgttaactttcttttgttattctttctaatgatcctttgttcttttcctttatagcacttcccataatttcttaggtatctagttgtatattgatttgtttgatattgttccttttattggaccataagctctgtgagcgtaagggaccatatcctttttatttaccacatatatagagctagtctgtaagtaggtgctcagtcaggatttgctgaatgaattaaaacagtcccaacccacaaggatttcactctgatgaagttgagaagagtatatgttacattacagtttagtaagcgttactgagactgagggaagcacagaatggtattgtgccctgataggcaagcaaccagcatatgctggaggaagtgacagtgttgaacattttggatagtaacactatctaaaatgtgaccttgagcagattacttaatctctctaaatgtttttctttgtttatttgtttttgtttttttccttgtttatttaaatgggataataatacctatgccataacgttattataagtactaaatgaaatcaggtatgtagaaagtccccggcatagtgctcaatagttgtcactattaatattataattagccattaccgttattttaaatgtatgactctttaaccaaactttttgaggatggctagtatttagatgacagaatttaaatagtgtaaaatgatacctgtctcaagcttataagctgtcatttattggccagtgtgtaaaggtcattacagacattgcacttcatatcctttaggctttattatctccattttcagcaacttccccaaggtcatgtagccaaaaagaggcaga

SEQ ID NO: 66435 - DNA, 1571 bp, Homo sapiens
gtggctcttggcaaatgaactagagctctttccagagatggtgctgggaagagtatgcatgtgttgaaataagtaataacaccattggcagatgcttcatgtttcccttaagtaattacagcagatagttaaaattgtgatttttgtaattatatttagctctgaattcacaatgattgctttttagccagctcacgtgggtgctttgtttttactggctgctaagtttagataggcacacgtttagatgatgctggctaaaaattaagaaaaactgatgaggtgaaaattctcaaatcttttcatttccatcttaagtttatggattttaattttaaaaattttaataatttagtaaagtcactgtatttgaacttaatttagttaagttcatgtaaaaagatgttgatttcatgagtgaccagaaaatggtacttaagaataaagtagatgaaagtatagaaaatgatgaaaagttaatggatataagctatctagttaatagactaaaaggatattagtaatatatgaatagtaaaacataggaagcactctgagttttcccttcctttttttctatatgtaaccttatatattattaacaatatataacattctttcctcatggcatatgttcatcaaatttttcctatatataaccttagaaagaatgttaatacctctgctgattttgcttgcccatactttttcatgtagacattctactatatatccttataatttcatatatgtagaacttaggggatgtattttatgtgtgtgcatttagctactggtatattgcacagtaattttctaattacacaaatacttatttcagataaattagaaaataaatatgtatgtgggggttaagacttataatcccaattcttagagacaagcattagcagtgtactataccttcttccagaattttctgactattataatatatgtattccattaatgggatagtgtaataagtatttttgcatgtggtaattttttaaaattcgctcatcagagaataattaattccttctttgggtagaaagttggtcagatgactttctatatcatttcaaccaagtctacgatttttgatttcctggaaacattatactttgttacataatctacagcccttttttcatcatcctggtaaaaccttactgatttttcagtgagaggactttatcatttatatgcatataaatctcttatataatcattgacttcaatttagggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggtatgctataagatatgatgatttttcttggctcttaaatattttcaattcttataattcccgggtagaaatttgaaggaaaagatcagcaatctttaagaaatcagattgttaaaagttatgtttgaatgtgttaattattcaagta

SEQ ID NO: 66436 - DNA, 1050 bp, Homo sapiens
actccttgtgtctttttgttctgccatcctcagcttgtggatatcattttactatatagtctacagattataaaatgactcctgaagttgtaggcaaacaggcacaaaggttcttgtcagaatcatggctattgcactctggcatgtaccacttaaaacattgtatatggcttacactgtaatttgtctgtagattgaattaccctttgatgagcaatgctgtgcctaaaaagtataacgtacagaatagtttccataccaggaaaatattagtttatgacctagaagtttagcatttttaaatcgttttctaaaattttatctcagtatatttctgcttttctcctaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaaggtaagatctattttacttctgatttatataagtactactgacatagtgcccaaattctaaaatagaggttgcttctacacatttcacaacaaatttgtatgctctatcaattcttttccttttttttttttttttttattgtttgatgttaaatcggtgagctgaaattttatttttggtaaaggttaccattctttcctgcatggaatatgttcatcaaataattaactttagatgatgaatctgtcaggtaggtaatattaaactggatagagttatgattcccagatggtaattttcatattcttcctctctggtttgggtaagtaggagaaaacgtatgtaaagaagtgaatatatattttgaaatggttattgctataccctgagaaagaatcaaggtggtcagaggtagactgtaagtgggctgtaagtagggtgactatacattccaatttgcatgggacaagtcctagtttatgttgttctggcacaattatta

SEQ ID NO: 66437 - DNA, 1066 bp, Homo sapiens
tatctggcatttatccaaagagttcagttaggactgagaaggtactcagtaaaagtttcaccgaatgaacaaatagcagagcagcaaccataataactgtggcattgggttaagctgcagccttataaactcatttttgttgcctgagtccaaaatgttttttttttttttttctggagttccccctaaccttgtgagtgggccttttaagtagtaagtagtatacacctagatatggatagatagctaggtgaccaaacctaatggattaaggccatcctcgcctaggtcacttactaaagatcaggtcatatgtcatatcgttcctgtgcttttcttcctaaatgggctttttcccctttctcatttgggaatggggtagcctagaacgtatttgggaatgggttccagattttttttaaacacatattaaagattatttatattatgctttgtttccaaaaggttttaaggtggattaaaatataagattatattaagtgaagtggaagaaaacaaggagacaaacccaagggcagagatttataatggaataaggcatgagtcaaatacaaaaatgtatcttgtaaagacattgctttgagtaagtcataactcagtttctagaatgatttctttctgaagtttcatgatctcagtacgtcaaggtgagggtggggaataaatccaggttgagcagaaacatacttattgcagaacttttcagagcaattatgtgctaatatgtatatgaaagattaagagtggaagatacaatataaaatgttccccaacttttttgaccatggaaccctttttttgcagaacatcttgaggaacaaatgttctctggaacattttgggccttgctgtctaggcaattaaatactgtgaagtccttgagctttatgacagtgcttcagagggaaggtatatattacatcgtaaaagggatatagatatcttaggtttagtttagaagcaatgatttagatgtgtaaggtgtttagaatcactttgtatgagcaatagttggtggagacaggatttatcatgaagaagagaa

SEQ ID NO: 66438 - DNA, 3057 bp, Homo sapiens
cttagaattcagaacttccaagctacaatagcaacaataataacatttctattggccttcatagtttataaagctcatttccatgtatcatttcattgcatactcagaaattctatgaggaagagagataattttattcccattttagaggtagtgaaactaagacccaaagaatcaacttgctaataattgatgtagttggggctataatccaagactttgagctccagatgttacacttgtcctgttatatcatgctggttctagatcatctgtcttttcttgctggcagtgaacaggatttccttcagtaattcagccatccaataagtgttgacagaatgctcaggctgtaatacaacacatattttcaggtgcattggagaaaataagactcctacagcattttgttcttactatacacaaacatgcactcacctacacatatgcgtatctatttataatagcaattatcacattgagttgtgatttgtctttttacatgtccgtctccccagccagactatgtgcttcttgagcatcctctgattattctgtgagctcctttatatcttcaatgccatatctagattctggcacataagtgtccagtttgttgtgaaatcaatgaatgagtgaatgaataagtgaattcagaagtgaaagacattatgccttctaggggcttatagtcttcttggggagataaagcatgaagtttacaataaatagaaagataagcaaacagacaaaaaaattgtttgtttttttttttttaagagaaactttgtttatagggtttgtttttttttaactaatataaaacagattcccagcctgtagttcatgtaattgcttcccggcgtcaggattggtcagaacatgagattgcaatggagactagccctaccataatttatcaggatgtatccagtgaatcacaatcagctacttcaacaatcaaagctctgttagaactccaacagacaacaggtatgaattcacatgctcaattgaatgaagcatgttttctctagagacgggttgtgctaaaatactaccactgttattatttattattactattatttattattattattgctattatttgagcacatttcccccctctggacttgtctataatcattggtacagtctggtttacttgttagttcagtaagatgtgcacaggaatattgaagtacagatggactatctgtagaaaagagaaaaaaaattgacagctctgtcttgtctcttgcttaaaatggacagtcctattgttccttagcactagaaaggagtagttctatcacttctaagcacaaggctagatacagtacagttgccagttgcattgaagaatagcaggaggcagattgaagggccttgccatcctccttgatattggtggagcacaaaacacctttagtggcccttgctaacattctgatttgttttaattttatcttcagacttatttctttgaatagtataggttagccacttgagctgtcatgcaaagttgtcctcatataactagatcctataagtatttctaattactaaatatctttgataaactctagaacaaacctgtggaagttatactgacttttcctttataataggtcaaagattttcagagtatttaaatgaccttagcaattatgtcatccaaacctttcattttatggataagtaaactgagatctagagaggttatccagttgattagtggcagagtgagactcatcttttggttcctagttcaatgtcctctctacttgtagggtgacttttgtatttttgttgttgttgttgttttacttattttgtttaattgttttgatttttgtcaggttatgtactcagtgggtatgaacattcagtggacttagttactggttaccgtttattgtaacttccaccttgtttgatccaaagattactagcatttaatgtaagtctttggttaatccttctgtcggtgttatttttgaccttagggatttcttcggttctttgtcgttgacatgctgagccatttctcttaatgccttatagaggtggggactttgaacgcatagattttgtagaaaagttgataacaaggtagaaagtgaatctattaatggaaatcattcttgattccagactgttatatcagacatttttctagaaacaaagaagccatttttttctaacaatgaaaatttttattctttaaaagttgttgaagacattgtaacattcctttggagatatcttgaatttttaatagctcaaattaaactggtcactgtgttgtgctattctgggtagatgtgtcctagagcaaatcatgttatgtactgcttattcaccctttgtttttaggttgatgaactcaagaccacagggaataccttgaagaagggtataggaaataccttaaggagagtgtacaagataaaaattcagttgtttggcttagagataaaaaggagatgatttttgtgttattgtatgtaagtccttcttactaggctgctgagtatggttatgcaagttgtgcactaaacagccatacatagcaatctgcttttttcttttcaattcactgtctacttagtcactgccagtgtggcaccccagaggtctggttcattattcctgtggacaactctggttttggtacttgtttgtaataaaagttaacttttcccctgacttttttatgcagtaaaggaaaaattggaatctaaaccaagacaacccactattgacctgagtcaaatggcagtgcctattcagatgacccaggaaaagagacattctcctgagagtccatcaattgctgtggtagagtcagaactagtagctgaatacatcactactggtaggtgtcctcttaaaatgtagtattaaggtaggagaactaccttcctggatttcatgggatgattgtgtgggggagaatatattctttatatttttagctttttcctctttgttttcagagcaaattcacaccatccttgggatttaccctgtctttaatgactaggaaaa

SEQ ID NO: 66439 - DNA, 1037 bp, Homo sapiens
atagaggatgagtgacctcttcaaattcacttggctgtttgatggtagaacaggacaggatccaagcgtgattcttgattcagtttattttctgcattatcacccagacctttagatttttaggaactgtaaggttgtgagacagaatcacttaatacaaaggagtgaatgctactaatgtttttattgcatgtcgaactgagaccaagagattaaagaatgtgtattgccttactttccttaaagatattattttgggattacagaaattgattactgctttgttaccttaatgggatgaaagtcattggagaaagtgagtacagctcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcatcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggttgtatctcttctttttcttcctatcttctgcaactgcccatgcttgaaataagattcagtgtcatcttgtattttaagaggagaaataattggaacgtagagtgtttgtgtaattcttttctaagaaatgagtagaggaaatgaattaagagtcttaacaccagaaaataattctgaaacagtattcttaaatctgtgaactcttaccatttcaaaagggtgagaatgtct

SEQ ID NO: 66440 - DNA, 2062 bp, Homo sapiens
ttgttgggcggcaggtctcagcctggagtccggccctcagctggcagctcctgacattgacctttctccggacacctagaaaggtctgacaggctggccctaaccgtgtcactcaagatgatgcctcctcacaacacttatcactgacactgggcactttgcctttctactgacaggaatgctgttgtcccctcctcagtctccttccgtcctgggagccagggctctgggatctgagcaaaggggcgaggaatgctagtcgagaggtgcttcatgcagaccttggtgaagcctgaagaatgatcttcatccatgcagggggctctctgtggggactggtacaggcacaggtctcagacaatctccctgaccttccagatagcactggacctacacatagccatggtgggcttctctgaaccttggcttttctcgggacctcatggcttggttaccgcttttagagaggttaacatcatgaataggccagacggctgtttcctgagccagggagcctttctcttctttttccgtgtttggttgtgcttgcagggccatcttattcttctaatctgtaagttctggaccctctaagacttttcttatagtagtaagtagaccagttttcgaagcacttacgtctgagagttgaaattgcaagttgcagtagaaagctccttgaggtttcttggcctttctaggttcttctgaaaatttttgagtgaatctcgtaagtctttttcagttaagaggaaaatgtagcaatgtagatgtttttcttatttcattcttactttgtgccttttttacttaggcattaagcagtcacactgcttttaccaaacacagcgaggaacttggaactgaggagggcgaggttgaagagatggacactttagaccctcagacaggtctgttttaccgatctgccctgactcagtcacagtcagctaaacagcagaaacttagccagcccccgctggaacagactcagctgcaagtgaaaactctgcagtgcttccagactaaacagaagcagaccatccacctgcaggcagaccagctccagcacaaactcccgcaaatgccccagctttccatcaggcatcaaaaactcacccctctccagcaagaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtaacggaatattgatagcatgcaaagttaaacttctctgttcacggaaaaaaaaatgagaacatcacgaccctatcatgatatcagtgctttctcctggcaagaggaaacccaaaagcctcattacgctggtattactttgccccatcagaaggttgacattagggaagaaatgcacgcattaatatgtaggaagaaaaaaaagcatagcactcaaaacttgatttttcaggcagtttttattgaaatcacttcagcattgaccaacagtgcatagaagcgatatccctaaattatttttattttttggtataaaatatttatttccatgcctataaactctgatttctgtggtaataatgctaagtaaactacagtcttttaaggaacttcattgaacatctttctttgtagtttatatcatagccatctagttaactttattttttagatttatcttctagattacagaggaattattggtggataattgaaagcaaaattatattagcaaaaccagtggctctggagtgatgtatatgtatgtatatattataaatacatatatataggatatgtttgtatacatgtattatgaagcaaaagattggaaaaaatcttctttttattttaaaaagcagaagattatatgaaataatttgagccaggttgaaggtgtactgt

SEQ ID NO: 66441 - DNA, 1053 bp, Homo sapiens
gtttgtttgatatgtttttgacttgtcacaggaagaatcaagccaagacagcaggaagacatagatattatctttgagatggtgtttgacaaatttggtttaacacctattacaaaaatacaaatttatttattttctggaagaggatcagaaaattgatggacattgtcacccagcacactgtaaaggcaataaagagcccatgtgtcagtttgattttgtaagatacaagctatacttgccaatgtgttcactcattaagtcaacccagaagataggaagtttctgggttcaaattttgtactcctcaatttttgctcaaaaaattctggaatgtaactggattgcacttctatttcaagttaatttgggggacccttttcttggaaaaacagttcttgttcttgatccaaatttatgactcaggacaatcaaacctcaactgcaatgtctggagagacatgttctaaggtgatattttaaaataatgtttatatttaatttgggactaaccatgaactttactgtttaattcaatcattgttattaaaaaatcttgtttggtttctgtcatgccttggtaagtacaggctaattaacacaatagaattattcattgataatagatggtacctcacattcccttgattctaaaaatcatctcttgtcatgcataataggtcaagactaaagaattactgagtccaggctaccccttagaagttgtattttatctccctctctccttgcaaggtatcaggttgttttcttgacatttgtcattctttgctaaacagatatatagcttggaaggtatcagaatagcacattttagttaattgagaatttggatttattgaaatgtgagtagactaggatttaccatcaattcattatggtaaactttctctttgccatgatcccaaactatgggagaatgcaaattgacaatgttaaaccaattaaggtagaattaaatatagaggaagtgcttaaaggcaagtagaaatggccattgaattattaaaataatttgtttccctttgtaaaaac

SEQ ID NO: 66442 - DNA, 1930 bp, Homo sapiens
aggaaaagttttttaaaaacttgtatgtttttgcaaatccctggaagtgttgaattggttaaaattttacattttctcagttcataattagtttataaacacctagaataatactggcattaaagaatccttgttggatggtagaaatcagatccctaaccagtgggaggtactttttgggtggcttgtgcattcttatcagttgtgtgctaatttattgtattgttcctttgtgctctaagcagcacacttgccttctatttatttaagtgtaaacatttcaaagcaggccgtactccttctgacaaatttcttgtaaaccaggattgcctacgctttccactgtcgtcgtctccccactttccctcttcctttaagaaaacttactaaaaaatgtttcattgcgaagcagaggaaaagaaacgttttcagacctaaaggaaatgtttggtcatgttaagaaaacaaattattcattcatatgatgctttcttaacgttgaaattgcacattcacattggactgagactttgaaaataacttttacatacttttgtttaagcccctttgaaatgtataaaaagttcatttacagttctaaatgtaatgtttttaagccttctatctttttaggacacagtttgtttaagcaatatgttttggtcttgtgatcactgtctgtcacaagtagagtgaaaggggtaagggggtgggagggtaagagttttgacaagttgtggcaaaggaaactatacttttcatttttaaaaatgtaaatagaaaagtttttaacggttttatatagatttcactataaataagcattttaagactgacaaatgttgaactgtacatacatttatcagcataactgcccagtttttttggtgctgaagtactgtaagtagaattcatcaacggtctcctaatttttgcatctacatctggggggaaaaagctgtgatactatagttaataaattcccactagagtgacactgaagatttaaacacaagcattcataagatgcgctgatctctggtggttgtcactagttctgctaggtgataatgatttacccatagatggagctgttggatattattttattgtacaaattcatgtttaaaaaactttgtgactgtttctagttaagtaattttttaacctttcttgggtcatagacttctttggtaaactatgaactctcaccaaaaagatacacatgcaacatgttaaatacatgttagactttgcatacaattttaggggctcatgggcctctaagcctatccatgtattccaggttaagccctctgttatgatcaatccattacttacagattaagtttttataaaataaagtatcttttaaatattcatggatcaagtaacaagagcaaacttgaataaagttatgttctacatattttggcagcatagcatacctgtgtcccttgagaatttagccttcatatgtttctgcaattggaatggcaaataaaagtgctatcatctacatttttttaaagaattacaaatattaagaaattatcaagtgaaatttaaaatttttcttttaaaggtgttaattccaaatagagcatgcattcatttatttattcaacaaatattaattgagcatcttctgtatgacaagtagtattctgtgcactggggataccatagtgaacaaacaggaaatcctatccttatgaagtttataaacagggcttcctgctcatgaaatggatacaaggaatgaagacaggagaaaataagaacaatacttaggtttttttataaagtggatagatgatgatgccatatatggattttcagacatccctttactgaaagtcttagcattatatctattagtattccacatttaagtacataatttaaaagtaatttaaagtcatctctt

SEQ ID NO: 66443 - DNA, 1127 bp, Homo sapiens
tggccattcatgtatctttagagaaatacctcttcagcttccttgcccattttccaattattttctttttctctcattttaaattgagaatttttgaagtataggaaatactactaatcttaagagaaaagtaatgtttatcacccttaaaatcctaggttaggttctagttctgcttctctaatgtaacaaattgcttagcagtattaaaacagtatagcttcataattgaaaacttgcttttaattacatttctttttgaggttctcacagtagcctgctaaggtaggagacttagtacaaaggaaatagtagtcaggcggtctggatttgacccttagactcttctgtgtattgatcatgtgaattttagcaagtcacatttcctctccgagtcagtttctccataataaaagtgagtatttctaaccccatgggactattatgaagacaagatgaaacagtacacgtaaaaatgccagtgagagtcgggtgctcagtattttttgagtccagtaattacaccactcctactttataaatagaaaactgagggttcaaagaagttaaatgatgtactaaaactcagattaaatgctaatgacatcatgctgagccatgaattactaccttctctagaaggaagtgtttttgttaccaaacaggactggcccttggaaggatggaggaactcggtgttgggctattaacatgtcttctaatcagccttgggtgcctttacacagaggtgctcgattcaggctttttttttttttttagtttaattatgtgtcataaatcccatataagaggaagtggagtgaaaaaaaagcactgtataagcaagacctttcccagaaaggatattgaaaacaaagtctgcggcctctgcttgcaggttcgtaagctttaagtaagcaagacttgatgacctatatattgaaaaagaagaaacacaggatcagatttgtaattgtgaaaagtcttgctctgccttcttccctcttccatgctcacacatacacactataactgaaaacatatacttgctttttttttttttttaaaccagacaagccctgtgagcttggaccagctctaaaaggcataaaacagcagaggacaga

SEQ ID NO: 66444 - DNA, 1049 bp, Homo sapiens
atgattcggccgccttggcctcccaaagtgctgggattacaggcatgagccaccgcgcctggacccttttctgtttttattaatgtcttttgtgggcagcatattggatcatggttttttaatccattctgccatctcttgttttggattggaggctttaatcaatttacatttaatatactattgataaagaaagacttctacaatttgatagttgattttcatatgtcttttaccttttaaaatcctccatttcattcattgctgtcttttgtgttgatatttaaaattaatctatttttatttctttaaaaaatttttctcctaatctctgtgttggtcaattttgtgtttttttttttttttttttgtaatgaaatgttttgattctattctcatttcttttgtggctattttaaagatatttagtattttctttgtggttaccatgggggttatattgaacatcataaatttatagcaaactagttgaattgaaaccaacttaacgtcaatagcatacaaaaaattctgctccagtgtatctttgtcccccttttatgttgtcacgaattatatctttatgcatatgtaaccaataacatagatttataatttttttattcattcatcttttaaatcatgtaaataattgtcttttaactctcctctaggtttttctgggcttttagttggtttagttggttgattatttggtcggaggctgtagtagtccatttgtctagtggctttttctatttattttttcatagattgtattccttttcatgtgtggtcactggtcactgaagttgctcttccttagcttgtgtctaactagggttttgacagatttctttgagtgacaggacctaaacaaacaaaaacacttctctcagtctttgcaggttgcttctgttctctggctctccttcaacacttacgcagacttccactgaacctacggaccaacctgaagtgaaagtttgaggtctttgacaaagctttctaaattcctccatatacaagagtgctttggagtcctttaa

SEQ ID NO: 66445 - DNA, 1566 bp, Homo sapiens
ttggaaacatttctcccaaagtggagaaattcccatctaccaccagaaatttaactatctgtgcccatagaagggacctaggacatagaatcaggagccctgggtcccagctctgccctgctgctcactggcttggggtcactctgtgggatatatggctgtttcctgtaagaggggtaataataagtacagggtttctctttgttagtttatttgtccttctatctgtctatcatctctccatctgtccacccatggaaccttcatcgagttccttccttaatgcccattactgcgctgggtgcccgagatggggcagggagccggatgggtcatccaggcatggggtgatcaggctgcggtgggggaaagttgagcattctgggagtccatgggagaagggttccccagccaggcagggttcctggataaacatgtctggtttcatcccctaccgtgcccacttatgccagctgtctccccaccctacccctccccaggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagag

SEQ ID NO: 66446 - DNA, 1061 bp, Homo sapiens
ctgctgtgtggctgtccaaaagcgtcttaacctaaggcccagttcccttttggtaaaacagagaattttctgccttggaaggtggttgtgagggtcagatgcgaccatgctgtggggcagccagaacagtgcctgacgtgtaacacttgctcagcagagagtggggcaccctgggcacaccctaccctcagccctgtggatgagcccctcacccggggcccgaggtctagaccaaaccagggactctggaccatcagagctggagaggccagcccgagaaaccgtctagtctggtgggtttcaaactgggtttcctaacaccctaggcagggatggtgggcagaagtcgagggcttcaggtccccctcacttcagccagaccaggcccgccttcatctgctgctcttgtttaagaaagggatctgctgcttctagttgaaaattcaccacctggcctcacgccccttaccatacaaatggagaggcagaggccagagaagaactgggactaggaactctggggagtgttccaggaagcattccaggaggtcggggtctgtgacaccttccaacagtgtctagactgggctcatgtcctgtgtggtggctttagaccatctggtgcattcattcctcacctgtggctctctttctagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccc

SEQ ID NO: 66447 - DNA, 1081 bp, Homo sapiens
caacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgg

SEQ ID NO: 66448 - DNA, 1035 bp, Homo sapiens
agtattcatcccacccccgccccgattaaatcaaaccacacgcacacaaatagaggctctggcacatcctgacagaatatagcctctgggatgtcaggaacccccaacctacggccattggcgtgtctgcaccggccaggaagcccaggcccccggctccttcctggatcacgcccctgccccgcccaagggtgaagaggggcggggccagccggcgccctccgagtgggccttacaccaggtcgggcctggcccggccccgcggcccagcggcgccggtgggcggggcctccgtcagggcagtgtcagtaacggcgccaggccccgcccctcggggaggcagggccgggcggggcgcgagcgagcgcgcgggctgggccggagccggcctggtcgccagcctaacccggcacagtgagcggagcgcctgggcggcggcggcggcggcgtgatggctccggccgcggaccgagagggctactggggccccacgacctccacgctggactggtgcgaggagaactactccgtgacctggtacatcgccgagttctgtgagtgtggcctgaggaggggagtgggggcgagagggcaccgggctgaggagacgccgtgtgaggaaggcaaagagcgaacctggccgcgaagggaggtgccaggcctggccccgggagctggaatgcggcgccctgggccagcgggaggctgagaggagcgggccgggagtccagtgtgtagagggaggagtaccggggtctgggagggaggaagggggcctgaggattgggggggcagaagagcagtgggaagtggggagcccctgctggacctaagggggaaagcctgaagagccgggttgggaatgggaattcctgcccgagagcggagtggggccaggctgggagagtggaggaccctgccccttggaatgagggcccaggacacctgctctgctgttgccaccaccagaagggtacagttcctagcttcgtctttcccccaatccgtgagaattctaccgtctttcccttccct

SEQ ID NO: 66449 - DNA, 1037 bp, Homo sapiens
taaagaccaaattctaacatggcatgaaaagcacttcttttttttttttttttttttttttttagatggaatctcactctgttgccaggctggagtgcagtggtgagatcttggctcagtgcaacctccacctcctgggttcaagtgattcttgtgcctcagcctccctagtagctgggattacaggcgcaggccactacaccgggctaattttcgtatttttagtagagatggggtttcactatgttggccagactggtctcgatctccttacctcgtgatccatccacctcagcctcccaaagtgctgggattacataaaggcgtgagccaccgcgcccggccaacatttcatttttttaagatgaaatttttatgcatacaacaaagttggaagaattcttcagtgaatatccattcacccactatctcaattctaccattaacattttattacacttgtttttatcacataccgattcatttttccattcctttctccatccatcagttcattttattttttgatacatttcgaagtaaactgcagacatctgtttgctttcctctaaatactaaagcatatcattaaagtttaattccttgttttttttttcttttgatgtaaaatttacattcaatgtaatacacagtttttgttgttttttttttttttttttttttttgtggagtctcactgtgttgccgaggctggagtgcagtggcatgatctcagctcactgcaacctccccgtcccaggttcaaacgattctcctgcctcagcttcccaagtagctgggattataggagagcaccaccacacccggctaatttttgtattattagtagagacaggggattacaggcacgtgccaccacacccagttaattttttcatttttttgtagagacatggtttcaccatattggccaggatggtcttgaactcctgacctcaggtgatccacccacctcagcctcccaaagtgctgggattacaggcatgagccaccacgcccagcctgtaatacacaaa

SEQ ID NO: 66450 - DNA, 1030 bp, Homo sapiens
catgagccaccacacctggccagggaggagaactttaatagcctttctagataattgtggatgttctttgacattacgtataccaaaacttgacaagtggtagtgttaaggttaattggaatgtggaatctgagatcatatcattgaatttttcttgccatcatacattaagatccattggcctttcttgcactttgaatggacttttacctatgcatcattttatagcaccatgcatagatcatttggaaaatattggttcactgttgatgcagatcttccaggtgttgagatatttctttatgtaatattaaaaaaaaacacgtgttattattatcatctctgacatcatcagaagtctttaagtattgggaagctgtcaagcttattgtggtagatgcaagttttccaaaattcttatttttgcttgaattttattgctggcaaaaaaggaaaatacacttatttgttctttttttttgaaaggacaaggctcaatttgctcatttctaggaaaacatcttctaaatacccaggaatgaataatcatagtttacttgtcagttcatcttttaggtaaaaatgtggttgatgaaaaaagcggctaagttgagctgacatctcaaaacagtcatacaagtgctattccttgagacaacattatactttgggatatagtagaagttctttatgtaaattccatttaatgatagagaatattaaaaagatgtgcacccaagagttgagatttaatacaattagtaatttttattgcttcataaaaggcactgttaattgaagctgacttttttttttaactatgaatatatggtggtggagaagaatacaattattatagtatagactggttgttactgccctaatttgtgcaaaagtgtacctaccattgcttttgtgccattaatgtaaatgtgccattagtgtaaatgtcaatacagtgcataagttaaataactctaagtattatgaaaatagttttgacctcaaagactccaaaaagggtacatca

SEQ ID NO: 66451 - DNA, 1045 bp, Homo sapiens
ccaaaacctaaccatatcaaatatagaaggtatcttttgtgagattttaacagtaataaatcatctgcatttttaataattaaggttaatttagtctaaatttaaaatgcattttaaaggtcttatgcattcatgatttttgactgatgcattttaattctaagtaaatgaagagtgaatgaaaaattatactgaaattagtttggggtgaaggatgaatctgttaaattaattttggggaaaagaataactttattacatcataactgaaccacatctgaaataatatctattaggttttaaatacctgtactcttgaaaatttggaactagtttaatttgcatgagggcagtctgtctggttttcttttgtattcctttatagagccttttgtagtagatgatcagtgggtatttgctattgaatgaatataaggccactgccctcaagaaatgtaactgaggagataagtcataaatatcagttgatcagatttagtgaaaagagatctgtctatgcaaggcaatctatgctaagtgccaggtgagaggttaaaacggttaagtgctgtaacaagagtggtcattttgagtaggatgattaacaaaaattcaccaaatgtaggtaggatttgatttgggcccttaaagaagtttcggtaaaagtggagaggaagaagggattatcaaaataaccattttcagattatgtcatttcaataatgcctcttcattactgaacatagtttggaaactttccctttttgacctttgaataaatcaaaaatgttcatttcaccaactatttctctagggatttcaagaccctgttacttaccttgttcttctctggctcatgacttcatcatggttatctgttttaaatctttctcagtgtgctcatctttgatccttctctaaagcagcattttagacctgtaaatgctgtttgtacagagtcattcccctcccctgtaacctccctcttgtgaggccagagtttacctaagccgtatctgatatggagctcccaagttcttctctt

SEQ ID NO: 66452 - DNA, 1486 bp, Homo sapiens
tgtaaactgcaatttgttgcttttttattccaagtaacaaaattaagccaatcctgtattcatcatgtcatactgcatccatggaccacaatttcagtgcatcagtataggctgcctcccccaacccattttctgctgtatctctgaggttcttccggagatctttttcttgcttgcctttagaaattaggatttcctttagtgggtttgctggtggaaaatttttagtttcatttgtctgaaatatctttattttatttggattattgtgagaaatttttggtgagtacagaattttttttcagcaccttgaaaatatcttcccaatgtctttctgagaagttacttgtgtaattgttgttaaagcctacgtgaatgtatctttatttaaagtgttattgattaacctaaatgtcttcttatatttttctcttaaagggaatacagtgagtaacctgatcatgattatacctccaatgttcggtgcagttcagagtgttagagacggtctggaaaagcggtacattgcttcttatttagcactcacaggtatgtataacactgtatctgaagaaatgtacagtattcaaatgggccatttttctcattcatttctaaaagcggttttcaattttgtgttattacataacttgaatatattctgaaacttcttagttaaaactccaaaaaccttgccagtgaattgaactgcattttgaataaaatgttttagaaattacaaaatattttaagcatacaaaaaagaatagagataatataacaaatatacccacacatcttactacccagttttgtcaggtcctaacaatttataatatttgtttcagatctttttcttttttaaggaaattactacagataaaattaaaactcctttgtattcctccctgattgtatccccctcagcctcccagcccatcccctaagagctagcctcaatcctgaatttgatgcttatcattttctcatgttttcatgtttatactatgtatgtatatatccttagaagtatacatagtatggttttgcatagttttaaactttttggaaaggataccatccaaccttttgtgacttacgtatattctacttgtctgtgaggtggaggactgtgtcttaatgatctttgcgtccctattgtctggcagtttagtgttcctcaataagtactggatggatgggtaaatcagctataccagagcctaacgtagtgaaatcacttctgtcttctgtcatgttcttgcatcatcataataaataaaaaataccaaatgaagtagattctttctagtagtttcatttcttcattttctattctgttttttttattattattatactttaagttctagggtacacgtgcacaacgtgcaggtttgttacatatgaatacatgtgccatgttggtgtgctgcacccattaactcgtcatttacattaggtatatctcctaatgctatccctc

SEQ ID NO: 66453 - DNA, 1029 bp, Homo sapiens
agccatttgggtcagaagtgcaaaggagtagctaaccagctatgtgcattaaaacttatcctgagcatcagataatacattttacagaaataatggaatattgttagtctagtaagtcacttagtagagggaatttaggagaacttatattgtacttcttttctacaccaaaatttcaccaattatagcacttactcaagagtcagctatatcttgccactagattttataaacttcattatccttaactcaatgctttgaaatgtcttattgtcttctcaggtcactgtccacgcacaaagaatttcatgctaattttttttcatttgtttaatttcagtggtaggaatgggatcctggtgcttccacatgactctgaaatatgaaatgcaggttagtaatgatgaaattgacaaatgcttatttctcttaattcagaagtacttcagatttgagaaaagagcacataactatggctaaaagatgggatttgtaatctctggagttttttacttcaagtctgaggatccaaactgactaagtgaagtaaagaaataagcaggtgagtccataaggaaaacaagtacaaatagtatagggctttttgaccatctctgtgcgggcatataaaattgagagcagcattagagagcagagtcacatggggacatcttaaaaagacataatcagttcaccagaacaatatattcttattctgagatacctgcattctttcatggctgtatggcatccatttgaatagtctgagtccctctatgtagcaagactttaaagcaagcttgtccaacctgtgggccgcatgtgacccaggatggctttgaatgcagcccaatacaaattcataaactttcttaaaacattataaggtttttttttgcaatttatttttatttttatttttcatttttttgagtcaaagttttgctcttattgcccaggctggagtgcagtggtgcaatcttggctcactgcaacctctgcctcccaggttcaagcaattctcctgcc

SEQ ID NO: 66454 - DNA, 1112 bp, Homo sapiens
tctatttatgttcctacttatatattcttttaaaagtttctttctctctttttttcaaggtttgaatgtttcaagatcaagaactcagtaaactaccatctgctttttaccttagttctattcagtttaatagtaaccacagtaagtcatattttgtttctaacagattaagcatgtaaattcaccatttatggagtttgacatattttacttccagtatttgcttcatgctgtcaaactgaaatctttctacacaaaacaagaatatcacactgacaaatattgctcccttgttctctgttcaaatgttacttctcactgtaattgaaatacttttaaaaatctgtttagtttttaaagggaaaaagcaaaaaagcaaatatttagtagcaataattgggaaaaattaatttttctcatagatggacatattagctcctatttgttaaaaatgagagattggctctgctccattggtccaaatgtgactgttgtaatggttaacttttctctagtaagttgagatagctagtcacttctaattctacattaatgctttttttctcaagtaaattgcattttatattatgaaaatatttattgcagaaaacatttattgaaaacttaccatgtcaggcactagaaatacagagatgattaaaaagcagttgctatctgtgaggagctcattctgttagagattttagacatgtacacaaagaattgcatcaaaagataataattgcaataataggggtaaaaactacttatatggtgatgagataaaggaggttcaatcaaggcttcatgcatgagtcaaggaaagcttctgagatgaggcacttgcactagaatttaactgatgattaggagttcatcagacccctgggcaagagtgcagtgaagaatttgtagatagcactattgttttttcataggcagagaactttgaaacaacatagtgaactaccattttcaatcacttactatatgccagatattgtaactatgtactttaccttcattgtctcattaaatcatcaccactggtagaattgggcaagatttaatatggctggaacatatggtaattgaagagcagtgaatgagtc

SEQ ID NO: 66455 - DNA, 1102 bp, Homo sapiens
attatataaaattttatgggattgctacattaaatgaggatatagaaatatctaaatccagtacttaatatcaaagatattatagtcttgtagggagagaaacaaaccattaaatgccacaaagtttatacatgaagagtaatggtagaaaggagtgtgactggttgcttccgctgtatagagaaaggatcagaaaaggcttcaagaaggaggtatagtttgagttgaatcctaaaagataagtaatgaatagaggaggatttctgaacaaagtaaagagcagcatgtttaaaaatacagaagcgtgaaactagcacatttgaggaagcacagtactttctggagacttggatgaggaggaaacaagaagacaatagtgagaccaaatagaaaggaaggaatcatggaaggatttgaatgttaggttaagaaatttgaactttgtcttacaagtgatgagagtcatggcagggtcatgacttgaattttgattcccctgtaccatgtcatttaaaaactgtactcctgtagggcaatacatgcatgttaaatcttaactaggcattgagcttaatcatccacatgacattggaacctacaactagggtttgtgtaactgcgaatgcatctagaaggtgagttagagatttctggaagcataagaaagcataagaaatttgttttaaatgtcttcacttactgagtgcctactgtatgctagacactttcaggtattttagcttatcattcctcatcactattattgttcattatccagatgaggaaggatgcgtcttctagttaaattacttatccaaggcatgtagcaagtaagtggcagaagttgaaatttactcctatctctaagtccggtgttctctctgttgtagaacagatctgctttggggattgtcaacataacctcttcactcctcatgagaatccatatatccttatctctccttgatactgatgcagagtttggagtggtccacaacagatctaaaacattcgactcaccataacagggctagcactgaggaaatcctcctgtagatactagctctcctgtggcatgccacttgatctgattgcttttaca

SEQ ID NO: 66456 - DNA, 1923 bp, Homo sapiens
aaggataataaatatttacatttaattgggaaggctattttggtaggcaaaatagacttcctttgccaaacaataatgattgtactaacctcattttccgttcctatttaggtcatgtatggaatgttggtctttacattagtacttcgatctatttatattgttacatggtaagtagtttggatcatctgcaccatgactgaagtatattcagacctataacagtaaatctatagcctaaatcaaaataacacataaaagctcacttcagtagagatgttggaagaaaactataacccaacatttattgttatattataaggaatactgggtcttcagacaagttgttaatgggcatcatgtgaaaactagggttccaaaattaaagacatgggaaaattaaagagagctgtcgacgatggccttgttttgaatatttataaaattcattagatattagagaccttaaaaatcctatagttaaaaaaaaattgtttttgtctttcttaaacctacttgactagggaattccttttacatagtacctccaaggaaggctgttaatgtcacaaagaattagtatttcatgaaagattatttgggaaatgggtataatctttaggcattcatgaaaattaaataagaaataacattcatgagattaccttaaatagggcctggccacacaacaggtgttcaataaataagtagtatgatttgtgggtttgttttttttttcttttttattaaacttttagtatctagataactgtaaaaatgcatacatttgtaaaaaataatagatcccagtatcctttaccaatctcctccatttgtaacatcttacaaaactatattacaatatcaaaaccaaggcttgatatgaatacagtcaagatacaaaacatttccatcatcagaaggatgtctatgttgcccttttataaccagacctacttccctcctgccccacctcactcctcactccctgtccttaacctctggtgatcacttaatctgttctgcatttctgtttttgtcatttcaagaatgttatataaatggtatcagatatataacctttgagactggctttttgaactcagcataattatccaagttgttcagtgtgtcaataattcattcctttctattgctgagtagtattccatggtatagatgtaccacagtttaaccattcatctgttgagtaacatctgggttgtttccagtttgaggcaatcatgaataaagctgctatgaacaattgtaatgcaggtttttatgggaacacaagttttcacttctccggaataaatgcccagagtgaaattgctaggttttgtagtaatttatgtttagtttttctcaaaactgctgaattgcttttcagagtagctccaccatttttacattcccaccagcaatatatgtgtgatccagtttctttgcatcctcaccagaatttggtagtgtcactatttttaatgaagttttttataatttgcatttccctaatggctaatcacgttgaacataccttccatgtgcttatttgccatatgtatatgtattctccctggtaaaatttctgctcatgtctttgcctggtttctctttttttataagagataataaggacagttgctattgtttttacagttgagttgtgagattctaattctttattaaatatgtgatttgtgaattctttctcccaatctataacttttcatcctctctttcaatgagcaaacatttttaatttcaatgaggtcaaatttatcagttttatggattgtgtttttggtgtcaagtctaagaactctatacctacctatagatcccaaagatttgttcttattttttttctaaaagactgtatagttttacattttacatttaagtctgtggtttattttc

SEQ ID NO: 66457 - DNA, 1051 bp, Homo sapiens
acattgtatacatatgtcaaaacatcacattgttctccataaatgtatataattatgatttatcaatttaaaataatattaattttttaaaaagaaaagacatggaactcaccactgtatcatttctcaggtcccaaaatccctagttagtctgcttcttctcaacacctttcagggtcttcttatgtttgtcttatatataatgcccagcagttttagttttacttagtggaacgaatatgaaaaagtatatccacttcatcttcccagaagcccaagtcccagtttattctgtttttaatgtagaccccttaggtaaatataaagaagcataaaatacagtccttgacttaaatcaagtctgatagacagggtaccaatacttttagaaacacaaatgacagacctttaaaaagcacttaacagtggcaatcctatgaaataaaagcaactttcttccatctgtcttgccacaacttctttcctatatgtccatttgttgatcatttcatttagcactggtcattatttccttatctgtctgctcaactagactgtgagcttcttaaagtcttagttatcttggtaatccctggatcccaggatagtgcttacccataaatgtttttaaaatcaaattgaaactcttaaaacttttgttacttttgtctgatgaaacatctgaaaattcctcctgtaacaaaacacctagaaattctaaatataatataacaaacatcctttaaatgcccagatgagttcacaagaacataaaattccaggctgggcatggtgactcatccctataattccagcacttagggaggccaaggcaggaggattacttgagcccaggagtttgagaccaggctgggcaataatagggagacctagtctatacaaaaagaaatttaaaaattagccaggtgtggtgatgcatgcctatagtcctagctacttgggaggctgagatgggagaatcacttgatcccaggacactgaggctgcattgagccatgattgtaccactgcactccagcctgaacaacag

SEQ ID NO: 66458 - DNA, 1925 bp, Homo sapiens
ctggaggtcttcagccaaaggcccagtctctctgacctcaccttccagccatcttgctcacttcattttggccctggccagtacctgtgtactgtctccccacctgcccaccttcctcttggccttgggcttgtgtcccgtggtccatcacatcacctgtcccttgtcagtgtcattcactcattcatccgttcattcattcattcattcgatcattcgttcattcattcaacaagcatttctgaggcctctgtgtggcaggccccgttctggttgctggcctagagtaatgacaagacacacttcctaccctctcaggactgtgtgtcacaggcaaaaactgagcaactcaacaaataaaaagcagaatgtggtgctgggaaggttagaaacagctcccccatgtggaggaaagggaagcctcccatggtagttccttagccaagttgttcccctctcccctgcccctccagctacaaagcaaaaggttctgtgaggatcaggcagtttgacatctagctgtatggttctctcaaatacccttgggggaatttctgccaatgacccccagaactgaccccagggcttgcagtgtggttttaacaggaccgggtattctgtctcccttggtgcccctctgctgttcaggtagcccaggatcccactgattgattagccaccatctcacaattgaccgtgcttgtggtccactagacccttcagattgttttccgttgtgataccttggccttgactctgtcctcttttctgtgtgtggcgtgttgtggcgacggccgctccccaactcccatccccactctctccccaactccggctccactcacactccagttctttcatttccccagtataaaggctgagcttctggttccgccccgggccctggggatataaacatttgccagattcttcctcggcccctgggggaaactgaggattaattcaggtggagtaagtggtgggatttgggtagaagtgaagccttgtcctgttgtggccatggtgcagggctgcggcacagccagccatcagtgtcatccgggtcagtaatgctcaaggcacagtccctggcccagcagcatgtcacctgggaggtggttaggaatgcagattctcaggcccacagagccctgataaaccaggagttctgggagggggtccagcaatctgtgtgttaagtcctgagagtgagtctgatgctcactcaagtcttgagaaccacgggtctgggtgagagatacggtagctgggctgagatcctgtcaatgggactggaggggaagggtcccggggtgtttgggaagcagaatcgacaggctttggtgattgggtgtggaggagtgagagggaggcgggcgtcaggggtagctccaaggtttaacttaggtgacttcagatctccaatcaccaagccctctctggtcctgccttctccacctgctcctgcgggtcttgcatcttctcctgtgtacctccagtgaggagtggtccccaccaccctccccatcagtgcacttacgaagtgctctcatcttcacaaacaagccagcacccagcccagccctggtagtcagggcggttgccacagcaattgacatcagcgacctggtccccaaggaacctgccaccttccgcctgcctgcagggcctgcattatcgcttctgcggggactggagtggaggcagatggggactcccacccctgacacacaccccattttgagaactgagtggggctgggaagagccagtggcaaagggaggggaagagggaagggcagaaagtaggtggggcccccctttggtggcctcttctctccacggccccaggctccagcccacttgggtccttggcgttggtggcagcagcacttgggccatggcggaggacaggccgcagcagcc

SEQ ID NO: 66459 - DNA, 1020 bp, Homo sapiens
attcattcagtcaatgcatgtttactaaacatactctctgggtcaggccctgggctaggtgctgggtgcatagcagtgactgagacctatatggccctgcccccagagaactgacattcccagtgtaacatcagagctcaaagtcacagagttacttaattataacttggtaaaggtaagtatctcagatgagagctgccaagggccatgagactgagataggggtcctggcctaatctgaatagtcagggaggcttcctggagaaagaggatggacactaaaggacaaatggaagtctactgagtaatgaggagaaggaagaacctggagcagggagcaggggtgggggctgctgtgggggaggcagagaaatgaggctgggggagtgcattgagagtttgtgtcttattttctagggaagtgacaggactgggttggtctatgtggggcgagagtagatgtagctgcagacactgctacagttgtccctgggcgaggagatgggggattgggccagggtggtgccagtaggatggagaggaggagatggatttcaggagaatggaggcgctcagattgggctgactggatggagggagggaaagcaaagcagccagtggggctgccagccttggggtgggctggatgggtggatggtggcgctggtcactaggcaggagctggtggtagatgtggacggaagtctcggggaaggttgcagggaggcatgagaaagaggaaagctcacacactctgagaacaacagctggaaggaggccgagggagcctccaagcctcgcggagatgggaacctgagcctggagatggggaggattcatccgggtctcacgaaggcttgtggcagagttggaatccgaacccagtattcctttacattccgattcgctggaagcacacgcccccatttcctcaggaagccggacatcccctcactgtgttcccccatcctatcccccctccccctacccaggtcatcccagactggaaggagcaggaat

SEQ ID NO: 66460 - DNA, 1067 bp, Homo sapiens
acttactcaggcctctcaacagccatggaagatcctggatgcagatgtgctttataaactgtacagggcagcagacagtagttattaacaccattcacaatagtaacagccagcgtttgccagtgcgtgctctgtcagccgaaagttgcactgcctgctttgattgcattacctaattccttcactagctctgagatgggcacctgctgttagattcagcctcattttacaggtgaggaaacaggtcaaaagagaggttaagggtctgtgcaatgccatgcctgtgcccttgtgtgggcttagctcccctctcaaagccagctgtgttctctcacctctgggccatatggacatattaggttgttgggctggggggccaagagcctggggaggtgtgggggaggtaccctgctcagcccctccccacatccaggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacaggtgggcgttctcaggaacccccaccctgccctgtagcagctgcggggtgccttgccactgtcctgccagggactcctgcatgaccttgggtaatccctgtccttccttgggcctcagcaaacctgtctgtacagtgggggttagatgggcacatccgtcccatctgggggtcatgaagcccccagcctcacaatctaacctgcagatggtaaaaatgaggaaaccgcggctctgagggacatttgggtgtcttgttctgagctacagggacacttagaggctgagccagggactcagccccttgtttccacaacagcacaattctgtcccttctgggaacttggctgggctgggcttccccacggggcctctccccacagcctcctcagtctgacccgtggcgctgcttagccctggtgcttggtgtgcctctgttga

SEQ ID NO: 66461 - DNA, 1444 bp, Homo sapiens
cctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcaca

SEQ ID NO: 66462 - DNA, 1106 bp, Homo sapiens
aaggggaattaatctgtcttctctgtgctcccaaagcacacagctccaccacgacaggcctcactttatgctcttttgtggatttgagctgcagatcccggtgcctgtcccagctttgctcctcccatgccgtgtggacttggcctttctgagcctttgtctgggttggtcaagtgcacagcagggctgcctcccagcaggagccttggccctgatgcccttggctgtgtgcctggcagctgttcgaccggcacctgtgcgtgcgccagctgcggtactcaggaatgatggagaccatccgaatccgccgagctggctaccccatccgctacagcttcgtagagtttgtggagcggtaccgtgtgctgctgccaggtgtgaagccggcctacaagcaggtacagggctgagtgcacagagggcaggaggggagggtcccagctttggctgggcaagggtcccaattttcttatcaggaccatgggcggggcttgacatctgcttgacctctcaggtgcagcacggaaaattggggttcaggtattggaatgcatcagtgggcttcagttgccatgttcagctggtgaggacttcacacatggtggtgtaaggaacaagaccagggctgccacgcgggccctggatgtcagttgtgagaaagggttttgcaatcataccatccagctgagctaaggagaaaactggggctcagagaaggcaggacccagctgaggtcacacttcgagtcaggggcagagctcgggaagagccctgcctctcagcctcggggacactccggaggccttcccactggagaggctgtccattcccttgtgttccccatcctcactccagggcgacctccgcgggacttgccagcgcatggctgaggctgtgctgggcacccacgatgactggcagataggcaaaaccaagatctttctgaaggtgagcacagatgccttccctgggctgccctgggggggctgtaaattcccatgatgtgggctggggtgctcgggagagggaggcagtgctggggctttgagatcctttctgccgggctgtggtgtggctggaggagcaggtgggatctggcctctctg

SEQ ID NO: 66463 - DNA, 1070 bp, Homo sapiens
tgccccaggggccagagccagctgggagctcatggggcccaactgagttcttgacctgtgctcccagtgaaggaagagcagcccccactgggactgagcaggtggtcctagaggagaccttgtggggcgctgctcaggagctctgcctcctaggaccaccatgacatgctgctggaagtggagcgggacaaagccatcaccgacagagtcatcctccttcagaaagtcatccggggattcaaagacaggtgcgtgttcccaccagctcctcccctcctcagcccacatacaggtgtacgtgtggtgtttggctctcctctgctctgcccgcatgaacactaggaaaaaaacgtgttcacctatgaaacaagtgcacacatgcatggcatgcacacatgatcatgtaaacacagaggaacatagatacatgatttacatggacccattgtgccacgtaagccaaataatgcaatacattcacctacatatgcacatgcacacgtagatacatgagactcacatgtggacccactgttcatgtcagatgctgatgaaattttgcaaagaggaaatttgagattttataaattattaatacaaaatgtgtctcatattctatctaagggatatgtgtacacgtgacaattcacaaatgtgcaggactgactccaaagtgtgattaaagctctgcaaaaattccacaatgcacccctttgcagttcatatggtcactctctcccttcttccactcgtccacccacctacctatccatccgtccgttcacccacccacctacccatccatccatccatccatctgcccacctattcacccatccatccatccatccatccacccgcccacacacccacctagtcactcatccatccacctatccacccacacattcatccatcaattcacccaccaacccatccaccatccatccatccacccacccacccatccattcactcatcagtccacccacccatccacctacccattcattcctccattcatccattcacccacccactcccacagttgctcatttgcttatgtgtgt

SEQ ID NO: 66464 - DNA, 1050 bp, Homo sapiens
ggctatcgggtgggcacagacacctgggcccacttcatactctccgagggcacttgtgttcttcactttgctgggcctctccacacccatcgtcccattttacagatgaggagctcaaggctctgggagactcagtggccggtcacatcataggaagtggcaggcggggatcagaactggggttgtctgcctccaagtgtcccggtcccctggtctccacagtcccacgcacatgccccctgctgcccctgctgccttttcagaaacgggtcccggaagtaccctccgcacctggtggaggtggaggccatccagcacaagaccacccagattttccacaaagtctacttccctgatgacactgacgaggtgagggtcaccggcttctaggtctgcagtgcccaggacagggccgggcttcctgggtggacaccaaaggtggccttaagcctctcccccatcacctgacatttgccgcctcgtcctcctgccccgtagtggagtcggggctcaggacgaaggccatcgactccccaggtcaggggcccttggttcctgatccaacccctgcttcctggagcagcttccttcagaagggcgcccctccctccctgtctctgaggaggacttgccttggagaaaagcgcttctccctctgagctggctttgcactggctttgcacctccctgatgtagggccccactggcccccaggtccagacctcccctgtcgactgagcccactttcctgcaggcagaacctcaacaccccttcctccctctccacctgaggtggttgaggttccctccatccaggtcctgtctgccaaaggtcctgtctgtcatgcctgtagtcacgctgcccctcatggtccccagcccctgcctgtctcaacacagtgtctcattcagataagcttttcatttgaagagtcatttatgaaacttgtctgaggctggagactcagaaatgccataacaggatttcatttgcaaggaccaaagacttcctcaaatcctttcctgtccctccagacatctctcctgcca

SEQ ID NO: 66465 - DNA, 1034 bp, Homo sapiens
gcctgccttggagggttttgaacacaggtgacgtggccagaaagcctctcaggctgcgggtggaggaggggtctgaggggcacaacagaggcaggagtatggtgaggaggctggtgtgagaggatacgtatggtcttatcacacagctaggatgggaggccttttgaggagcttggctgtgcgaggagaacaggtaggtagctggaggcaggtgcagggtccaggaggctttttaaagatgggaggcccttgggctgagagggaggacaaagcagaggatggcctgggggacccaggaagggatgtggggcagcactgagggcccagcggaggtggaagccataggtcatggcagggccgtcagtaccacataggcaacaggagaggctgactttatcccagctggggccaggcttcattcctgtccccaaatgcttttcttgctctgggcccccatctgatgccttctcatctttttttctagcaaactacggagccaaacttccctgagatcctcctaattgccatcaacaagtatggggtcagcctcatcgatcccaaaacgaaggtgagcagggataaggcagcaagtgggggcgggcttctctgcctgaaccacagacacggtcccagaacgaaccccacaagccctcctagccaccatctatctctagactcatccacccatcacgtggcttcaaaagctgtcagcgtttgctaggactttacccaacgcttgctccaccaaaattgctctcctgaagttactaacaaactccttcctatggaatgtgaactccctttagtacttggcctttcagtatcactggatgctctgcccatgcaggtcatggggctggctgtgcaggggtgaccgtgcatctgtgtttctgggccagagcagcccagctgcacacccagagggtccgactggacaggtggtgaagagggctcgtgaccaccatctttccattggcttcatgcatcacgcattcctggctgtcctctgtgtcttggtcattccttcccggacc

SEQ ID NO: 66466 - DNA, 2104 bp, Homo sapiens
tgtagtcccagctattcgggaggttgaggcaggagaattgcttgaacccaggaggcggaggttgcagtgagccgagaccgcaccactgcactccagcctgggcaacagagtgagactccgtctcaaaaaaaaaaaaaaaaaaggaattgctttctgtaacagttttactgaaaatttagatgcaattttcatataatattttctcctaaatagtcattaaatgttgaaggtatggcccaaagtacagcccagtgaaagtgatttgggaaaggaccaagctactgaactttttactgaatgattagcattattggatttgaggatagaacaataaattcctagatcaatgctcctaaaatgcagtattgcgatatactactgggtcatgatctattaataccttccccagaggtaattattattctgattatcaccatggttaggcttacctcggaagaaatggaataatacaatatgaacttgcttgtctggcttctttcccttaatgtgtctgtgagattcaacccatttgtcagtgtaccaattacttattgtattgctgtgtaattttctgtatagtattatatgaatataacactattcatttttccattctcttggacatttgggttctttctggttattggctattataagcaaatcttttatgaacatttctgtgtatgtcttttggtggctatacaaactaatttctcttgggaatatacctaggattggaattactagagtataggtagatgtatttatctgtaagtagatgctgccaaacagttttccaaagtggtctgttttaagatgtccttcaatttggggatgatcagaagctttccacacagcaccctttacaaacaaagatgcctttatgtcttgtaatggttactggggaagaatgttaaatagtcatgtgtcttttgctatttttctcctttctagcatcaattcctgaagattgccaagcccctctccagcctcactccactgattgctgcagctaaggaggcaacaaagaacaatcactaaaaccacactcaccccagcctcattgtgccaagccttctgtgagataaatgcacatttcagaaattccaactcctgatgccctcttctccttgccttgcttctcccatttcctgatctagcactcctcaagactttgatccttggaaaccgtgtgtccagcattgaagagaactgcaactgaatgactaatcagatgatggccatttctaaataaggaatttcctcccaattcatggatatgagggtggtttatgattaagggtttatataaataaatgtttctagtcttccgtgtgtcaaaatcctcacctccttcataaccatctcccacaattaattcttgactatataaatttatggtttgataatattatcaatttgtaatcaattgagatttctttagtgcttgcttttctgtgactcaactgcccagacacctcattgtacttgaaaactggaacagcttgggaatgccatggggtttgataatctgccagggacatgaagaggctcagcttcctggaccatgactttggctcagctgatcctgacatgggagaacaaccacatttttctttgtgtgtgcttctagcagctgttcgggaggaccttgacccaatagtgttcccatgctgtttcttgtgaaatgctctcggctatgtagcagcttttgattccctgcataccctaggctgctgcccctatcctgtcccttgtttataacattgagaggttttctagggcacatactgagtgagagcagtgttgagaagtcggggaaaatggtgactacttttagagcaaggctgggcatcagcacctgtccagctctacttgtgtgatgtttcaggaactcagcccctttttctgcctaggataaggagctgaaagattaacttggatcttctaatggtccaaatcttttggtcacaataaagagtctccaaattagagactgcatgttagttctggatggatttggtggcctgacatgataccctgccagctgtgaggggaccccgtttttaagatgcatggccaagctctctgcaaatggaaatgc

SEQ ID NO: 66467 - DNA, 1057 bp, Homo sapiens
tggagtgcagtggcgtgatctctgctcactgcagcctccgcctactaggttcaagcagttctccagcctcagcctcctgagtagctgggattataggaacctgccaccatgcctggctaatttttgtattttttagtagaggtgaggtttcaccatgttagccaggctgctctcgaactcctgaccttaggtgatcttcctgcctcggcctcccaaagggctaggattacaggcatgagccagtgtgcccagctggaacatatctagtttcttactgtagcatacaaaagccaaatagcaggataacattatgaaacttaaggtttggactaaggtgaaatagttagatggagggaagtggatggatttgagagataacttagcaggtaggttcaacaggattagatgattgaatgtgaacattacttacaagtgggtgatattattcaaggagaaaggaaaaagaaattggatactgcctgattgccaagtggatagttgcttacataactttggggcttgggggagaaatctgatctacaggagatttaaaccatgtctcttgactcctaatctactggtgctacctttactttccactgaacagtgaaatcctcatttatttggaggcagctttttgtccctctcatttcattaagccatgagaactatagctaaagcctgctgacccaaggtcttatattcagtagaagaaagatatgaagggaatatagagtacttgaggtttccttgcattttaatatttggttgcagagtaggagtgtcagccaatgaactgtggatggcagctgccccagagaagttcttacttcaaagagtaccagtacacaataattgagagaggcacctcctcttccaatgaaaatagagttgggcttctgtgagggaggctgctagaaacgtgcttctatatttttggtggttgaaaccacgtggcaccctggagaagtcatggttaataggggtagcacatatctcactaggctcttgtgagtttttacaagtgttaaagccaaatattaaggctccacctagg

SEQ ID NO: 66468 - DNA, 1066 bp, Homo sapiens
tgcccaaagtcatgcagaaggtaagaataataagagttgggatttaagttcaggcagtcaggttccagagtccatgttctaaatcatcacactctactacctcttgatgaagaacaaaagtagttccttccctgcaagggttcaggatgtaaggagggagtaactcaatagaagttggtgttgtactagtaatgcaaagtgctatttgcattactacaggatatgtcttttaacttggggaagcataaaatattacaaatgaaggggattcttacctaatagaattgtcttcaactaatttcttttgttacagaatatttcttttagcttggggaatacaggatatttcttttagcttggggaagcataaaatattacagatgaaggggattcttatctaatagaattgtctttaactaatttcttttgatagttgtctagcctctattgaatatctttagtgctgagactctcacttcttttgtttacagtgagagtaaggaaggccattttacccagaatgggtgggcctgggcacagaggaggagtaatatagattttgacataagagaaaggatgagtttattggggtttgctctgtggatgttctaacctcacatctaggagaggttcccctatgctaacaaaggctggtcttgccaaaattttgcactaataatgcaggtatacacacggtctgtgattgaaccacttcctgtcactccaactcgggacgtggctacatctcccatttcacctactgaaaataacaccactccaccagatgctttgacccggaatactgagaagcagaagaagaagcctaaaatgtctgatgaggagatcttggagaaattacgtaaggaatttgtagctttctgaacctttcttcgttttatgactggtcaagcacagagatttgctggtcgtaggcttggtccatgcagctggctggccatgcttggtaccttaggcacagactgcttctcctcaccctgcccctgaacctcccttccctgtctcacagccctggttggatactatgttaggatggagatgtggtgag

SEQ ID NO: 66469 - DNA, 2101 bp, Homo sapiens
attctctgggcttggttcttggtgaggaatatattggatttggtagaatatttcccctccttaattctattagtggtgaattggcagtcagtttttcttggacccaggggaattaaagaacaaaactgaagacattacctggtctttaaacttactttcttcctaagatctccattgggtctctctttcaaattttatgaagtctaagataccactgattgtaagatgtacaattatttgcataccaatcaaagaaaataaagctgccaattaaaccataacatgctttagaaagtaggacacacctctgtttcagagacgttaatgtgaaaaaatgtacatctcagaatcagtgaaacatggtaattgcttcattgagggagcttgattctattcttggaaaacaagaccctacctttaattagacttgacaggatcaatacctctcttttcctcaaccttagtccttttgtccttgtgggcagtagatatggatatagaaggatcctttatgaaagctgaaactggagactggccatgttttggcatggatgactcaggatggtgctatggattctttccttttcttttagaatgcagattttcttggccatttaagcctgacagtgatatagctgatgatgtggatacagttctagcgtagtatttagaatgagaccagaattcaaatctaattcctctctttaacctgtgtgtaccctgggcaaataacagtcatgtgccacaacaacagaccgcatatacaatggtggtctgataattaatattataagggagttgaaaaattcttatcacctagtgattcctgaagtttaaaataaatttagcatagcctaagtgtacactggtaatgtcctacttaggccttcacatttactcatcactcactcactgactcacccagagcaacttccagtcctgcaggctctatttatggtaagtgctcatataggtgtatccttttatttaccttgtaaaccatattttttattgtaccttttctatgtttagatatacaaatacttaccgttgtgttacagttgcctgcagtaacgtgctgtacaggtttgtagcctagaaagcaataggctatacaatatagcccaggtatgtagcaggctataccgtctaggtttgtgtaagtacactctatgatgttcacataatgaccaaattacctgatgacacatttcacagaacataccccattgctaagccacacccaactgtacttaacatctctgaacttgtttccaaatcaataaaagtagatataataatagtactcagagccataatgaggattaaagaaggtgatatgtataatgcatttagcatgatatctagcctgtagtaccagtcatactattactattctctgaatctggcacgtgcttgaccagatagacttcttttgctgtccagaaaaatttaactgtaactgttattgactaagtcccttgtttttcttcctgtgcagataagtcagctgaggattacaattcttctaatgccttggtaagtctttatttactctattttgatgtgggcagatgtggaggtaaggatcaagacagtgtggtagaggcagagcctgagctgggaggcactcatattagtcactcctgcacccttggcctcagaattcctatctatccaataaagaaattagatataataaatagggggtatccctttcagctttaatgtcctagaaattctttctttgtgataatttttttatttttaatttttatggattcataatagtcgtaaaatgttctagaaattctaattttggaaccagaaggtatggctttagactcagttttaatttgtagctttgaaccttgggaaagtcagtttgcctctttgagcttcaatttcttcatcaataaaatgaggatgatacactgtgccctcacctggacatgtcttcagatacctacacttagaagaaaatttcctctttggtctatggagtctgcaaaaccaagattagtactaattgttgaagggagcagattttattcatttaaagtcattcattctgtcctctgaagttgtaatgaatgctttg

SEQ ID NO: 66470 - DNA, 1102 bp, Homo sapiens
agtccattcccaagagggaaagtgtaacttgtctaaggttataaaattagaggttggcagagaactcactatgtggaatgctgttagcagttttatttaatcttcacatagatgaataaatgaaacctaagaggttgaagaatttctctaaagttagtaagtggtactgggattcacacttagtttttgctaggccaaatttctgctttcaactacatcataatggttttccgtgctttgcaatgtctcagaatgggaatgcaaagaaaagcaagatattgtgatttttcattagtgcttggcatatagtaggcatttacatcagtgagtgttagcaatatcatggtgtgcagtggaaggacttgagctagaccctgaaggaagggctgtataattttgattctttgcaattttttaacatgtatttccttttggtcaaaaataataaaagagttatattgttcttatttctgattctagtagctgctgctggtggtgacaatgtcaaataacggcctagacattcaagacaaacccccagcccctccgatgagaaataccagcactatgattggagccggcagcaaagatgctggaaccctaaaccatggttctaaacctctgcctccaaacccagaggagaagaaaaagaaggaccgattttaccgatccattttacctggagataaaagtatagtatttgattttcttctcatcatttatatgctttaaaaaaattattttgggtaacctggataaaagatctgttgtctttgacttaattttcctttaatgttttctttctggttaaatatttccctttctccctacagtggctgaagcaaaatggaaaatagacctatttttatactctattaactatatctgagcaaaactgtaagagaataattatgctcttgccagatttgggacaatctgaagtgatttatttatttttaaattcttaaactgtttatgaagccacaaaatgtaagaaaaattgaaatgtctttatttggaatttttttccccccgagttagtttcaattggaaatgttttctttccaaaatcttgattgccttttctttattccagcttcct

SEQ ID NO: 66471 - DNA, 1116 bp, Homo sapiens
actgactggcatctgtcgcgcattttagtttatttgtgattgaccatgatgcttccagctatactaagaagcaggcagtcaggtgacatactgtacagcaaagaaatactgagtccctgtttgagatggagggagagctgagagaagcttcttctgatatgtaatttggagtttgctggtgaagttttcttctgcatatgtgctttcccacgcatatcttacttcctgattggcactggctgtgtatcacaagttgtaattatgttataattagattgtttatttctttaacatctgacttctgcagtgttctatcctataagttacataaatgtaggactctgttttgttcacagtattccagcacagtgtcttgcatgcagtagtcactttatgaaaattctgaatcagtaggcacatgagaggtaattaagagagagagataaattgacttagtcaagattatatagcagtttggtagcacttctgggactagatctgattttttctatccttaagcccagaattctttgtacaacatagtgctgcttgccacatgcctatcatgattagagctatatgattttgctctgtggtcttagccaaatctgttggttttcttttctgtaaacaaaagtattaaacagctgttcttttctccttcccatctttggttgcccaccagtgatatcctggtgtggcctccaaccatagagtaagtgtctgctgagaaacagggaaaccttactctccctgccaacctggaactgggaatcatgttatttctcctgaacaccttcctatttcagtggtgatgtggcggtcatggtctaccaattgaaacagaaagcagagtttggattatagaggaagaaggcagttggagtagctactttaacccttctttattcagaactgcactctgagtgcctatgtacacatactctagcgccttcttactcttcattataaacattggggtctgctcattttccctttagtttgttggaaaaacacacaaatctacttaaattagttgaggaaaatgtcctcttccattttcagttattttgttcagtaatactagtgataagggatgtctattaagagaaaata

SEQ ID NO: 66472 - DNA, 1017 bp, Homo sapiens
acgaggaggcacagcaaagcggcgcccagttccttctgcatggaataaatgaccccttccaggcttggacagtcacctttagggttctactccctgaaaaataagggctggtaggacttgacttacgcagcccctcccccaccccggaatattctgtaacttgggaagtgaaaaacaaccggggaaggagatttatagttattttatgttcattattacgtttgaaaagacatgattgttgtagccttcgctatcctatttcagcagtacacattactgggagtgttttggaagaatacttgagaagtagtgggtgtggcgttgtgagcaacgtccttggtttttaaaccccttggataattgttctactgttacaaaaactgtgaacagtgaagggaagggttagttccgtggttactaataaaaattcagattcattagtcttgactttaagaattgttcctgagaacaatctttaattttgcctcctacatttttgggttctctttcaactctgtcaggagaaagtaggaattatcagtacagatacctcatctctcttaccctgtggcttcatctacttcttgtgtgaccttgagcaggtcacttccagccttaaaagctccagaagtttggttttatgccccaaaacgggcaagtagcaagcaccggactcagctttcaagagtccactgaagaattcccacactgtgaagtctttgctggcctccatcctgtctctcctcttacagacagagctgatttcttcccattggcccggtgggatttctaccacagcacttacaacattttggttcctatttggaaaattctaagtcaggtgcatataaaaactccccacctcaactagaaactatgcctttcaaaaagggttttgggaacattgaccctgaaaacttcccatactttccctgaagcttatccatactctttaactacatgagctcatgggtctaccttggtaaatttgcttattcagtcaattcgtttatccaa

SEQ ID NO: 66473 - DNA, 1044 bp, Homo sapiens
ggcggtctccaggcccgagtccgaagtccgcagcccctcccctcctcacgcccctcggggcgggacgagcgggaggctcccgagcggcacacttaagaagtcctccccgcctccccggcttggcgctggggtgttggaaccagagccgaggaggcggggaggcggggaggcggggaggcgcggggaggcgcggggaggcgaagggaggtagcctagggcgccggccgcagggccaacggtcagccgagcccaccgcgcactcaccctccgcagtctccctcagggccttgtaggcgggcgcggcggcggagggccggcgcggcgcggtcgacgcagcgctcttggtgcccactgcgcacgcgtgctgcggcccttgcgcccctgcgggcggtgacacccggaccacggggcggagaggagcggcacggcgcggcggagctctgatggttgctttgcagcgaggaccttagagtttttctttccccgctccacactgtaaaaccgtggagctggaaagaccgctgaaggccatctcacatagccacctcgtttttatcaatgggcgactgaaattgagaggggagacgcggcgcagggggcgggtgagttagtgggcgtagaccggtgcgcagggcctcctggagccttgcttttcttcacctgccaaaaaacatttctaaaaatggtggtaatatatgccagataaaattcgccactttaatcaatttaagtgtatatttcagtggcatcgattaccctcacagtgttgttcaacagtcacctcttttttccagaacttgagcggtgattcttcaaagtgtagcctagttttagcatgtgactgtctataacctttggcatgaactctttacgtataatatgaaacagttgtgtcttactgttacatgcactcttcgtgaagaggaaacaacaggtaactggagaggtctgtttccaagaactgggggtcctggcgcacctcttccatctgctttgaaagcaggaatacggctgcgtgaggtggagcgcgtccggagtcccagc

SEQ ID NO: 66474 - DNA, 1026 bp, Homo sapiens
ccccgcctccccgcctccccgcctcctcggctctggttccaacaccccagcgccaagccggggaggcggggaggacttcttaagtgtgccgctcgggagcctcccgctcgtcccgccccgaggggcgtgaggaggggaggggctgcggacttcggactcgggcctggagaccgcctcctacccagagccggagcccgcaacccgctcaggcggcgacggagccatgtcgccgctgctggggctccggtccgagctgcaggacacctgcacctcgctgggactgatgctgtcggtggtgctgctcatggggctggcccgcgtagtcgcccggcagcagctgcacaggccggtggcccacgccttcgtcctggagtttctagccaccttccagctctgctgctgcacccacgagctgcaactgctgagcgaacagcaccccgcgcaccccacctggacgctgacgctcgtctacttcttctcgcttgtgcatggcctgactctggtgggcacgtccagcaacccgtgcggcgtgatgatgcagatgatgctggggggcatgtcccccgagacgggtgcggtgaggctattggctcagctggttagtgccctgtgcagcaggtactgcacaagcgccttgtggagcttgggtctgacccagtatcacgtcagcgagaggagcttcgcttgcaagaatcccatccgagtcgacttgctcaaagcggtcatcacagaggccgtctgctcctttctcttccacagcgctctgctgcacttccaggaagtccgaaccaagcttcgtatccacctgctggctgcactcatcacctttttggtctatgcaggtttgtcattctcaccaaatacttggcacttccagagcctctatgacatgaggctgtaagttctttactaaaatacatttgaaaccgtctatcccgctatgatgtaaatgctggtatccccgttattctaaccattttgcagcccgttcttaaccagtagggccgacacgtagagccttcatgc

SEQ ID NO: 66475 - DNA, 1247 bp, Homo sapiens
catgctttaaaagaatgaataaggaataaataattaagagtagtttatgcaactgttaataatttcaggataatggaactaggacttctcagtgcatgaggtggggtggagacggcacgttaatcgtggaatcacaactctgccacatacttgtgtacacctttggacaaggcatataacttatttaatcctcacttcccccatctgtaaaatggggaggataatacctaccttgcagggttgttgcagaggctaagataaaatgtacctaagtcctctggcactcgtgactaggcattcaataagtagtagctattattattatcactactgtaaacactgtaaaccttttgtttttcagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctatattactttgctctcattcttgactaaaaccattaatgagaaatgttttttaaaaaataatgctggcaaatatgagaattttgttggctttatttttgtttacttgttgagaagatgaacatgaaattaataagaaaatatagttatagcttctggcaagtatttagtaaggcaaagatttaacacatttcaggggatttctgccacttccttttagatcagcagtaatttcttatatttatcaactctcaatttttagttttcatagatacctgggtattataaggctgatttgtaattactgatttatacttggacttttgaaatcattatgtgtccttaaaaa

SEQ ID NO: 66476 - DNA, 1033 bp, Homo sapiens
tgtgtataaataaatgttcaaaagtatcttcctggaagcctatttggacagtatattatcttcagcagattcttttttttttttttttttccaagacaaggtcttgctcggttgcccaggctggagtacaatggcgtgatctcggttcactgcaacctccacctctgtggttcaagcgattctcctgcctcagcctcctgagtagctgggacaacaggcgcgtgccaccacgcctggctaatttttgtatttttagtagagatagggtttcaccatgttggccaggctggcggcagatatattattgattccattttgttttttctaattgttgtatttaaactttaaagttttctgtttgtttagaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaaggtgagtgtccttttgcagtgtgaacagtcagatgagcacttgggcaataagttatggatagtcaatagaagttcttttaataactaagagaaagaattgactctctatagtataggaagcagatacagaattacatagtataggaatgcttatgtcatttgtttttagtgattttttttcctcattaccaaaaaagtctttgttcatagtcaaaaaaatttttttaatgtgcgcaagaaagtagaagtgaaaaagaaacaagtgtaattctaactgagagatatccactattaatttactgttgcatctgtgtattagtttgctagggctattataacaaagtgtcatacaggctgggtggctcaaacaatagaattttattgtctcatagttttggaggctagaagtccacgataggttatctctgagggctgtcaattcaggcatctcttcaggtatacacacacccaccaaagcaagagagagattttaa

SEQ ID NO: 66477 - DNA, 2461 bp, Homo sapiens
ccagcctgggcaacatcgtaagaccccatctcaaaaaaacaaaaattagcagggtgtggtggcaagtgcctgtagtcccagctgcttagtaggctgaggtgggaggatcgcttgggcctgagagggcaagggtgtccagtctgggcaacaaaacaagtcccagtctcagaaaaaaaagttgacccttagctcattgttgatgagattagattaccttaaaaataaccttaaaaattcattcccggtgaggcgcggagggagcactttgggaggccaaggtgcgtggatctcgaggtcaggagatcgaggcaaggcttttctaggatgctcactgtataatcagaatttttcaaccataattggaaataaatttgtcaaccataattggaaattaaaattgaattgcaatattcagattttcaatatgcttcatttttttaaagtcaaataatgacattaaaagggtattttattttctagaagaatcaaaagaacctgttgctgatgaagaagaggaagacagtgatgatgatgttgaacctattactgaatttagatttgtgcctagtgataaatcagcgtgtgagtgttctacagtattgattcttccccttttacataccaagcattcccaattgacacacacacacatacacacacacacacacctctcacctttaccaccattacctccattctattgctttttctttattttagcattggtaatatcattaaggaccaaatacctattaatatcaaaggttgtgaatgtagtgagaatattgtagacactctgtcatctgggtatattttgtgagtggactctggttagttttactgattggtgctgttgacttaatctcacctgctggatggcagaggagttatggcagttttaaagtggaagatctcaggatggctggaaagagccctatcagctgagagcagtcttcacccttcaccctgatgccagcagtcttaccaggactctgacccttttttcttggaaaatcccacgagccatgaagagattgcaatgatctctcataatgaactcttattattttatgacttgtcttttgcttcaaccgctttcaagattgatcttacaatttggcagattttgtaaatactgtggcgttttgtgtacccattaaatttatttgcactgatggttacttttattacaaaaaaagattggttacagtttaatttccttgttcagtggaggcaatgttcactgcaatgtgcgaatgccaggccttgcatccagatcctgaggatgaggattcagatgactacgatggagaagaatatgatgtggaagcacatggttagtgaaatggattttaaagtgggttttttgtttgtttagtgtttcattttaagcatttatttgtattaagggtagaggattatagttctttatatgactgtaaagtatgcagtatggtaaaattattattattatttttgagatggagttttcgcttttgttgcccaggctggagtgcaatggcgtggtctcggctcactgcaacctctgcctcctaggttcaagcgattctcctgcctcagccttccaagtagctgggattacaggcatgcgccaccacgccaggctaattttgtatttttagtagagatggggtttctccatgttggtcaggctggtcttgaactcccgacctcaggtgatccgcctgcctcggcctcccaaagtgctgggattacaggtgtgagccactgtgcctggctggtaagattattattaaaatagaatgacacggtagaacactttatgccaaagccctttgcaacagacaaatttttgagtgtaagaaatagagattgttatggggaagaatgggtaagtagagcatatgggaggaaagaaaatggtagatagggaagtggatggtcaggaaagtcttttaagctgaggcagctgcccccagagaacaagcttctctctctacaccttgagaacctggatcatttatattgttttattattactattattattttgcaacagggtctcactctgatgcccaggctggtgtgcagtggtgtgatttctgctcactgcaacctctgcctgctggactcaaatgattctcccagctcagcctcttgagtacctgggactacaggcttgcgccaccatgcctggctaatttttgtgtattttttataaagactgggctttgccatattgcccaagctggtctccaactcctgggcccaagcaatcctctggccttggcctcccagaatgctgggttacaggcatgagccaccgggcctggcctgcatctttatttaacatgttccttcaaacagctcactgccaaggtcatttctttttctcagaaccatacttcatttatttaagagccctttccgattgcctcccccagaccagaatgcagtcactagcgtgataagagtcttt

SEQ ID NO: 66478 - DNA, 1148 bp, Homo sapiens
tgaaggtatgtatggtgtaatttaatctaatgcctcctttgatagcaaattatattttaaaaaagagtctttgaggccgggcacggtggctcacgcctgtaatcccagcactctgggaggccgaggcgggcggatcacaaggtcaggagatcgagaccatcctggctaatacggtgaaaacccgtctctactaaaaaatacaaaaaattagccaggcgtggtggtgggcgcctgtagtcccagctactcaggagactgaggcaggagaatggtgtgaacctgggaggtggagcttgtagtgagccgagatcatgccactgcactccagcctgggcgacaaagtgagactccgtctaaaaaaaaaaaaagaaaaaaaagagtctttgataataatcaatgtaacattgaggccattgactcattttgggtagtagtttattaagcaaaatttcagcacagcaacttggacacttgaagttttcacaatggatgttcatgtgtgtctgtatatatttctctatatttacacttagaattcttcatttattatggatatgtatttctagcttttcctctaaagtttcactgtttattctgcctttctctttttaaaaggcacccttaggggcttggatcagtataccctgtgcttctcataatttaagatagaactgttttgttttgtttcagtagtgggtctcagtggttgtaggggggatatattttccatgggcctccaccaacctcaccattcccccacatttggcagtgacattttggttgaaagaggaagggtattattggtgtctagcagttagatgccaaggatgctattattatactaaatattctgctatgcacagatggtcccccacaacaaagaattattccatccaaatgtcagtagtgccaaggttgagaaactgtaggatataaagattctcaagttttgctttgggataattgcaaagacttgtaaaagtctagtgaagatgctcatgtttaaaataacgggttgcttttctttgaagtagtgtgtaagagacaatcctatgaagttacctacaaggctattgctctttcaaatttagattttaatatggttccagatataatatgatcatttatattcaggtgtgaaactattt

SEQ ID NO: 66479 - DNA, 1059 bp, Homo sapiens
tttaaccatttaaacatacaattcactagtttttagtctgtttacagaattgtgcaattatcaccaccattttagaatattttcttcaccccaaaaagaacctggtacccagtagcagacattccctatttccttctagccctaggcaaccactatattgcattaacattttttttttgacttcttcaggattttttactttttttctgctaagtggtacagctccagatggatgaagtattatcagaaaattagctagcctctactgaaagctcaaaatactgattttggtgatgtgtttcctttgttacaccaataaaatatttgcatttgaccacatttgagggaaaactagatctagcttttctgtggctttctcttaaagacgttgaataaatgaaaggcttcagggaatctgtctctcagggtaataattatttcctgacttgcggtgagtgtgattacagccatttcatatatatgtcttttagtgtaggattcatggagaaatgcatgattaccaaggatttattgcatacttaactcctgagctctttgttaacggttttgaaggatgttaataaaggaatgtgacaagttctgctgtccgatagttcacattccataagggcacatataagactcattaccacagagttaagtgctaaaatttgcaaatcagaaaaggaagagatctttatggactggtgtagttgaagggaggcctcatggaagaggggaggatttgcaaaagcaaagagggtatttgaagacataccaaaaaagagtaagcatgaaagtcatagaaacatacatgtgactgaggaaaatggaatttcaagtctgtttgaatttatagctagagggaaagagaccgtaacagaattgatcttaaagaaaactcagtttccactactgaattttcttattttatgaacgtttctaaaaaagtaaacttgaatttatttatatgcataaaggtgtccaagctgaacttttatatactttgtggtcttacatgaggatttactttctaaaaataatctacttaaaacatgt

SEQ ID NO: 66480 - DNA, 1030 bp, Homo sapiens
catatgcagagggaccagactcccgttttggggtcctggaaggaattgcccttttatttggccacgtggagcactttggtattttgacagtcagatagatctaccgtaaatattgtggttgtagaacagaggtccctgtttccttgacatgcagttttctttattttgaagcctgtaatgacacatcgaatctttcctgcccttcagatatgtgttgcttccccttttgctccatcacttgtctacagccagagaaaattctctacttttaagagctcatgtgattactttggaaccacctgtaaaatccaggataatctccctatgttactgtcgactggtaaccttaattacgtttgtgaagtcccttttgctgtgtaatataacatattcacccgcatgacaccagaaagtgaaggtcgtggggccaaaattctgcctactacagaatccagagcacaaaaactgtaaagaacctctgctttaaagggaaatttagacattgaacaaggtttaggcttcaggccagaaactgagataggacatatggatgggaggaaaagcaagattgaggtgagaggcagataatgagtttggtcaggacatgtgtggagtagttgtacatatgaccgtgttgggccgggcgcggtggctcacacctgtaatcccagcactttgggaggctgaggcaggcagatcgcttgagcccaggagtttgagatcagcctgggcagcatggcgaaacccagtctctacaaaaaatacaaaaattagccaggcatggtggcggcctgtagtcctagctactcaggaaactgaggtgggaggatcacctgagcccaggaggtcgaggctgcggtgagccgtgattgtgcccctgcactccagcctgcatgacagagtgagaccctgtctcaaaaaaaaaataaaaataaaaaaagaatgtgtatcttgggaaagtggtattaaagagagatgtttggaggtcgttaaagtgttagtgtatactcatggaaatggattagatatc

SEQ ID NO: 66481 - DNA, 1738 bp, Homo sapiens
taaaagggtgttacacgtacccagtttttactttttagttgatgaaacccatcctataatatacatttgagcaaagtacacatattaagaaaaacatggacatttacttgtttaatagtcaaaatgatgaggaaatgttagctgtttttaagtgggactggtggggtgtcctttgtcacaaggaatgcttttttagcttgtttgtgggcataagagatgttaaccctttgctgattctaccacacaactgtaaagaacctaatgaatctacaagtttaatattcagaaaaagctaggaactccgctctttaccagtacagtggaacaggcccgttattcaaggtgatgcctcacagctatagaacaactattcaaagacccagagttaaatggtacatgtgtatatgtgtgtgtgtgtgtgcacacgcacacacttcagataagtatcagaaaaaataaaaatgaatccatcattaacttgaaagaaataagatggctgcattgcaacagatacaaatattatgaacatcatttaattacagaaaatctagacaacagtttctcctgatgtttgacattctcaaaatatattcctcattctcgaagaagcagagaatgccaaggctgcatatctgctgtaatctacctagccctcttctgcttaatatgatccattattgaatcttctcagattaaaatccattcctatatcatctacctttcccaaagtgtgtgcctgtaaacctaccttggaagtggcaagttaactgatttttttgtgtcatttttataccaatccttaaggtcaaagccttttgctatcaatgtatttaaactgagttgctatatgttcactaatttgttttcaaaatgttttgctccaacttaaattatcttttaacatcttttgagtgccaagaattgctaagtaactgtaatatgttgaagagagtaattgccaagcaagcagtcataagccaaaatgtaatgagcttagtatataaccactttagagtatacactcaccactttttgtattcattcatgcaaaccctcctggaagtcgattagaagaggatccaatttgtggaccttttttcctccttttggacacctgagcacaattttttttttcctttcatatttataccactttggaaaattcagtaaacccaattctggcacatcataatggtttcagttagtgaagatgtttattttaataactttaaaatatgactatcctatacataagttatataagagggcataacaatagatgagtagaaatttataaaatttcttggatattttgaatgagaaaaaaacatttttaaaggaattttgttttttccttttttggccaaaccggtacaagttagaaagtgtgctaaggactgaatacttgcctcgtgctttttgccactggatgatgtaagttaagaatggaattgttaatcctaagtatatattttcttgactttcatcagtttctaaagaaatctaatttaagtgttttgcggttttgtttgatctgtatttattgagttctggtcatagaccagcagcttgcacgtcatgctcatgaacagccagaacatagttattggggaacttcatggctcaaaaccttctgaatcatttaacttattttgtatgttgcaaaaaaaaaaaaaaagtttattttgcttgagagtcacctttttttaaaaaaaataactgtacagcttttaaggga

SEQ ID NO: 66482 - DNA, 2519 bp, Homo sapiens
agagagaaatcaggccaattattgaaaggaaacatttaggtacaagcaattctgaaagcaggacgtggggtgaatatcgggaggaaaaggagaattaaattcgtttatggttaaccgtgccaatggcttaaatgtgctgtttattctagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaa

SEQ ID NO: 66483 - DNA, 1063 bp, Homo sapiens
actctgtctcaaaaacaaacaaactaaaaaggataaaacattttctaatcttgaggattcaccgctaagagtatatattgtgaggtttggcattaaaaacctgcacagattgagtcattttttttttttttaagggagacttaaaggccaggcatgtggtaatctcaacactttggtaggtagccaggagtggtagtgcatatgcctgtgatcctagctttagctactggggcagctgaggccaaaggatctcttgagcccaggaggttgaggctgtagtgagtcatgttcatgccactgcactccagcctgtgtgatagtgagatactctctcaaataaaatgagactcataaaagttactgttcacttaaaaatatttatgactgaactctgcttggtagcttttcatttttataacctaagctacatttctaaatagacttaaattttgtactttgttcttcctttttttaaaatagaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaaggtaaggcataggtctcctatatatagaagtttggacagggcaaaatagacattataaagtgaactcaggattgtgattctgtaccattctttgaaactcatataaccaggccaggcatggtggctcacgcctgtaatcccggcagtttgggaggccagggcatgcagatcacttgaggccaggagttcaagaccagcctgtccaacatggtgagaccttgtctctactaaaaataaaaaaattagcctgtgtggtgatacgcgcctgtaatcttagctactcaggaggttgaggcaggagaattgcttgaacctgggaggcggagattgcagtgagccaaggttgtgccactgcactccaccctgggtgacagagcaagactgtgtctcaaaaa

SEQ ID NO: 66484 - DNA, 2578 bp, Homo sapiens
tatactaaaaatgtctgaattgtacactttaagagggtgaatattgcggtgtgtgaattatataaaaatttaaaaaacgaggttccctacatagtaaacttctcttcagtagggtaaacgaatgctaaaactctgagacctctgtcagctgaagtcataagaaaactgcatatttgttggaagaaaataaagaaatgaagagctgctaagcatgaataaggactgtctctagaaattaaagggaagcttttaataaacacatatttttctctccccgaacttccctcccccaaattcaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatgggtgtgtggtctcctactaggccccgatccctagataccagcaggaacaggactgggctagcagagaggcttgcccatgctgtgatgagggttttcttcttcatgtacatagacaacctctgtttattttcaggatatttaaagcagattcaagaatactaattttggcccatttttaaagtttagaacagaaaatagatttatggttgtttaacattcaaaattgtatttaaattttactaactacaattaaactttcatttgttgagagctttctctgtacctctgtgccaccttctgccaggtccatgaggggtttccagtcctatgtgaaaaataaataagatattatcctctcatgactcatagaagttggacttgggactggtaatccagtatagaagatcaagaaaggcttctttgcagagttggaattgaaacaatactgcagagtttctcctttcagattattagaagaggaaacaagtatataaaccacaaaaaaaaaaaaaagtcattctgcataactgctactaaaatacagggaaagataaattaggctacagaggaaagttggcttaatccaaagagtaaaccttaaagtagaagtaaagcttgatctgaaatttgaagaatgagtatttggaatcaacaagtatgagactaaaagcaggataagaaaaaggtattctaagcatagaagtcacatgtccaagacagcaagccgtaaaatgtcatagaatgtttgggaaactcctgttggctctggatagcaggaataaggggatgaagtagagagtgccctactggagatgtggtcaagtgataaaaagagccagattagggagtgttttatttgtcatgcataagtgttttgactttatcctgaaaattatacaaaaccagtgaagggttttaaacactaaattaatatgagatttatgcttcagaaagattcatcctggcattcatttggaggatagattgaggggaaatgagaccagatattagagaaactatttgtggagttgcttttgtagttaaggtgagtatgaaaagctgaaaacagaagagatcaggtttgagagattatcttttaagaggtagactctagagaaattattaatttattggatatgagaaatgaaaaggggaaagttaggataaataccacgtttctggttggagttaccggatgagtgatggtgccaaataccaggccagggaacagaagagagaagtagattgggaaataatgaattcacttttgaatatgtcgaatttaacatgggggacatcccaagaggtcaaagcagtacagaaatcaacattaattcatctttacaacccctcctaagaggataggtggcaaaacattttccccattttataaatagggcatttgatacaattatccagatatgttgcactatacttaatgattcactgggctcaccagaatttgaactcagaactcttaaaaatgggttcactcttctaaataccattgtattttatctgatttctcttggacagatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctggtaaaaataatctgtaaccatatggtagctcaataaattattttttgtttttcttgttgctcatgctggagtgcaatggcaccatctcggctcactgcaacctctgtgtcccgggttcaagcgattctcctacctcagcctcccaagtagctgggattacaggcatgtgccaccatgcctggctaattttgtatttttagtagagagggagtttctccatgttggccaggctggtctcaaactcccgacctcaggtgatctgcccacctcagcctcccaaagtgctgggattacaggcgtgagccagcacgctgg

SEQ ID NO: 66485 - DNA, 1747 bp, Homo sapiens
ggaggctgaggcaggagaatggcgtgaacccaggaggcggagcttgcagtgagccgagatcccgccactgcactccagcctgggcaacagagcgagactccgtctcaaaaaaaaaaaaaaaaaaaaaaaaaaaaatttaaaagtagtaataattattttttttaaatgatgaaagtttggccaagcgtggtggcttatgcctataatcccagcactttgggaggccaaggcaggcagatcacttgaggccaggaattcaagaccagtctgaccaacatgacgatatcccatctctactaaaagtacaaaaattagacaggcatggtggcacacgcctgtaatccctgctacttagaaaactgaggcaccagaatcgcttgaacctgggagacagaggttgcggtaagccaagattgtgccactgcacgccagcctgggtgacagagtgagatctgtctcaaaaaataaaataaaataaaatgatgagctttatgcattcttcagtgaaatggacttctgtggcttagcacagctttattatcaagtacatttttcagctctgttttgactcagtaactgtgtagcattgtttgtatacttttttacagtctttttttttaaggatagtcaagtgaagccctgggagtggagaaagaacaaaaaaatctgtaactggttgggatcaattagttgtaaataccacagcactcacaccagcccagtcaccttttttaaaaaatagtttttggcatcattatgttatatcgtacgtataaccttctccctttaaaacatcttgggatcttttttaaaaagtataatcactgttacatacacatgttgaaccaaatgctgttttaaacattgactattgccagtaggataggcacagaatccgtttcttttggcaaagctgtatgtttctttaacgtgtgctttatttcaaaggtactgtgctcatcttctgttcaaaaggtgtgtttaattaaacacaagaaaagcttcattgttcacttactatgtggtcccttaccagctctcagagcccactacccatgaagttaacatgtatgtaataaatgattgctaaaagttgtttaaaatgacttttatctattttgcttcttcagaaactgctctgtgaaaaattagaggaacagttgcaggatttggatgttgccttaaagaagaaagagcgtgccgaacgaaggtatttttatatgtgtgttaatgttttgtttgggaatatgagagcagaattgtctcactgtatggataaatggatccatctaaaacaaggattggcatactgtggcctgtgggccaaatccagcctcctttttgtttttgtactgcctgctaactaagaatgttttttatgtttttaaatgattggggggaaaaactagaatcatatttcatgacacatgaaaattatatgatactcaaattttattgtctgtgaataaagttttattgaacgcaaccttgctcatttgtttgtatattgtctgtggctacttttgccctgtgacagcagcattgagtagttggaacagagaccttatgacctgccaagattgcatgcttattatctttccttttataggaaatgtttgccaactttctatctgaagtatttatcagaagtagctgggcatggtggctcccgcctgtaatcccagcactttgagaggccgaggcaggcagatcacctgaggtcagcctggccaacatggtgaaaccc

SEQ ID NO: 66486 - DNA, 1146 bp, Homo sapiens
tcatcattctcttacaaagcatttaaaatgtgcatgacctttgacccagaatcctcttcaaggaatttatcctaaccacagagatgtgtgtaaaaatatttgtaaagatacagtacattgttgacgaaagtgaaaaacatgggaaacaactacctaaatgtctagtagaggattagataaaaacagttatgtaatggcatttatagtaatgttaggagaatgtgactaggaaaaatataagaccaaatgttcattataattcggttttaagaaaaaagtaaacaaaaatgtagaaaaaatagtggaaatatataccaaaatttaaccatagctatatctgatgatgagactataataattttctcctctttttttggtatattggctgaatattattatacaatggacatgtaatcaggagatttttaaaagacattcttatatcaaattatcccaattttttttattttatacaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctagtatgtacctgatgtaaatgaagaatactcatattacagacatggtgaggttgcctggagcagcctaactcttctgggttttatcattatttgaatttcttaatgataacttgtatgctacagagtaacctttatttctgtttctcatataacctaattgtaggaaggccagtgatcaagatcctactttcattctacttggcttgtatattgatatttcctctacataataatacacctcaatctcttctcacagattgaggaatgtattcaagtatttttagtctgttctttttaagtttttcttctttccctttaaattacttaataatggcatttctgcctggcatggtggccacatgccagtagttccagctactcaggtggctgaggtaggaggatttgagcccagtaattcaaatgcagcctgggcagcatagcaagaccctgtctcatggatgg

SEQ ID NO: 66487 - DNA, 1532 bp, Homo sapiens
aggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacttgtcttaactttaattaaaaatatttgtctctatatattaataggttttttggttttgtctaaaacttagtcatcaaagacaactgacaaagtatctttcttcctctgtctgagataccttttcagactttatactcttacttatactctatactcttgtcatcttttaacttttttaagaaattaaaagtagtataggaatatattctccttgtaaactattcaaataatatccaacctgtagaattatagaatgagaattccccattgccactattaacagtttggggataattgccactattaacagtgtggggtatagtatctttgcagtcttttttttttttttttttttttttttttgtgagacagtcttgctctgtcgccaggctggagtgcaatggcactatctcggctc

SEQ ID NO: 66488 - DNA, 1047 bp, Homo sapiens
tgcctctgggtaataggatatgggctttttgtctttctatatttttcattttcccactgccgtgttcctggtacctcagtgaaatgaagtgctcagttcttttaacagttgtcagtttttaaaacaaatatagtcttctggaaatgttttaggtagcattttcaattttatgtttttaagccatctcttgaatttgaataaattatttgaactgcataaatatttgcaatccattgagaacaccaaaacaaaaagtaaaaagcagaaacctaaatttttctaaattttttttaatatctagaagttgtatctcaaagtttttgtaattttcttcattgtcagattttattttttactgtcaaatatccaatgacagaggccacctcttttaaaatagaaactttaaatggaaatatacattatactaagtcttatattttatagccttgaaagtttctattcatgtaattaagctttttctgatttttagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctaca

SEQ ID NO: 66489 - DNA, 1093 bp, Homo sapiens
ctgccatatctagaagctttgaacattgtgactaaataaaaactttgctggttggttaaattaaaaatctcactgctttttgaattttaatttctttgattactagtggagtttgaacatttcagcctctgcattgttggttgacatccatggctaattttgttttcggatctttagttttagcttatattttaaatggtcttttaagtaaatgcatttattaatccttcttcaatgcagtataccttagcatctgttaaatgtatcatgtccttgcccaaatctcactttgtaggttggtgaaatatgcttcatagaatttttaattaaatattgctttacagtctacataagacttcctgttagtaaaagctacctcatgaaaagtattgatgttatttgccaacatttagactagcttttgttaccgtttcagttattcaatttagtcagcacatgtttgagtgtcttactgcaggtgaataatccatgatttctgccccagagtagttcataagactggtaggatacatagatttgtaaataaataattataattctgggcagtaagtgctgctatagaagtctctataaagcaatgtgcaaacacaagaaaaggagccgttaattccttatagggaaaggatcagataaaattataaaatggagtgatattgtaactgggcttgaggaaggtaagatcttgcctataatataataatattggcaaacattgagtgcttgcctggtattactcttctgaaggccttatatgtagtattgtatgcaatcattggcaacccaggagattgtgcctgttattttagttgttttacaaattaggaaagtgggtggagggtgggaggagggtcaggatcaaaaaactacatatcagatactatgtttattattgcctggatgacaaaataatctgtatgtcaaaccctcatgatacgcaatttacctgtataacaaacctgcgtacgtacccttgaacctaaagtaaaagttaaaaaaaaaaaattaggaaagtgaggaatcttaaaaggtacaaaatagcaattgcttactaggcagagttaacagagtaaaa

SEQ ID NO: 66490 - DNA, 1045 bp, Homo sapiens
ctcgccctccaaagtgctgggattacaggtgtgagccaccacgcccagccatttgtggccactttcaagtagagtaatctttacaaagtttatccgtgtaatataaatcagaactttattcctttttatggctgagtagtatttccatatgtagatatactagattttgtttattcattctatacttgtctttgagagagtaattggaattagccatggggaacacattccaggctaagagagcagaagtgcagtcagtcacccgatatcctaagaaagcctggtattttggagggatatatctgatttaacatacctgaaagaagaaatggtttggagaacagagaacaagtgagggaggggtagcaaaacaactggattgttgttagggtccatagtctaaaatattctgtacatagtgttaagaaatttggatgtgatttgagggaattcataaaaatttcctctgactaactcagatttaggattttttaaattgttcaaaaataggaaaaacccaaagatgggtagttttgttttcatataataacgactaccttaggcttgtgtttaaacacattaaacagattaaaagccttttagggagttgttctttaataaattttaatgctaaattccctttttgcttaaagtagtggaagtaggctgggtgcagtggctcacgcttgtaatcccaacagtttgggaggccaaggcaggcagatcacttgaggtcaggagttcgagactagcctgaccaacatggtgaaacctcatctctactaaaattacaaaagaaattagccaggcgtggtgatgggtgcctgtaatcccagctactcgggagtctgaggcaggaaaatcgcttgaacccaggaggaggaggttgcagtgagccaagatcctgccattgcactccagcctgggtgacaagagtgaaactccatctcaaaaaaaaaaaaaaaaaaaagtagtggaagtaattgaaatagattttcctagcaatattagctctcttacgttttgaagctttttaaaattgtta

SEQ ID NO: 66491 - DNA, 1985 bp, Homo sapiens
gtgaagtggagttttgtaagaggcagtaatctttttagcaagagatttctttagaaaatcaagtgatggccgggtgcggcggctcacacctgtaatcccagcactttgggaggccaaggcgggcggatcatgaggtcaagatatcgagaccatcctggccaacatggtgaaactccgtctctactaaaaatacaaaaattagctggcattgtggcgtgtgcctgtagtcccagctactcggaaggctgaggcaggggaatcacttgaacccagtaggcagaggttgcagtgagccaagattgcgccactgcactccagcctggcgacaacagagcggcctccatctcaaaaaagaagaaaaaagaaaattaagtgataagggaagaacaagtaaagcaaatgagattttgactttgactttttcatttaataggttgcatttaggtgcttttcttagctagtaagtattattttttactagtaaattaaaagcttcttgttttttcttaaaacaatttctttaaagtaacagtattattttcttggtgatcggctggtgttggaaacgtgtttctacctaattcttaaaagaggattatataacaaaagttatctagtctttagggttccgttttctaaagctaataagtcagccttcttaatgattgataaatttagaaatataactgaactttgcaaattaaacatcaaatggaatttttaaaaaatgagaatccaccaaaaagggataattttacatagttgatctactgaaaatttcataccatgacatcaccacagtcttaaaacttgtactgttacgtagcaacttccatttctgcaagttgcaaaattaataatataaatatagagacgttctttgccgagagtcgtcggggtttcctgcttcaacagtgcttggacggaacccggtgctcgtcccccaccccagccggccgcccatagccagccctccctcacctcttcacggcaccctcagaccgccccaaggcccctgccgccgccccagcgccacgcagccactgccaccgccgccacctctccttagtcgccgccatgaggaccacgtccacctcacaggtgcgccagaactaccaccaggactcagaggccgccatcaaccgccagatcaacctagagctctgtgcctcctacgtttacctgtccatgtcttactgctttgaccgtgatgatgtggctttgaagaactttgccaaatactttcttcaccaatctcatgaggagagggagcatgctgagaaactgatgaagctgcagaaccaacgaggtggccgaatcttccttcaggatatcaaaaaaccagactgtgatgactgggagagcgggctgaatgtgatggagtgtgcattacatttggaaaaaaatgtgaatcagtcactactggaactgcacaaattggccactgacaaaaatgacccccatttgtgtgacttcattgagacacattacctgaatgagcaggtgaaagccatcaaagaattggatgaccatgtgaccaacttgcacaagatgggagcactcgaatctggcttggcagaatatctctttgacaagcacaccctgggagacagtgataatgaaagctaagcctcggctaatttccccgtagccgtggggtgacttccctggtcaccaaggcagtgcatgcatgttggggtttcctttaccttttctataagttgtaccaaaacatccacctaagttctttgatttgtgccattccttcagatgaagaaatttggtacccccccccaaaaaaagtaataataataatataaatatatgtattagatgaatagataggaagcaattaacttatatataattatactttaagttgaaacaagatttagtatgtgatttacaaaacaatagaagtagttaagtttcattaaaccatatgaaattgttaacatttgaacattttgacctataaaaatggt

SEQ ID NO: 66492 - DNA, 1083 bp, Homo sapiens
ttctgcttccccataatttgaatccagtgatcctggctcagcctttgagatattcttctacaaatcaatcctttaaatgtttgaagacatttatgtctgagtaaatttctgctagataaagcattttcagtattcaatcatcttctttgtggttgttcccataatggactttactatattaatgtttctttcagagtctgccattcaaacagaaataccatgctccaggtatgatctcatccaagtcaaatgagatgatgccccacattattttaggcactaaatatatattagtgacaactaagatcttatctttatgaggaggcaaaaattattacaatgttttctacattcaacctttgcaacaatgagagacctatgtggacaagacagtttactatatttgtcagtaagagttccactgtgttgggttaaagctaattggaatgtcatgtcatagaacatctcacttataatatgcataaacacacccaactgaaaatttgacataaattaccatccgtccccagaaaatacgcatataatattcacctaaaatctattctttacaagttgaggcctttcacaggtgcctgcagcccctcttagagatcttagagccatactattcactattacatcaccaattgtttagcatagtacctattacacaaggatgtatgtaatagaatttataaatttaatgaaataaaggaatgttagtatgacaatcagctgtttaaaaattgaatttcattacacaaaatcagagagtcaataaaccaaatgatttctgaatgctcccaaatatttctgcgttatttgggcaatgttccctggctcattgtaaatagaaacatatgtattcacagatgtcatcaaaatggctaaaaataacctggcaccattttctaaagaaatttgtggttgtgaaaatgagaaaactatgcgatgggtatggtggttcacacctgtaatcccagcactttgggaggccacagcaagtgaatagcttgtgctcgggagttcgataccagcatggtcaacatggcaaaactctgtctctactaaaagtacaaaaat

SEQ ID NO: 66493 - DNA, 1110 bp, Homo sapiens
gcattcaaatttttccgtatcgtcaaccaacatttattattatctttctcattgtggtaaaatgtctattcagattctgacattttagcttttgatataatcactttagggtcttcctcatgtaatatttatatttttccctttttctgtatatccttttttttctctctgaaaaacgtaacactgtcagccagaggaagtaatatattctagggaatgggaaactcatgcttcctgtgagtctttaaactgtccattgtccatcttggcaacatgaagaaaccccgtctctacaaaaagtacaaaaatcagccaggtgtggtggcacacggctatagccccagcttctcgggtggctgaggtgggaggatcacctgagcccagggggtcaaggttgcagtgagctgtgatcgtgtccctgtactctaccctgggtaacagagtgagacctatctccaaaaaaaaaaaaagaaaaaaaaaaaagatcctctattatattgttcctggccatactgcttgttttgtattctttttctatattaatactaatctattattttattgcacaaatcgatgaaaagagatgacactatgacactagtgcaggctaggaaaagggtaacccacctgagagagctggcttgtttttctcctgtctaccccattccctgtactccaggttaatctcttgccttgtgttggttcttctcctttggccctcgttatgctctttgctccttgaattgcaagaaatacgtgaaattgctggcattttgtatcattttttgcctactctttggcctttaagataatattattaatgttccagttttattgctgaaaaaactagctcacagaggtcatagaacccatttgcatttcactgtgttaacctcccttactggcttcctctgacctctagtttagggtgatgctgctgaaatgagagaaagtttcttgcactggctttgaaatgcagtggttattcagatcttctttctttggtctgttacagtggctctggtttgcctgaaatgcttgtgtagaaagagaagcctagacatttatcttaaagccaagttacataagttttcatatgccaagaatgga

SEQ ID NO: 66494 - DNA, 1035 bp, Homo sapiens
aatctttttttttttttttttaaagacagtctcactctgtcacccaggctagagtgcagtggtgctgtctcggctcactgcaacgtccacctcctgggttcaagcaattctcttgcttcagcctcctgagtagctgggactacaggtgcgtgccaccatgcctggctaattttttttgtattattagtagagacagggtttcaccatattggccaggctagtctcgaactcctgacctcgtgatccgcccacctcggcctcccaaagtgctgggattacaggcgtgagccaccgtgcccggcggcttcttttaatcttttatgcatcagtattagatggatcaattaatcactgagacaattttagttttctttcccttgactgccagtaagcttaactttgttatatttatttattagttataatcattagctagttttctgatggaatttttaccttccctgttacatggctcttacagtgctctcgtctttctccttgtggcatcattgtacatatgtattactgaaagctgtttcttttccttttgaagtaaatggaatataattaatataaaattctgtttaaatccagagcaagtatctggcatctgctaggccttgttgctttgctcatagcagacattaccaacctaagccttcctgctaagcctagacttagcagactacattattacacaaatcagtcagcattggcatctatttgtcatctattgttagtaattccctaagacagctgaactaagacctatagaatgagcagaaattttgttaggaaataaccagtagcttagccctactgtaatagaaagtaccttgagaaaatgacagtgagtggaggcctaacagtcatgtgttcaggaggttactgtgataatccaactgagcaataaggagacctgaattaaggttttggcactagggatggaaaggagggggtggatgtaagagctatttggaaggtaaaatcaacaactattgataattgatagtgagagagaaagagagagaggtg

SEQ ID NO: 66495 - DNA, 1044 bp, Homo sapiens
tccagtctgggtgacagaacgagactctgtctcaaaaaaaaaaaaaaaaaaagctgataatatgttgatataattttggatgaagggcattaaataaaatatattattaaaattaattttaacctctttttactttttataatattttactagaaaatttgaaattatgtgactcaccttacatttctattgcacagtgctgactgtagaagagccagtactcttttaaatcaagtaatacataatctatttgtacatgcctaaatcaacaatgagtagatttgtaaagtgggatgaaaacatttattcacttttatttttgtcttgtattggcttttaaaaaatagtaccagttgtatcaaaatctttcatgattctgtgtagcatagaacactggtggggaacatgagtaaaacactggtgcaaaggttttagccaactgcttaatgagtgatacagacagtatgaatacagtgggtgttccagggacaaaaaggttgctggtactagaaatctatcacggagactttcgggacttgtattgcctagacattgaaagataaatatgattcaagtgggcagaaaacaataaataactctttaataaagcccacataggtaatgggctgagcatgcttagtggaccattaactggcaaaatgattcgaatcaaggatttcagtgcaggaagtaagagagaagaattgcagagttagtatgagactgaatgttgggactctgaggctagggtaagaaatctggctgggtttatgtaggtatttaggagccataaaaaatacttaccaactgggaagtgatatgaaagcagtctttttggaagattggtttgattgcaggagactatccatagctgtttttctgatgcgagaaggtatagtcatgtcctagggaaaggaggaaataggaggcaggtttaagatgtgggaagggggaacatcaatacttctgtgtttgtggaaaaggagaaattgaagaaagtgaccttggttttaaaacagaagagaaataaaagtattttatatt

SEQ ID NO: 66496 - DNA, 1027 bp, Homo sapiens
ggtagtgagggtaagagttgttgtaacattgctgctatactggcctcaaagtcttatccaagtggactgattaggggagggtaaggttggatgaatggtgatgccgtgtactcagatgggaaaggatgtagttattaaaggtagaacttaaaagatttacttaggttacttagaggacacaggactgggaaagaatgtactagataatagcttactagtaagtgggattaaatgccttggtcatcagtgtattttgcagcaaaagtgcagtactggttatgaagcttaggcatgtgttatgctagatatctcagggagtttgatacttactcttttccttttgtccttagcatcttcacagttggctctgcaaataaatataattgccacttcttcaatgtttagatgttaaaagtgttttaggaaaagaaaattaggtagaatgagttattccaaataatccattctaacttgcttttggtatttggagtttggggatatagcaatatggtaatattggaaaactttgattaatcagaagtataatggagcttactttatattcccattaaagtcttgccaacctccagtttatcagaaccataaataaaccatctacagcagcactaacttggtctggcatctgaattcagacattccataatcctcattttagaggttttttgtcctatgaattttgactgtggtcaactggtttctccttgctatctttttgcctcatggccttttcattttataccctatcttctattattacctagttgtattcaccatgataactatatctcactcctttagtgtcctattttcctgtattttggacttcccctttaaaccttaattatcttctccattcttatctttcgtagaaaaatagattacaaaaatgcaaaaataaggggctttgtagtatgcatgctttaccataattttataggttaaatgcctgtagtagtactgttgtaattatcagagcttactgttgagccagactccatgataaagt

SEQ ID NO: 66497 - DNA, 1031 bp, Homo sapiens
gatttctaaagaggctttttaaaaggaaaattgaatttctgcttgtatttatgtactcttatttttatagacagggtctcactctgtcacccaggctggagtgcagtggcttgttctctgctgactgcaacctctacctcccagactcaggcgatcctcccatttcagcctctcaagttgctggggactacaggcatgtgccaccacacccagctaaaaattttttgtatttttagtagagacagagtttcattatgttgcccaggctggtctcaaactcctgggctcaagcaatccacctgactcagcctccccaagtgctgggattacaggcgtgagccaccaagctcagcctatttatttattcttaatcttgaattacctcttaaatgaatgttactatcatctacccaagtcactcagatcagaaaccaaggaggcatcctagaccttagcctctgacactttctttgataccaagttatattgagtctgtttatccccttttatattcaaccttgcttttctgttctcattgctagttttaatcacgccaaactgcttttacatctctgaagatgtgaaaggttgttttacatttatgctttttcttcgtcctcctgcctctgagtcgaatataccatccccatcttccttcccttgcctgctcactgtacccgtcattagtctgctctttaagcatcaaatgctctgtggaaaatttccttctttctgtctctcaagttaaattaaccacttcaatctccttaccctgcacgtacactttgtagattttatgccacagtactcataacactttttgcagttactgcctagcctacaagatggtaaactctttgaggacagggtttcttactttattttatcaccagcaattggtgggtaatagcaaatatgtagtaaatgtttgtggaattaatagttttcctcaacttactataggaccatgttctgctctaaaactttgaagttaaagcctagtctgtgatagcttagtacagtggtgggca

SEQ ID NO: 66498 - DNA, 1021 bp, Homo sapiens
tttagtcctcccaattctgtgctttgtgtggacttccccaggtttctcctaactggaggtagatgatggtggttatggataaagttgacgttgactttgtgagatccctgacacccaaggctcctaagtatctttcctctcctgcagagaatatttcttttcaagaggaaactatactactgtattctttaaaaacagtctggatattggttgagatgttacatatatctaataaatttattaaggtaaatacagataatgtgttaggattctcatagtttatactatggttggctgaattagttgtatgatattaagtaagttgagccattagttttttgtttcatttttgcatttaatgatttgaattttaactcgaagtgaaaatatcaaagttaaaaaaatgcctttttaactggaattgtaactataacttactatggtctctcttactggtactgtaactgatctgtgtgtaacaatatatttttaggtgcatttgataaagtggaaaggtgattactgtaactggggccacatgtgttgatttaaacaaaagattttaccaggtgcatgtactagaggttgcatgagtctacagtggtagacactggtagggcatacatacattaatagtagtattgctggggccagagcctggttaggttgaaactttttagttgtgtctcttctgcctttgaaaaagcaaatattctttagggcacttattagatgaaaagagagaaacagatttcatctccaccattttcgatatgtcatagagtaaagttacggaggtttggagggaggttgttgtcattgtcctaggaactaggaggtaatggagacagagggacttgtctggctaacatgagcctgttaatgcaaactggcttactttttagtcttttaatgattaagaagtttgccttaaatttagatgttttgttaagttcttaaacagacctcaccggtaagaaggtaagcaagcatttattagtgaggttattcacttaatata

SEQ ID NO: 66499 - DNA, 1055 bp, Homo sapiens
gctgcatgaccctcatgttgtcatgtgagtgtgtgcttatcacatggctggtacttgatgatgaggctgcacttagatctcatgctgaaatctgaggtgcactggattgctctggccttgggctgactgcaaacctttcccttcctggaggacagcaatccagtctctactctgacccatagagagaagcttggatgtaaccaggaagaggtctggggaggcactgagaagtcctggagtctctgcccttgttaatttagatccatctagccttcattcctaccctctgaacttcttagccttgggatcatcttcaacttacactttttgctctggttgcaccaaattaaggagacatcccaagctcactccattcctggcctttgcacttgcccttacatttttctgaaattctctccctcttctttatagaagcttgtggttaatagaatgagtaactgcttcagtttatgaactgggctcaaattcttacccaggtgtgcatctggggagtctctgagaacctatctgattcttgggatttttgccaagattgtgacagtctttctttcataatgtagcaggataagaactcttggggttaactgtttggcatagaatggatattctattccaaagccttcctgcgctcctcctcagtacttcttgcaggcttggttagagcgtgtgttgtactccattgcaactatctgtttcctcaaccaaacagcaggcaacttgaggggagttcttaattattcttgctaggacctgccacatagagacactagatgattatatcgtaagataatgtaatgaaagaatgagatgttttcagacattttaggtccctgagacatgttcctgttcattggccagaaactttttggcgaaccacttcctattcaaaggcttcctctccactaataaagtagtctgtggtacatgcagccctgaggcttgagatggaactgcgcaggaagagcccaactgggtatcagaataagccacatgcaccttctgaaactgcccaaatccacacctgcataagaatt

SEQ ID NO: 66500 - DNA, 1274 bp, Homo sapiens
tgaaagagggagaaatctaggaaagctgcttgatttctagttgaatatgttgataaagtggttggggcttacaacataatgagcataggggaaaagaaaaaagaaccacagttaaggaagaagtatctaggtggcttgggttagtccagtagctctgggaacaaggagtgcctagagcccggaagctggcttgcctgcgcattctggtgaagctttcgtggttcctgtcctctgcttccagaagcactgatctgggacacagagcctttgggccaagaattggatcaaatgggtgggaattcatttagcccaaaccattggtctcatctttctccataatagatacagcttattgggttaaaagaataagatcaattgagaagtcatgttcatgggagactttcaaaggaaaacaaaaatgtaaatcccaaatgataggccagtctttgtgacctcggtattctgttccctcctgatttgtctgcgtaggccttgcaggaaaagttgtggaatgtagctgcccctttgtatttgaagcagagtgatttggcctcagcagcagcgaaacaggtaagcttattcagaccttcccttcaaataggtctctgtccagtaattgtctggtccaagacagagccagaggccttcctatagctctgtctgtgtaggccttgcaggaaaagttgtggcatgtagctgcccctttgtatttgaagcagagtgatttggcctcagcagcagcaacacaggtaagcttattcagaccttcccttcaaataggtctctgtccaggaattgtctggtccaaggcggagccagaggccttcctgtagctctatacctctgctgtggcctccctaatttcaggctatgacagaagttagtgatatgagaaggagcataactaggagacacagcactcactttggactcaggggacctgggtcctagtcccaggtcttcctctgatttgctgagtgatattgagcaagttacttaaattccctggattttttctcttctataaaatgtggcagttgggccgggcgcggtggctcacacctgtaatcccagcactttgggaggctgagatgggcacatcacttaaggttaggagtttgagaccggcctggccaacatggtgaaacgctgtctctactatcatgaatctttcatctgaaaatgtagcccaactcagttaaggttgtttatatctttagcctgtaccatctcttcaacgttaaaaggtcctgggtagttcattaagtaggctt

SEQ ID NO: 66501 - DNA, 1122 bp, Homo sapiens
agccgtatctagttttaaattagttttggtctcatctgtgtttgatgtaattaataaataaatgaaaagagtttaatagcaaataaataaatgagatgcaatatgatatggttaaaaaaatacttttggagtcagagctgactctgtctagttcatgtcctgttttgttgtttattctgtgaccttaggcaagccacttaaattttgatctttagtttcctgttcagtgaaataggattaattgcaattcatattgtgaggattaagtgagctcaagtaaggaaacagccagcacagtacagtgcacatagaatgtgctcagtttacctttctcattagagcccatagtctcctgatggatgtctagactgaggcttcctgagaattgtgagcataaagagataaagagaggtaacactgggacacaggatttttcccagagctaacaagtttccatttttgtttgtacagaagttcagatttcttatggctaattgtgttggattgggttacatcttgttttgtgcacttcagaacaactgctacaattccggggcaggggaataaagtaacatttggaatcagttagttaatgtacagtcagttggtctgtattctgtataattgtcatagaaggcagaatcttcctggagaggaaacacaaatgcttctgaagtagaatacttcagggctgtctcttgcaagagaaaaatcagagaagcgaaaggaagagaccatctggccaccaaactcacacttcacagttgggcttagctagtctatggtcttggctttcattgtgctgggttcccacactttgggtaggccctccaggaccagttcaagcaacccaaacgaataagaagtgatatatatcatacattaattcttcaatcactttgagagtaatttactctttgcccctttgtaggcatctccttcttgatgtcaaagtccccaggaggcatcgttaactatcgtaacgttacctgccgagcatgagatgggaggaagtgtcatagtccagtggacggttttttccaggctactgtgaaacctgatgtgttatgccggccctgaaacagacagcttcccaagtgactcagaccttaaggtttccca

SEQ ID NO: 66502 - DNA, 2370 bp, Homo sapiens
gctccattgtctagaactggcttacttgcccaccagcaaaccagtcactggaaaatgggaatgggattgccatgatgggtttagaccaatagtggttcagctcttgggctggacctgccttttccgagcactttgctgcctgcctgatacctgagtaaaatcagggctctctcaggaagaaagatgggggaaatggctcttggttaaataaccagttcttttatctttataataaccagtttttttagatgaattaaccgagttccagaataactgggtgacttatctgaagtcatagagttagcaaaagtatatggttgagaatttccaattccagttcaggttttctgattccagttcctagtacttttcaaaggactaactttactaatttgttgatgtgcattcttatttgtttgtttcaggtgcttgaagtttctgggaagtcggcatccaaccctggtgcttcccttggtgccagagcttctgagcacccacccattttttgacacagctgaaccagacatggatgatccagcttgtatcctctgtgcttaggatgggccctgatgtgttggcaggcagctttggcatctccttctgcagtatagctagggtagtctgaattttcttttctttgcttttctttcttttttttttttttttttgaagacagagtctcattctgtcacccaggctggagtgcagtggcctgatctcggctcactgaaacctctgcctcccgggttcaaacaattctcctgcctcagtctcctgagtagctgggattataggcgcccgctaccacacccagctaatttttgtatttttagtagagatgaggtatcaccatgttggctaggctggtctcaaattcctaacctgttgcttgggctggagtgcagtggcaccaccccagctcactgcaacctccgcctcccggattcaaatgattctcctggctcagcctcccaagtagctgggattacaggtgcctgccaccactcccggctaatttttgtatttttagtagagacggggttttaccttgttgcccaggctggtctcaaactcctgacctcaagtgatccacccacctcagcctcccaaagtgttgggattacaggcgtgagccaccatgcctgtccagtatgtactttgataggcaatatagttgcttactttataggcaaaatcatttccattttttgtattcttggcagtctctggcatttttaaaaacctttggtaattgggggtgtgggtggagtaggggaatgtattttgttgtttgtatttgcatttctttgattattagaaaatcatagtctcttgatggagattttggaggtggaaagtgagagtgccagaatctggccaaccttttatacttccaagtttacttaacccagtcatctatcagatattgcagttttggtacttattttcaatgctgctaaaacctgtccaacaatgccagcattgttctcagatcacaccttcaggcactatgcctacctccgagacagtctttctcatcttgttcctgccttgagggtatgttgaaaacatctgttgtccttgtttttattttgcatggggtagggttatttttgttcatgttttcctttgagatgggggtcttgttatgttgcccagggcggtctcaaactcctgggcttaagccatcctcctggctcagcctcccaagtcactgggattacaggtgagcaccactgtgtgcagcttgtttttggctttttattttttgtgctttgtggttattaaatagtagaaagcagtccatatattctctgaaaacttgtttgttcattctctttctctcttgggctctttgccattgttttatacttttgcttttgtatcctttaccttttaagatgattcattttttttggtgtccctgggttattgatattaggcaagaagaaaggaacctggaacaatagattatattttagatcaagaatttaaattgttatatatatatatttatttatttatttttattattattactttttgagacggagtcttgctctgtcgcccaggctgaagtgcagtggcacgatctcggctcactgcaagctccacctcccaggttcactccattctcctgcctcagcctcccgagtagctgggactacaggcgcctgccaccacgcccggctaattttttgtatttttagtagagacagggtttcaccgtgttagccaggatggtcttgatctcctgacctcgtgatctgcctgcctcggcctcccaaagtgctgggattacaggcatgagccaccacacccagcctaaattgttatattttaactattacatatagctatgattctcca

SEQ ID NO: 66503 - DNA, 1048 bp, Homo sapiens
cccagaaaacctcaaaagattaattttctatttgttaggaactacaaaggcccattctcattttgtgagatggtatgacattttaggactccttttcagcagcagttaccatggaagactgagtaaagcctttctccaaacagtaacaaaatacccccaaccccacgccattttttcttctttttttttgaaacagggtctcactctattgcccaggctgaaatgcagtggcacaatcattactcaatgcaactttgatctcttgggctcaagcattcctcccacctcaccctcctgagtagctgggactacaggcatacctcaccatgcccagctaatttttttttatctttagtagaaatgaggtcttgctgtgttcctcatgttggtcttgaactcctgagcccaggcaatcttcttgcctctgcctcccaaagtgctgggattacagatgtgagccattgtgcccggccccaaatgcctcttatgaaatgcccttaggctttgattgtgatggttcactaacgtggtttgcagaaccaaatttgagtctgagaaaataatatgtacattcattgttagtacctcaattttgaaattataaaagtggtattatagagttgtagaatttttgataagggaaaggaaaacaatttacccatatgcctgctaccctaatataatgactttggtgattttggtatatgtctctcagctctttttcttgtgcatggtttttttgtttgtttgtttgttttgttttttttttttgtttgagacagggtctcgctctgtcgcccaggctggagtgcagtggtgtgatcttggttcactgcaacctctgcctcccgggctcaagtgatcctctcacctcggcctcctgagtagctgggactacaggtgtgtaccaccacacccggctaattttttgtagttttttagagatggggtttaatgagaggctgatatataaaacggagtgccaggtcattcatttgtgatgagaaccataactgtcaagtggactggatacactaaccagtatatt

SEQ ID NO: 66504 - DNA, 1066 bp, Homo sapiens
ttcagatttttggaattgggatgttgaacctgtataatctttaaatcacctgttcagcaaatcgacaaacatcgaggacagtttctgtcttcaacgaagttgatagtcaggtagccagggatagctaatcagtgaataataatacctggtactggtaggaaagagcaccaaccacaaccacagaaggcttcttggaggagctgatctctgaactgagttttgaaggatgagtaactaggtagcgatgcagagaaagagaaaatatgagcagggatataaaagcagtacattatcatgcatagcaatatactaagctgcaatatcatactaaactacaagcagtttagtgctttctagttgcgggggtaatgttcaatataggggatctgtaacgaggtaagttggagaggaaaacagaagccaggttctgcagcaacttagctttgtagcctcgagtctatcttgcttaaaaagtgaatagtttccaatccctttggcttatagcagtatgaaaaattttctgatatgtgttacatcagaaaattcaaaaccatgtaaaagaggttagcttttacttatttataactgccctatttgtggggcaaagaaacttgaggtcccagtaaggagattcatgggactatttagaatacagtcactacttttataagccttaagaagtcattgaccttaaaaattacaacattttcagactgttaggttatagacttttatgcctgtaagtctgcccatgactggtctttcccagggtaaatgcagatattcctagttagtggcagttttatgtctgatgtacttatcacctagttgcatagacttatgttatttacaccagttgagcagtttttgttcttaaagcaggtgtgataattgttaaatatcttgtatctaaatttcacatacatttaataaggctctcaagtgaaatggttttctcagtgttaagtaaggttttcatagcattaactacctaaatttaggttgttaagtagtgctagtagtacagttggagagattccatcttaatctaaacatatttgtcttg

SEQ ID NO: 66505 - DNA, 1025 bp, Homo sapiens
ctcccaaagtgctggtattacaggcgtgagccactgagcccagtgctttttttatttttatttttttaagaaatgccataacaggccaggcgctttgtcacccaggctggagtgcaatggcgcaatatcagcttactgcaacctctgcctcccaggttccaatgattcgcctgcctcagcctcccaagtagctgagactacaggcacccgccaccacccccagccaaattttgtatttttagtagagacagggtttcaccatgttggccaggctggtctcgaactcctgacctcaggtgatccacctgtcttggcctcccaaagtgctgggattacaggtgtgagccactgcgtccagccaaaaatgtaactcttaatacacatggactaatttttgctttctttgggatttgtcatttgaatttcaggtttgcatcgccagcttctatatattacggcctttttttttgctggatattatcttgtaaaacgtgaagactacctgtatgctgtgagggaccgtgaaatgtttggatatatgaaattacatccagaggattttcctgaagaaggtatttcaagttaattttagataatctgtgtttactgtattattattttccctggttaatcttatccatgtgtatggctttagataccttctaaattctgttgactcccacatcttagtctatagaccaaaattctcttgaattaatatatccagtttctgactacctccgtgtcctttggacagcaaacaaaactcatatcccctctgccttcccaaacctcctgctcctctgtgtcctgcttcagagaatggcactactgtccacctggacactcaagccagaagcctgagaatcatcaagtctttctctttcacttcccattagtcatcaggtcttatcagttctacttcctaaatatttcttaactttgaactctcctctcccactaccactaccctggttcaggccttgttaatctcttgcttggactgttgcacttgcctcttaact

SEQ ID NO: 66506 - DNA, 1124 bp, Homo sapiens
ttaggctttggagggagtgtctatgcgaatgaacgactgaaaactcagaaaacgaaaactagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtgagtgctgcgcggccgggatcggctgggaggagaaggggtcgtagggctgcagactggcccggccgtaggcccccctgaggtgctctgcttttccgtgcctttttgcctagctggccccatctcgcctttccggggagtccgcgccccattagctctttagaatcaagcagagccagagtgtcatttggcacttgaagaaactgaggtgcagtgaagcaggaactgagtctgtgaaggacccgaaactactctcctcagttcgtgttgtgctgtgtgcgcaaatgagccatgactccatgccatgcactactcacactgtgggcattattgatagcatttcggccttaaaacacttttagggatgtattattcacaacgaggaaaccgagcctaacagattaacagcagcttgcccaaggtc

SEQ ID NO: 66507 - DNA, 1149 bp, Homo sapiens
caaaatcaataattttgcagtcttacatggacagcagacattctaaagtgcatagaatttaacagatgttcagatgttttctttcttcctcttcttccctgccctgaaatcaactaattaattttaattcttactaaaactgaaacgcgtcacatcttttgtagtttcccagctctccccttcaccctagtagacatggataagctgcagtctgtgttctgctttgtagcttgtaaattcttctgttattataatagtatggacgggtattcagagtatttttatgtatattgtcccactggacagtggacaaagtgagaccaaaagaaggttctgtgaacttacattgtggtgagcatataaccacttacttactagaacccagaccccataactttctacacactataccatagagagttccctagttctctttttgaatttgaaaaagattgatgactgtttaatcagtttcatttctcttttcaacagaatcagctgcctcaagtcttttcccgactctttcctttcaagaggggcctctgtcatgcatattgggctccaaacttctgggctttgtacaatgctttggacaaagtgctgtctgtcatcggtatggtagcgagcattttttactcagactctgaatattgaaaggacttaggcacatggagaaatggaaaaacctttgtgttttgaatgtggctgaattgtttgttctccagtcctgcatttcagctttcaggatgaacagggggagcagttcttgggactgaggctttagtgcagtaaacagactgttttccttataaaagctccttgtggtaatgaggttattgatcctttcctggggaaaaaataaaatatgtagacactctataaaggtaatttttgccttaattaaaaaactattcagcagcagcagttaaccctgctttttttccccccttctcaccattcctattcaaacccctacttatttttagagacagggtctcactgtcacccaggatggagtgcaatggtgttgagatcatagtgcactgcagccttaaattcctgggctcaaacagtcctcttgtctcagcctcctgagttgctgggaccacaggtgcataccaccacacctggctgatttttaaatttttg

SEQ ID NO: 66508 - DNA, 1050 bp, Homo sapiens
atcgcttggacccaggaggcagaggctgcagtgagccaagactgtgccattgcactccagcctgggtgacagagtgagactccatctcaaaaaaaaaaaaaaaaaattaaaaaaaaaatttgaatctgtttatagaaaacatatttatgagcagtccacattagtagtagtattttttgtctttaattttgctattaaagcatttggaatttctatactccatcagctggtatagttcattatgaatttggtgtcctctgttgtctttccttgacctaagtccagatattcattttcagtacaatggctttttatttggattaatgctactctccattgcacgattatttcaggtaaacataattgtttaattagattttttcccttttagattagtttttagattgtaaagggaacagtgtagtgggtgataggtaaatttatttgactgttttgagctgccaagtgcgatagacacttttattaggtatttctcacaaattccatcttctcttttgaccataattttcttcatttaacagatgagacaattgtactccaaaagcttgttagcatgcggcaggcctgaattaaattgagtttttgtttgtttgtgttttgaaacagtctcactctgtcacccagactggagtacagtggtgcaatctcagctcactgcaacctctgcctcttgggttcaagcctcatgagtagctgggattacaggtgcacaccaccacacctggctaatttttgcatttttagtagagacagggtcttgccatgttggctcgaactcctgacctcaagtgatcctcctgcctcggcctcccaaagtgctggaattataagcatgagcccctgtgcctgccctaaattacattttctttgcttttgttttttttttttttttttttttgagaatgagtctcgctctatcgcccaggctggagtgcgatggcacaatcccggctcactgcaacctctgcctcccaggttcaagcaattcttgtgcctcagcctcccaagtagctgggattacaggcgccc

SEQ ID NO: 66509 - DNA, 1048 bp, Homo sapiens
tttaggatatgtctgatcttctatttttatcacaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtaagtctggagcatgtcattttgtatggaaggtattgaaaaaatagtacagtgttaagtagtattaacttactcccaatttaggaggaacaaagtttatatgatagcaaatgctaaaacaatgaaaaattgtattgtgctttaaactacatgtttaaagcactctagctgaatcttgtggaagaaatggggataaggtggagttacaaggcagaggtagaacaagagattatgaatgttgtgaaaagaagtagtcccaagtatagttctagggccatttctcccacccagaatagctccatatgtttttctttgcttccttgcagcaggccgccagaggcttccatcacctaccctatcttagggtatgcacacagtacatgcacagtagcgcacacgtatggattgtgctaaccaccaaagtctgcttttacggagctttcattctagtaaactcaagaaatttcactgagtgcttttagttgtttccatatactttccttcatgaagactctttgttattttaagttatgcttatattttaaatttttatgttttacaacttttacttataagttaattttaagtattgaatacacatatatagaatgtcttgcacagtgacttccaagtactaagtttcagttaatgtcagtttccattctttcctaattcttttttttctttttttttttttttttttttcttttttttccctgagatggaatcttgctctgtcgcccaggctagagtattgtggcgcgatctcggctcactgcaactgcctctcgggttcaagcagttctcctgcctcagcct

SEQ ID NO: 66510 - DNA, 1034 bp, Homo sapiens
ttttgctttggttgtttgaacaatttctagaatggctaaagcctcagtccagtccagtgacctctgtaggggctttcttgactgatgtttaagattttcagggtttttgatatgcaagaccaggcctgggcaaaggagggggtggtgactggaccaaaggttaggccagtttctggaaggtacttttgtggttacatctttggttttctctcatcttgctgtcacatgtctctcatgagttgcttgacgcaccttcacggacacctcagtccttggttctgtactgggcactgggctcagagacggggattggacctctgccaagggaggtcccagcctggtgggagacagagacatggattccagttatgctgcagagggatgagaatagctaagagggccttggaggccagaactttagacacttgaattgtggagggaaaaggaaaggcttcccagaggagagggcatgtgagctgggcattgaagggtgagtcagaattttccaggagagaagagggaaaagccctttttcagtagaggggacattgtgcaaagtagcagtcaggaaaaagccccctgctccaatgtctgcagagtctccactgaacaatgttgcttgagttcatctccacccctgccccacatcagctgagtgtcacagaaagggcttgcatgtccggctcaggagtttggaccttattctgggtccaaggggctggagagtgttgagagttctgagcaggggcatggacggaatggtgcttaccgtgtaataagctccatctgacgatgctgcatctggagagaccaaggagggatgatgaagcttgagcgggggcccagggcgtggcagtggggctgagcataggagttgtgtacacacacatacacacacacacacagggtgctttggggtgatggagataagtcaggctcaactgtgcaggagcagagatcagtcaacactcggcagaaatgttgagggtcatccgagaggaacaggtgaaaggatctgggccttttggcagagg

SEQ ID NO: 66511 - DNA, 1833 bp, Homo sapiens
gaacttagactacagtgcaagtgagtgaaagcagatgtgtgccttccctggtgatgaggctctccaggggaaaggaagggaatgcacctggcagggtgaagaactgaggacaacagacttcgagaaggaaatggtctttctcatctaggcctctgtgtggctccacttggagtatctccttcctccagtccacgcagccctcccaccttctctagcgccagcgtttcccctcctaaaggccttgccctgaaacccactcttgatcagtgcttcgtctgtggccagcacaggagtagccccaaggctgtgctagtgaaggtttgttgagtgagtttaggtggaaccagagactttgcttgctataggagaggaggtggcctctgctgtgctcttcctagaggcccagcccggttcgttggctcctgcagggcatggtgtgctgggggaagggaggggcctgcctccctgctaagctcagccctgtcccctgttccagaggaggagccaccatctagcgccctggccagcgtggtccagcacctcccattggagctcatggatggtgttgtccggaacctcagcaatgatgacagtgtgacagactcgcagatgctgactgccattagcaggtgggacgctgaggctgagccatgatcagggctggggcccctccctctcttcctctcagaagccccttctcctgggtgggccgctgggctagatttggagtcagagggcccaggccctcatgtgtgttccatcatctatcctttcttgagccctgctctgtgccttgcctggggctggatgtgggggacacagagagcctgccctagtgatgctgtcaggccaggtaccagcagtgtgaccctggacatgccagtgagctctcagcctcagtttccccctctgtaaaagcagaggtgggtggtgtcaggcgtccttggggttgggtaagagggtgagagtgcttcacgaggtgctttctgagtggggcaaacatgggaagcagagtttgggtgcttttcagctcacagagtccttgcatatcccccacctcatctgaacgtcctcctccctgtgatctagacgcacctgcctgtccagttgtcccagaatatgccgctcccctcctccctgcaggcctttgcctatgcagaccccgtccacctggcatgcctccctctgccattctttccatcccgtgtgcagatccaccgtcttcgtagggccttcctggattccttgcctttagtgggtaagagtgtgggctctcgaggtaagttgctagaggtcaaatcccgcctctaccacttcttgcctgtgcgaccttggacaagttactcaacctctctgtttgagtttcctcaactgtaaaatggagtataaccaaacccatcatctagggttgttgtgaggattaaattgggtaaaacaagataatacacgaaacatgtctagaactgtgctgtgggagacgccgttatcattgttatgactttgctgtcatggttttgtctttttctagcacagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggc

SEQ ID NO: 66512 - DNA, 1038 bp, Homo sapiens
aatgtgtggctgttggggaaggtaaatgggcatggataagctgagtgccccggaaggggacccgcatgtacatgtagtgactctgtgctctctgccccaggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccagg

SEQ ID NO: 66513 - DNA, 1733 bp, Homo sapiens
gttcaaatcgaatctcccaggaggcttccttccagccccctattctggtaactaccaggaggcttccttccagccccctattctggtaactaccaaaatccctcgggtgcaagtgtaggggtagagatggaaggatgagaggtgaaattgaccttttgaaagcaaagctctggctcacaggccccaaactaccagccgtatctagcatatccccaccctccacccactacctcctccaacaaaggagtcaactcagttgaaaaaactggtcctttggcctatccatgggtcaaagtccacctctcctgggggcctggagaggactgagcctacggaaaggggataccttcccactcagcactgcttcacacaggccccctgcctggggctctccaaggagccttcttcacccacttccagctccacttctgcaaggttaagtcaagtgagaacgatgagaaatagggagatggtgtctccttaagtccttgatctgcctgtctgtggaatgggaggttggattagctgcgctgaggtcccatccacagctggtgctcagctgcttgaaggggagactccctcctctgtaacttctttctgggggattggggtgggcagtacctatccccagtcccctcctagcttgactttagtggtttccaatgtagaagttaacaaagtatgccccattcctgtgacaaaagcacaaccattctgaagttactggagcatgggctcagctcatcctccctctggccccttctcccatggggacatctcggcccagcacccctatcccatttccagagttcttccttccccatctgggccttcataaaatgcaggggaagccagactggtctcaggagcgctaaagcccttccgtggggggtcgtctttctgggactagccctgctgtttaggacctgggaccacaatggggtacctgccgagggggtccccaagagatccaggctgtcatgtgatttatggtggcatgtgttgtgtatttgttggctacttgtgtcttgaaatctagaattatttcacgcagaattgtcactgtttgtcaggaagagaaaatgggctagtggaagcccagtcttgagttcttgtcttgttaccatttaaaattgacatttaattttcaaatcactgttggtgcctaatcacttaagttattaatttattctgttgtattcttttttttaaattgtaacatatttatccggtgggtgggacaggagtgtgttcaagtgggtcatgtttttgctgtggtgacacatggtacaggcttggagcttgcaggtccctttctactgtggtgttggagcaggacaataaagtccactagaaatgcaccccagaaccagctgccgtgtccatcttgtcttgaggggcttggtggtggaacccgttctcactccagtctgttccaatttttgctttatttggaaataattgggtatttttcttggctgtgaataagaacaaatgctctctacctcagcgtctgttgtaaagtggaaatcatactagcatttacccatccagctttcttaggcgtctagagatgggttctgggcgtgtctgtctgctgctttcacaggtcacttagatgtgacatcttgagggtctgtgacattgggcccaaactccacaccaccatcacagcaggcagcccctggggaaggaggtaggtaaaggcttgagagctgcctcccaggtgcatc

SEQ ID NO: 66514 - DNA, 1041 bp, Homo sapiens
caggcacatgaacttgacttcattttataggcatcaagaaagagcatctttgaatgttgctgaagatgaaaaatatcttgggcatggtagtagggaggtgggagggaggtttactgttccttaaatgaggcttatcccttcctgcttccatgcggctgatcaccattgtgatgaggaaagagatgattttgagccagatctgggtttgagacctagatttaccttgggcaaatttcttaaactggttaaaggctttgagagatacaccctttcctagggtcatctgttgtgaggttgtgaggtacagatgagaatttatgtgtaagtacttatcatggtggtatctgtcacgtggtaaatactttgttttcttcctttcctggggagtttccttttctctcttcccccagtcttactaaactcctgcccatcttttttttttttttttcctcttcacataagcagtgtagcttttccagggttcccagatgagacagatataagctttccctttgttcatcttcatttgtggaattttagacttttgaagaaagatttcaaagtgataggaggaatgacacaggaaagggtagaaatctgaacaaaatactatatttgggagcagaaaaataagggtccatgagagggtgtatgcacagtgtgaataaaggcatcttgtcacttagggcaacatcattgattctcagcccatctttgttcatccaggaggccaaagagaaagactgtcttgccagttcctagaattatccacgaaaaaggggctactcactcctctttattcagtgagagctagctaccaatctcccagatagccctgagcttttagaatatgatggtatgttttgattaggattagggcagtcattctacagactttttctaggaaaaccgagcttggtaagcagaatagaaaacatccagaatgacatcagtctggtaagctttgaaggaaacaaccaaagatggtcaacacaactgcttgttcttttatttaccatttcacacctggtgcagtcagga

SEQ ID NO: 66515 - DNA, 1066 bp, Homo sapiens
cctcggactcctgggctcaagtgatgttactgtctcagcctcttaaagcactgggattacaggcatgcgccatcatgccccgcctgagcttggtctcttgaaatgttgctgtggatgttgataaagatgacctgacactgatacatgggtcagagtagaggcaagaattctcatctggttaactggtgaagatcaaatagagttggccttccaaatactatttcactcctgtctctcctgttcatggaatcttttttgataacagaaggttacagttgggtgggagagctcttgtgatcattcgtgccaatctcaaattgcccacagggacgttttgggatcccctgcccagaaactttgctgttgtttatagatgaggaaactgaaacctaaaagatgtaaatatggtttccctcaagtcacataaagtgcttttagcaaagccagaactggacccacatctcctaatccctattcccgtggaggatctctattacactaatgcattaacttcactcctgatctttaagtaagctccacgtctgtggtctctgttttaagattgtgaaatgtcataaaggtggtttgcctttgaaaataagccagaacctagagagttaatagaaattgaacagtgaaagtggagtccttttcttctctcctcaactggggagccgccaggctgtttcacttgcaccgcatgtgttccattatggtataatgatgtaattaccagtaatgctgctgctgcttgagtagtggtgaagaggcagcattaaggaaaagactagccccagttctctcctaagagccatttcagcccacttcagtctattagattgaagatgctggaaggcgaatggcttcagcacaggaaaaggtcagatttaaaagcttttctgggtttggtatttattgttgcttttttgaccttcagaaaagtcccctgtgtgtttgtccttgattcttgcctttcccattaatgcttgaaagctgtattgctgtccagaccaggtctttggcatagatgatttcctttgtggtgttagagaaagcctagccccca

SEQ ID NO: 66516 - DNA, 1022 bp, Homo sapiens
ctcccaaagtgctggggttataggcatgagccgccatgcctggacttatctgactttaaagatgcttttctggggtctgaagttgaagatttaaacctatagagtttatttttgctgtcttgtcttttttttttcagtttgttaacatgctgtgtagttctgttacaaacatatgtagtgaaagaccagcttttattagggttaattgttccttttctcatttggtatgcactagtatttagtgaaattcttccttcgtgtagtatgctttgtttctatttttattaaaacatttgtttgtattgtgactatttgtgtagtaatttatatatttaatttgtagcttgcttttcagccatcagtactgtatttcagtgacttctgcacaaacgtgatttaactataggaaatttttttgtccaggataatttacataaagtccctcacttgagaatttcaggtgacagaagtttactatatttctaaatagcaagcctattatagagtagatcagaattaatcatattcatgaacagtattaatctgttgaataatcaaaccatcaaggcagatgcattggttgagttgctgttcatggacttcctggttgaacaaaatggtcttgccattcttagcaaagaaatacctcagcatgtggcaactcatggatgtggccagtaagtgctgtgagaagtgaacaaagaatagaaaattaagcactgacagccgggcgcagtggctcacgcctgtaatcccagcactttgggaggccgaggcgggcggatcacgaggtcaggagattgagaccatcttggctaacacggtgaaaccccgtctctactaaaaatacaaaaaattagccgggcgcagtggcgggtgccggtagtcccagctactcgggaggctgaggcaggagaatggcgtgaatccgggaggcggagcttgcagtgagcagagatagcgccactgcctggggggaagagcaagactccgtctcaaaaaaaaaaaaaaaaaaaaagaaa

SEQ ID NO: 66517 - DNA, 1137 bp, Homo sapiens
gccttagcctccagagaagctgggattacaggctgcaccactatgcctggctaatttttttgtattttcaatagagatggggttttgctctgttgaccaggctggtctcgaactcctggcctcaagtgatctacctgcctcagcctcccaaagtgctgggattacagacatgagccactgcgcctggccttaatgaaacacctttgatgttgctttttatctctaggtagaaagggacaatgagatatagtaactttaagcttataagaaatgctgagaaatacaggttcctgagcaggctgttgtctacatccaaattaattttgacaggtgtttatagagcatatactgtatcctttcccttcccaaggtaataaatcagtactcatccctgccttcaaggcatttgcagactagaaagactagaagtctacatgtgaaacagaatgatgcccttatatggagttatccaggcaccaagttgcgtgaaggcaaatgctcttggtgtggaagaagttggaggggcttcctggaataggaggtggacatgtgagttggactcaagagataagggcctaggaaggaatatggtgttcaaaatgagaaagaggtggtgcacatggggtgtggggccagtaaaattccatccagagtggaggaatctgtagcagaaagcaggaagttttgaaagttcagagctggggggaatattttataattcccagtaaatgccttagatggtaggatgacatttactgataaagagcatcactaactcagtgagtctttccctcacagatggccacttcttcagtgtgaaatgtcagtgtatattgacaatgtttatgttcagaaaacctctcagtatttcaaaggccttagggtcattaagcaaatgacttaattcttttaattcactgaggccacttctttgtctgtaaaattagactaatgcttcttatttcactgggtttgcacatttatcagaataacatgtgaaaaaaatcttagcacagtgtctagtccagagtattaagtactgggggaggtggcatagggatgatgttgacttacatttattaacctattcataggaactctgaacatgagcatgggtgccttcacatccctttcaaa

SEQ ID NO: 66518 - DNA, 1024 bp, Homo sapiens
cccaaacaactttagttcaaaataaccaggtttggaggcatttgggtcaagcacctttttcactgatttgaacgaatctagtcgtatgatggccttagcctctctttcccatcttccatgtaccttcagcccatcaggtgtcagaccttaacagctttaagtaacagcttttcttaggttaggatgtgatgtgttcacttacatgactggaagcctctgccccttcggaagttcagtttccccctaactgaaactggtgatatgtgtaaccttaagcctctggggaacagtatgcctttacatctacttttcttttggggtattcagaatttttgcatcctgttgtaagttaaaactctgctagtttgcttatttcagtagaggcccgagttcattagaaccaagcttggaaagtatttcccagccccatggctgtatatttaccccaaagtagctgctgcttctggtatacatcataggcgtgttatattgtagattgagaaatcctcattataagaatacatcgagcatatgtgataaggggaaaaagtagttgaactaggttataactatttaaaacgattttttaaaaaactgacttaatttgaagtctgggcgcagtggcttatgcctgtaatcccagcactttgggaggctgaggcgggtggatcactggaggtcagaagttcgagaccagcctggccaatgtggtgaaaccccgtctctaccataaatataaaaattagctgggcgtcatggagggcatctgtagtcccagctactcaggaggctgagacatgagaatcgcgtgagcccgggaggctgaggttgcagtgagccgagatcgtaccactgcactccagcctgggtgacaaaacgagactccatttcaaagaaaaacaaaaaaacttacttaattcggaaagacgggaaggtgtagaggggaaaaacatcttagaagaagcaaaggcaaatgtttgagcaattagttttcagggatttttttcatcagccttttctagtt

SEQ ID NO: 66519 - DNA, 1392 bp, Homo sapiens
tgcggctgcggcgcctcccaagccggtctgctcgtgaactaaatacagtgtcgaagttttgtattgatggcttctggagaccgagagagttgactctcggggctggggctccgcggcagccccgagcagcttcagcccgcagggtcggggagagggcgggaaaggggggcgtaggctgtggggccgcgcggacggccccacaaagggcgagcgcctcacgccctctccttccctttctccgcctgcccctcccggccgccggcctccctccgtccgcggctgcatcaccggcagcgtcagcggcatgtgcagcccttgtattaagtgactcatttgtttgtcccccttctttccctttattccgttcgtctctcacaggcgcctccccccgaccccggtgtgacactgcagtttggtccccgtggctggcccgggtttgggaccgggcagctcccgggtgtctggggtcgggagagatcgaggctctccgcggccaggtgttgccaaccgacagtgtttactgagatcgctggaacagccttttccctctaggtggggaactggcagcctgggggaggtggaacagcgtggcgctgagccgtggagttctggctttttttttttttttttttaacccctctccccagaggatgccttgcctggtgaggtcaaagtacaagatggtgccagttactgagatttggccgaaatggtcttggggtagtcgcgggagtttggaagtgggggtaaggttgctggaaggtttcaaggtctctcatctgctccctctccgtttcccatgaaatgcccttgtttaacgggctgtggtgccgaactccgggatcactcccacagcctggaagggagccgttgcctccagctgcagtgcatcaagggagctcggaatagaccctgccctctgtcagctgcaccagtggctgtccatggggggagaggcagaagcctaccagaatttcctgtcttggctccccagatcagaatcaagggacttctggcctctggactgaggaagtgacattctgtttttcaaaggaagtgttgttgttgcggagtacaagtgtgtgtcaatgaaatcaggctcttaggtagatgtttgctgggggaaaaaaatctaaggatttagcacatgagttttgaaagtggacgtggatttataggaggaatgaagcagtgaattgttcatctcagttcggaagctcatttttaggagtgtctatgtagccaaagtataattattaagaaataaacttttttcctcttcagggttgtatcagttcgttaggaaggttgaatattttaattaggattaaggagcagtgatttactattaacaattttataaataatttaaaaactttgtcccgaagagct

SEQ ID NO: 66520 - DNA, 1051 bp, Homo sapiens
caatccccgtgctagattctatgagtgctgagacaaataggacatactccctgctctcagagactcccattctgtacagtcttgtcaaagtttactgtgtatgtgaatcactgcggagcgtattaaaaattcacattatcttactcccaccagaagatctgattcagtaggtctgtgatggaactagctcacaatttacattgttttaaacagtcaccctgagtaattctagtgtaagtattttaattctgtactgagaaacctgcagtgagattttaatatttttacactaaacggtaagtaataattatacaaatctgctcattgaagaagttacctgttttctctgcatgcttgagctggtttttatgtgtctctatcaaggatgggaaggccagcctgcagtgataccccttggaacccttgcagtgtagaaactaccacacctctcaacttttatctcttttcctcactccatttctccccaccacttctcctaatgttttcttctttctatgcaagtgttaatctcccactctggttccttctatgcctagtactgtatcaacatccaggtgcttccccttcctttctccaccccaccccccagccagatatgtcaattgtattgaaaacaacttacatctagtttactaagtacaaacttgtgctggttaatgcttctcaaaaagtaggagtgggctgtttgttgagatcaacaatcatttttttaaaaatccgatatggaaatttttgtgtcaagtttcactgtcatttagttcttgactgattttcttctgatgggttagtagctctcaacagaagattttaaaagtcccctgctcaggtacctgtcctgccgatagagctggggtgtaccctgcaccctgactcaacattgcttgtctccacatgcctgtaaatgggcttgggtggctttctcaggctacacacctgtcacttcttagtcacccagaatcaaaatattaacagctctgatcacattttctgaacctatgaggctttatttcaagagtggtgacactccaaa

SEQ ID NO: 66521 - DNA, 1065 bp, Homo sapiens
tggggtgttttggcttctgatcaatatttgtattcagtctgcaatctatgtataattaaaaaaacaggtgagagtaacatctgattataatttctccccagttaatcttcagaattaaaagatagtaaaagcgttaagaaaagggcagaaagcgggccgggcacggtggctcatacctgtaaccccagcactttgggaggccaagacaggcggatcacctgaggtcaggagttcgagaccagcctgactaacatgatgaaacccatctctactaaaaatacaaaaattagctagctgtggtggtaggctcctgtaatcccagctccttgggaggctgaggcaggagaattgctggaacttgggaggcggaggtttcagtgagccgagatggtgccattgcactccagcggggggcagcagagcaagactccatctcaaaaaaaaaaaaaaagaaaaagaaaagggcccaaagcaaccttaatcactgtattgaaatgatttagtatggcttttgtaagaaagtattttaagtcatggtcagcatccctccctgaacttggacattctactgttgccaggagccctagattggcctgtgatcaactaaggctccagttagctgttgtgcagtttggacccagcattaccataaatggagtccagcgaatttctagccattatcagcacactggatagtttctgggggacctttataaagaagacaccaggagtttaggtggtttttaaactgtcattcaggcagctggtcattgaattaacatagctcatgacttttcaaaaattttctgctatacctttactgttcataattgttactaataacatgactattatttaggcattgctttacagttcacaaacatgtttcatgtatcttattttcttagttatcaagacaatacattgtggactttgttcctttgtatcttactggtcatgaaatttatttggtttatttgttataaaaattcaaagttccttttgggaggccaaggccggcagatcacaaggtcaggagattgagaccatcctggctaacacggt

SEQ ID NO: 66522 - DNA, 1053 bp, Homo sapiens
ttctcctcactccagcattcaagcatatatttttgtgccttcaaacaaaacttcatgtaattaacacctactctagagctccctggtgataaaaagttgaatgaagcacagttcctgccctgttgtagcttataatctaatctataggatatcttttcataatgtaacaggcaaaactctgcactctcctctgtgtattgaacaatatgattttgggaaggaaaagaaaacattgtgattaacctaccaagaaataaaagaggcgtatattttcaagaaaattagtaaatctatagaaaattttctgtagcctcctgaggcaagttttctgtcataaatgcataaatataatagcttaaaaaggaaaagggaccaaagcccatgactgtatgacaggatccactgctgtttctctgggtaaccttggatagattattcagcttcttcctttccattgtctgtctgtggaggggaaagactggtctatcacagtgaggtaaacaataacaaatgattgcaaaatacgtttgaaacattaaattctaatcataacatctggtcttatactatatatagatgatgattttctatttttgaaaaacaggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacaga

SEQ ID NO: 66523 - DNA, 1023 bp, Homo sapiens
tcggccgggcatggtggctcacgcctgtaatcccagcactttgggaggcctgggtgggtggatcacttgaggtcaggagttccagatgagcctggccaacatggtgaaaccctgtctctactaaaaatacaaatactagctgggcatggtggcgtgtgcctgtaatcctagctatttgggaggctgaggcaggagaattgcttgaacctgggaggcggaggttacaatgagccaagatcgtgccactgcgctccagcctggtgacagagcgagactccgtctcaaaaaataaattaattaatttaaaaaaatcctttgctcttaagcattatgctgcaatttctttatgtgtgaaattaggggcttgagctaagtgatccctaatgcccccacgaactatagaaatccaagctgcttagggaggaccacgtgtctgtacttatacattcacttcctcaaagttgttttggttttccttatgcagactttttcttcaagtacttttcaatatatatacattttttatttatatttctatattagcactccttcaggatcttggtataataataccaacaatattattaatccttgtgctgtgctcaggaagaggaaggggcaagttacctacaccctcgccttttggtatggaaggagataggtttcagagatgcaaaaaaatctaaaattggcttcaggtgatggcctttgaatgccttatattaaccagtaatgaccttaggcatatttaatctctccgagtcttgtttttttggctataaaatggaatgatactatctccttcacagagttattgtgcggatgaaatgaaacaatacaggttaagtatctacatagagtggaagcttagtaaatgctagtttcctaccccctttcttttctttgttctgagtcttgctattaggtagataagcctgatgattgagcaagcttatgtattttatagtttgtaaaaactagccttaaaaaaagctaaaccactagccttaaaaaaaagccaaa

SEQ ID NO: 66524 - DNA, 1044 bp, Homo sapiens
ctcatgtgaactaatagagcaagaagccattaccatcggaatggcacaacgccattcatgaggaggccacccccatgatccaacacctgcccctaggccccacctccaatattagagggtcacatttcaacgtgaatttgggagggcacaaatatccaaaccatatcagtctatgaaataaactagaaagaaaagataaggaagagagaagagtcacaagtcattcccataggtcatactttaattataaaaagtagagtggtgccgtttactgaaatgttgtcctctctcaagtggaggaactcataagtgaacctttgtggagttctcaactgatgttttcttctggttcacttgaaatttagagctcactaaggaaggaagcaatgtggtaaaacagtcttgaccatgagggaaagggaatacatgtttgggagcaaggtaagaatttcattcctttgaagccattagtagtatctttgcaaaatgtaagacttttgcctctttcagacagcagcagtagtaaaactggctagccattatagtagccaaagtccattttcagtcattgttgcctgcagcccatctgcatctcttcaccatcacatctggaaagccctctttcctaattgtacctagtttgtttttagggccaaaatactgtgtatttcagcagttacagcaaaaaccacaaacatgtttcctatggtttgtggaacattctttttcttctgatactagtgtgtaaccttgccccattgttggtaacagcctgtgagaaactgaataaggaggcgttcaatttgtggttttcatcaatatttaaaaatactgagataggtgagaagagaggtggcagaggaagggccattaaactttttccctctttcagctttagcgtggacaaggttatgtattgtaagccttgttcctatctagcctatgttttttttttaattcagggtctgagttttattttcagtgcattgattggaatcaaagagtcagaagggagtgtcataaatagaaatcagggtttgttca

SEQ ID NO: 66525 - DNA, 1100 bp, Homo sapiens
aagggacagatcatgggaaaatgaatctaagcaaatatgcaaaatgccatatgcctctgaggctggtctccaggtaagtccctcaaagccaggtggcagatgttcagctgggggagtggcttcacagagaagaatagtcttttattctacacacgtgtaattaggaaaaagtgactgcccctcagtccttgatgagatgccacaatcaccaggtagtgttctaattttcaaaattatatcagtattacttagcaaaccagagaaaggtcagcattagtgggcattcagtaaagtacatactgtgaagtcaactcagaaaggagaatactcagccaaggggtgtgcaataaatttcccagagctgtggctaattaaccaacctgcatcaaaatagctcgagccaccaaccaacagaaatagtgatgaagggaattgccaattttccccatatctaggactaaagagaatcctagaaatttttgtcaaaattgaaagtatccatttcagtctgtcgtaaaatactttgagattctttatcatgacatattttatattaatactttgaattgtagagttagggaacatagggaagagaaatccttttatgtgtgtgatacagacttctaaggttttgttaccaaactgtttctcccatttcagtcttcccagtgtgtcttaattgaacaagtttggttaaagcaactgagataaaagtgaacgtaaatgcctcctaagtcttttggtagagtaagagtgtcgaggaatcttcattattaaaagtagcaaggaaaagacatttagggagttgagaaattatttatattgtctcacttaactaaataagattaactttgtaagattagagattacttaaaacatggtagacagaggaaaatggaagaaaagattaacaaagattaaatttttgacgttccaaattgacatctattattgagtacccgtgtggcaagcataacgttaaaacattcaaaagagaaaacaataatgtttatcgagtatgtgccgataattaacttttatccctttcttacagatgaggctgctacctctcagtgcagcagtatagtcactcatgcaaa

SEQ ID NO: 66526 - DNA, 1057 bp, Homo sapiens
cttgctcctgctcactctttgggtccacactgcctttatgagctgtaacactcaccgcgaagatctgcagcttcactcctgaagccagcgagcccacgagcccaccgggaggaatgaagaactccagacacgccgcctaaagagctgttaacactcaccgcgaaggtctgcagcttcactcctgagccagccagaccacgaacccaccagaaggaagaaactccaaacacatccgaacatcagaaggaacaaactccggacgcgccgcctttaagaactgtaacactcaccgtgagggtccgcggcttcattgttgaagtcagtgagaccaagaacccaccaattccggacactgcacaatcaggcaaaggaaaagctggcttggcagagcaggaggaggcttagactgctttggtttggactatcaaatagaaatagtgaggggagggctatgaagggatacaggcagtctaggcagattttccctgtctcagctcttgtctgaccgtctcttctctgtctgcctgttttgtctctctcatccctttaccgtttcttgtcctgtggttttttttttttttttttttttttgaccttaactatagttgtcttttttttgagatagaatttcactcttgtcacccaggctggggtgcaatggcgtgatctcagctcactgcaacctctgcctcccaggttcaagtgattttcctgcctcagcctcccaagtagctgggattataggcgtgtgccgccacacccatcagatttttgtatttttagtagagacagggtttcaccatgttggccaggctggtctttaactcctgacctcaggtagtctgccctcctcagcctcccaaagtgcttggattacaggcgtgagccactgcacctggcctgccttttttattcttttggtttttacaaaattagctataacatggccaggtatagtggctcacgtttgtaatcctagcactttggtagtccaaggtgggaaaattgcttgagaccaggaattcaagaccagcctgttgaacataggaagacccta

SEQ ID NO: 66527 - DNA, 1067 bp, Homo sapiens
tcacaataccaataacagtgattgtgtgaaaggaaaggaactaggtttctctggaaccgcaatggaagggagatgtatactcttatacatcttgattttttttaaaactatgtagacaagttacctattcacatagttaaattaaaacaaatacttgctttgacttactttaggcatgagggtgtctcatggagagaatcagtattttcctacatagtcttataatgcttagaatatattaccaggcccttactatgacctgaaagagtccatgtgatctgacttctgactgcctttcctatgtaatttcctgtgcattcttcctcttgttcagtatgctctagtcacgctgactgccctttttgttctgtgaacaagccaaactgtttctcacttcaggtccttgtacttgctgttccttttgcctggaatactcctcccaagatacttctatggttcatttccttactcggtgcacgcttctgttcaaatgtcacaaacttaggcctttcttgaccatcatatctaaaatggcaccccaaaccccctctgccttcttattccactttatttttcttcatagcacgaatagctacttgtttatttatctgtctactctctcctcacctgcatctctcgctctctctctctctgacacacacatgcgcgcacgcacattgtctccatgaaggctgagctttatttttatctccagtgcctagaattgtgtgtagtgcctagtaggtgccaagtatatgtctgttggataaataaatgaattaatggtgaattttaggaaaaagtattttgctgttgtagtcttttaatagggcattggcatatcatggattcagagaataatctttacttgcttaagtgactagcttcactgtgtatattgcaagtagatgaggagttgaggttattgaatggttacttgtcttcaggcagatcattctttcataggattagatcagccttaattcctgattattcatgacctcacagtgtgatataggagtacgctttttctggttttaaaatgaactagttagcagctccattgt

SEQ ID NO: 66528 - DNA, 1037 bp, Homo sapiens
actatgcagccataaaaaatgatgagttcatgtcctttgtagggacgtggatgaaattggaaatcatcattctcagtaaactatcgcaagaacaaaaaaccaaacaccgcatattctcactcataggtgggaattgaacaatgagatcacatggacacaggaaggggaacatcacactctggggactgtggtggggtggggggaggggggagggatagcattgggagatgtacgtaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaagatagttcaatctccttattttacaagtgcaaatacttaatttttaaatgtttgtataatacattacaaaaattaataacatgctttcactacgttgaagtgacttacatagctagtagtagaatcagatgaagtggtagaatcagttgagcccattttcttttgttttgatggaacatatgaaactctaagtgtttcagtcattatcttagccgttaaaagcttatactctggagtcagcagatcaagatttactatttacttacatgagtaacctttggaaagttattgatcctctctaaccttctgcttcccttctgtaaaatgctaattttaaaatcgttattactgctactaccaacaccactgccaccaccattattaccttagaaattacctattgttattactagattttaatttgaatagattcttaggaaaaaacctgtctttcaaaacatagctttaggggctttattgtactgtatgacacaatacaactctttctggttagttgttatggatatgaacttcatttttgcttcagagaacaagtttgtgctggataaattattttttgagctcaaggtctttcaggaagtttgtagatttttttgtaaaaaaaaaaaaaaaaaaaatccaaaatactgatgcagtattttacctgta

SEQ ID NO: 66529 - DNA, 1080 bp, Homo sapiens
tccatctattttctacactaagttttctgatcttaatattatttggctaaatgacagattaggtgtgctcaggatcaaggatcatagctaaggagcctcaaacagcttgctttgttctaacaaaaccttaacatttaaagattaagtcctcaagaaatatttattacttcatatgtgcttgatctaatctcagctgttacttggtttgaatgtgagggaaacaataagtattaaagaatgacggatgtagtgtccacttcactataggagtttaagaataagggatttttctccccatttggatggttgagctatagtcctctggaatcaagggaataaagtagttcctcaaaatctctcacctccacatttcaggggtcattcaccattgattgaaagacaggtggtcgtcaaggacttgagtgggctttgaacaaggtgaactgcaatatgtatctgacgttcttttttcttgtgtttaaaaaataaatgaacacaccttatctacatgaaattctagttttcactgttattatctagattttctgtggggtttcttgggctgcggtgtttttttctttactttgttcttgattgctgtgaaatgtagttgcctgctgttttaaggcagctgcagtagagtgcacccagaagtggttatgtttctatatttagtaaaaccataggatttgtgaagcagttgcagattccttcaggataaaatggtttctataaatgtaacttttttttttcttttttttttttgtttgtttgttcatttattgagacaggatctcactctcgcccaggccagaatgcagtggcatgaacatggctcactgtggcctccacctcctggactcaaacgatcctcctgcctcagcctcccaagtagctggacctataggcacaggccatcacacctagctattttaaaggattttttgtagagataaattttcaccatgtttcccaggctggtcttgaactcctaagtttaagcagtcctcccaggaagtgctaggattacagacctgagccactgtgcccagcctcaatgtaacatttttaatgaaactg

SEQ ID NO: 66530 - DNA, 1066 bp, Homo sapiens
ttcttactctaatttttggaagtgagtcactaagtctagtctcccctcactggggatgggggtttgggaagagggagatggagttaagaactacccgcaggagggagaatgtttggaattctatatgaaaatttgttgtctctttatccttctttattttttatttgtgtaatcatttatatcttaatagacttgtatatttcatagtttgggttataattcagtgctgtgttatttactttgatgcttaaaactgttttagtttttgttgttgggaactcattcagattgattcttacgcccctttgatacgcccctgtactttgactaattccttattctctgctactgcaagatgcctcagctttgtttgttgtttgacattcattcaccacctttatttgtttttattttttttatagtcagtaaagttacactgacatattattattcctccaaagtccatagcttttacgagcattcactcctagttgtctgcattctatgcttttggacagatgacatacgttcaccattatagtaacatacagaatagtttttgctgccctagaacttttctatgctctgcctagccattcttccttcctaaccactggtaaccattgatcgttttaccatctccatagttttgccttttccagaatgtcacgtagttggaatcatacaccatagagcccttttagattggcttcttttgcttagtaatatgaatttaaagttcctccaggacttttcatggctggatagctcatttgttgtagtgctaaataatattctgttgcctggaggtaacacaatttatcagttcacctgttgaaagacatcttttggttgtttccaagttttggcagatttcccaggcttattttttattttcccttccctagtcctaaaaattagttatttctccaaagagccctagttccttttattagaagatggtatttagaagccaaaattgggtcactggatatgtttgctgttactgagagattattgcttttaaacctttcagtagacagagtttttttttttaaactagaga

SEQ ID NO: 66531 - DNA, 1104 bp, Homo sapiens
tttgtcccctcattgtgtaataccttgaaaggacatcacctttttaaggctacagcttttggccttatattcaaggtttggataacctttcttaacagccttttagtattcatttctattatttataaagttagaagcaaggtgtctcatccctcagaagtgtcatatgtgaaatatataaacttagcaaatgtttgtttctctattataataccactagtgtattaaatatgcctctttcccagtaaagcgcagtgaaccacagaacacagtgttctgtgaaacttgacggaagattaaattggtagaatactaggttttgtattttttagtgtgccatgaagtatttgtactactgtcattcaaatgttcctagtttaatatgcacagttctaggactattaatatgcagaacataatgtttttgattaaagtatgatttattctccaataagaaattgttagtcctttttccctcagctttgttttttcttgaattcaatttaacagactttgtaaaaggcaaaagatttatgcaatctgaagagaaaccagagtattaacagacttttaaaatggagaaaatggtagttaaatttagacagttaacattttccaaaaggatatctctgttgctttagtgggtttatggttccattttaaagctttttttaaagtaaatattctatgttggaataatttttaatatatagaaagttgaaaagataatgcatagttttgtgtattctctatccagtttcccccattgtaaacatcttccatgaccatgatacatttgtcaaaaccaagaattaaatgttatcacattactattaatgaagctctagactttatttggatttcaccagcttttccatcaatacccttattctttttccaggatccaattcagggtaccacataaaacttagttgtcatgtttccccagtctcttccattctattacagtttctcaatttttcttttttacgacctgtggaatgtactctaatctgggtgtgtctgacatttttctcatgattagactagggttatttgggtattttgaaagaataccacagaggcgaaggcttgtcccgtcac

SEQ ID NO: 66532 - DNA, 1060 bp, Homo sapiens
actagtttcagctcacaacaacctctgcctcccagagtcaagcaattctcatgactgagcctcccaagtagctgggaatacaggcgtgcgccaccacgcctggctaatttttgtatttttagtagagatggggtttcaccatgttgaccaggctggtctcgaactcctgacctcaggtgatgcgcctaccttggcctcccaaagtgctgggattacaggcgtgaaaaaattaaagttttatctaacttagatttttttattctttactatctgtatcgtgaaaggcatagcctccctctaatctcttaattgggatcaagaaagaaaataggatattcagtggttatatggagcttacagatggtgagtactctcccttttcttcatgatcttcaaaggaaattgcagattgaggtaaacaggacaatagcatgccattatgattttaaaccttttaaatttctgaaccatgcttcatctttatgtattctcttcccaactttttgtctctgggattatgagtaaatagaactgggtaaaaggtgggggtagggtacaaagtagaaaatggaaaaagtaaaaggagataaaaatagattgggtgtttcagtgattgtagaggtcaaataagttttccattgttgattatattcctttccactgttcagcttactgctatttactctcgctccttgctatatattttacatggagacagagtcggacttgtgtgggtttttctatttaattctcctgagattgtgaaactgctcagctaaatttgttctgctgtgagaacaaataactggagggcaattcaaaatacttgtttaatattttcttggaaatcctcaaagaaacagggaggattttagatccgtgtggtaagaaattcactgggatacacacattaaaaaaatttttttggtagctcttggtttcccctttcttggctgtgctatttactgtcttccagtggcagaataacctagcaaaaatttttgttttgcataatagagaaaggctaggttaagttttattgcactaacgtaagttttat

SEQ ID NO: 66533 - DNA, 1037 bp, Homo sapiens
atcacttgaatccgggaggcggaggttgcagtgaaccgagattgcgccactgcactccaacctggcgacagagtaagactctgtctcaaaaaaaaaaaaaaaaaaaaattcaagtggttggaaataacttgaattttagcaccattcgtgatagagtagttacaaaaatagacactttttgagtagtaataaattcacttagtatttgtaaagacctggagaatataattctgttacctacctttatgtgtgatagttatctacctttatgtgtgatacttaggattagttgtttaaagaaccctttctgtagtactataaggcatattaagtaatagttatatgttacctagtattttgtagtgtttctttgatctgttactttgggtttgctaaaagatgttaagcctccaaataaaaaattttcgtaagtttcagttttgttaattaaaatatagaaatgtgggggaaaaatggaaacttgaacagtacttttaagacactttaaggatctaaggttatttcttggtttgagtatgaaaaatattttttgtataaccttgtttgctcataaaactgacatacttgttatgtactaaaacttggctatttagaatcctcaaggaatgagtcattcagtaaagccaagtttctgaaataactgaggaattttctctttaggcaccaattttttctaaattccagtggaagtgttcctaaaatgaattacttactttcccctcttcctcagtgagccagtagaaaagattctgctctttctttctcagtgagtcgaggttcttcctgtgagtatcagggattgttcttctctgtatggcagcgttttcaaagcctgccactgactatgtgaagtatttttgttgttgttgttttgagatgaagtctcatactgttgtccgggctggagtgcagtggtgcagtcatggcttactgccaccttaatcccccaggcccaattgatcctcctacctcagcctcccaagtagctgggactataggcatgcaccactgtgcct

SEQ ID NO: 66534 - DNA, 1031 bp, Homo sapiens
tcctgcctcggcctccagagtagctgaaactataggcatgcaccaccacactctataattttttaagttttttgtgaagatgagtctcactgtattgcccaggctggtctcaaactcctggactcaagcagtcctcctccttcggcatcccaaaatgctgggattacaggcataagcctggtagatgttgttataataaatacttattttttgagtaggttcttgctttgtcacccatgattgtactgacacagtcatggcttgccgttgcagtgatttctgttgtcctcacatatcctttactttttagcggtatgaccaatctgctcctctttgagttccatattctttccataggtctgttggtctattgattgggtatacattaatgatactttgtgtgctagtcaagagaaaattcaaagatgaaaagagaacctgctgcccaggttagaggatttcagtttagtcctgtgaggtctgatatggtagctaccagccacttttggctctgagcacttgaactttgtctggtccaaattgagatgtgctataagtgtaaaatacataccaattttgaagaaccaaaaagaatgcaaaatatctcaatatgtttttatattgattatatgttgataatatttggggcataataggttaaagtgaaatatttcatctatttttatgtttaacgtggccacaaaaagaaattttaaattaaacatgtgactcacattatgtttctgttggacagccctgctccaatggttaaaacaaataattttagcaataggatagttggtagtaaggtaagtaaagaactataagaaaacaggaagttacgtaactgagaaggttaaggaagatatcttgcatgaggtgatatttcagccaagtcctgaaagatgtgttccctaggcagaggagctggggatggggcagaattataatagcatcccagaaaagctcgttgataagaacatgaactttgaagtaagaaattccttttgaatctcaactctactaatcgg

SEQ ID NO: 66535 - DNA, 2233 bp, Homo sapiens
cttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaaccttcacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgtttacaggtgtctggtggcctttgcttggagataaaggcttcctcttgcctgtcccagcccccgagccatcctgggtttgcacttccctgctggctgctatcaggatgacctgggagaggactcagtcctaggccccagggtccctctaaatccctccaggctgcagctctgtcaagagggatgtccagagggtctctaagaccctgaagcttgactttgcaattgcatgacaggaataaatatcacagctcctctgacatcactagtgcagcgtggctccccatcccactgctgccctcgttcagggacaggctgaaggggccaacgaacccaaccctcccagaggagggagccttgctccaccactgggcacacagagtcatccaccatgccactgccttccacaagggatgtgagccgttgcactttaaaaataaatgactgtatattcatcatacaaataattgtaactacataatacaccttggg

SEQ ID NO: 66536 - DNA, 1023 bp, Homo sapiens
ctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaa

SEQ ID NO: 66537 - DNA, 1042 bp, Homo sapiens
gcttttcagaaaagcatgggccagtgatagacaccaatgtggtgcctccacagtgcctgccagaggttgttcaacaactacttagtaacccaccactaggaagctgctagggacgcagccatgaccacacacagacgcttacaagctgcagtaaggagctttgtgtgttacactgagtttggagttccacaaaaataataagccttggtcactatccagaacaaaagcacagggagagaaggtgggttctaaataaaaatgtgacattttctgagtacttcaatgcacctggccttatgtgagttattctatgtaactcacaaagatcccacagccgtattgttctcattttacagactcgtgcctgaggctttcccagtgccacacggcaaggaaggggtagagctgggattcaaacccagatgtgcctgttctgtatcctcttgctgagtacagtgcctggcatactgtaggtgctcaaaaagactcactttctcttgtctcgcttttataacccaatttcaaagactcagaattgtatagctggaaaggtctttaaaaacagtctcatcccacccactcacttcatgcattcatttgctcgcttctcccctccctactaccccaatccattcataaattctctatgagaacccaactctgtgccaagccccatgctgtgcccagtgaacgcagggatgaatcaggcagagactaagccttcaagggatgcttgcccaggggatgacagactaaggaggaaagcaggttgccagatggcttgctgctggtggtcagaaactttcatatccatatttcttactccagattgattcctttaggcctcagcatagctatctcctaccagaccccggagaatgggattctgcacccctgtacgctggtggcacttcccacactgtactttaatgcctctttcttgtctcgctactagattatgagccccaagagggtaagtactgggtctcatttagtacccagcatacaggatagcacacagtaggtgcatgaagcatttttg

SEQ ID NO: 66538 - DNA, 1024 bp, Homo sapiens
atttcattgcatagtgggtcatatcctacagtttgaaaacccatggtgtgcaaagaagagatttcatataagcagtttttagcaaatttaaaaagatgtgcaatcacgaataagaaccaagatactgttacttctcactaaaccttacctcttagcatccaggtagactacatgcatcttcattcccatccagcaacaacaacaaaaaaaaaattctttttttcccaaaaatttcttcaagggtcctgagatgtattccagtgagataggcttaggtcactggacaatccctgaagcacttactggtggctagagggaaagaatgcactgattggcttagcctaggtcacatgccaaccccttaggtggattcaacttccctataattacactaatactccagaaaggaaagagaaggcagaatggactgctgggaaggcaaccaaaaaatgtccgctacagatatatcatgtacatcattgcactctatcttcacttgatgcttgtgaggtaggatcactgaccccatttacaaaggagaaaagtgaggttctgaggttcagagagctaaagtaactggcccactaagaagtggcaaggctggattagaactctgctctgattccaaaaccctcattcttggattcaaatacattttgtaaagaacaaaaccacacacatgaaagagattattggctgggtgctgtggctcatgcctgcaatcccaacactttgggaggccaaggtgggcaggtcacttgaggtcaggagttcaagaccaccctggccaacatggcgaaatctcgtctctgctaaaaatacaaaacttagctgggcgtggtggcgcacacctgtaatcccaactacttgggaggctgaggcaggaggattgcttcaacctgggatgcggaggttgcagtgagtcaagatcatgccactgcactccagcctgggtgacagtgagaccctgtcaaaaaaaggaaagaaagagacagaggaaaaaaaaagaaaaagaaaagaaaga

SEQ ID NO: 66539 - DNA, 1097 bp, Homo sapiens
acagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacaggtaaggaccacggctcactcaggggcaggaccccataaagtgctcttactacctaacaatacttagtcttctttgagaaagctggcataaggtg

SEQ ID NO: 66540 - DNA, 1923 bp, Homo sapiens
cccgagaggcaaagaaatcatcagaatcacgttcaggtatgacacaggtgttgaaactatctgtcagagaatttaaaataactataattattttaaaggctctaatggaaaaggcgaacaatgtgcaagatcagatggataattttagcagagagacagaaacgataagaaagaatcaaatggaattgttagaaatgaaaaccacggttataaggatgagaaatgcctttgatgggctgctctctctggaggacacagcatgacacagctgaggaaagaagatggttaatagaaattacccaaactaaaatacagagaggaaaaaaaagagtggaaaatgcagaacatggcattcaagatctgtgggacaacatccaatagtctgatatacatgtaattggaattccaggagaagagggaaaaaatagggcagaagaaatatttgaggaaataatggcagagaattacccataattaataatggacaccaaaccacagatccaaaaagctcagaaaacaccaagcagaataagtacatacacacacacacacacacatttctagccatatattcaaatggctgaattaaaaaggagagacagaaaaccttaaaagcagccaggaaaaaaaaaaaaagcattttataagaggaacaaaggtaagaattacagcagacttctcatcagaaactgtgcaagccagaagacagaagtgctgaaagaaaaaaaaaaagaaaaactgtccacagccaggtgcagtggctcacacctgtaatcccagcactttgggaggccgaggcaggtggatcacctgaggtcaggagttcgagaccagcctggccaacatggtgaaaccccacctctactaaaaatacaaaattagctgggcatggtggtgcgcacctgtagtcccagctactcgggaggctgaggcaggagaatcacttaaatccaggaggcggaggttgcaatgagctgagatgtgccattgcactccagcctgggcagcaagagtgaaactctgtctcacaaaaacaaacaaaaaaaattgtccactcagatattatactcaataaaaatatctttcaaatgaagacatgttatagaggtatagggaggggtaagggaacctagaaaggatgctaatagcctgggcaacatagaaatacccatctctaccaaaaaaaaatttaattagctggatgtagtggcacacacctgcagtcctagctactcaggaggttgaggcaggaagagcacttttcagcccaggagttcaagggtgcagtgatcgataatcacaccactgcactccagcctgggcaacagagtgagatcctgtccctaagcaaattaattaattaattaaaaataaaaataaaggacgctgaggcacccaggcactaaaaacagtgaatagccattaccaacccccaggctgcagagcaaggtgggaaagttgaaggatatcatgactgaagtccagtgggagctgtaatgatgaaggagaagccccctagttgaagctgaaatcatggatccacgcagccactgttagagattcggcactggaggaaagaaggagtgaggagtgaggaaaaccttctgaattccagtctcttgcccgtgcctaccacggacttagcttaaccagaagtgagccagccagagtgccccagtgacacagtctgcaggggtcagctgctctgggcagagagaggacagagaatggatctgggaggtagggggaacagagaataaccagcacagagactgactggctgtgtgacatgttagccatgagtcgccaagccagggttcagccccagatctgcctgaaccctaagcagttcccaccagaggcaccacctcaaatacagtatggcagagtgggccagatcttgggaatcctgagggctagaat

SEQ ID NO: 66541 - DNA, 1038 bp, Homo sapiens
gcaagactgtatatgaagccactttggacactgttatgggctacatgggctatgggatggattagtggtgggcatcttgccagtcatttgagtatcggtgtcttcattgtcaggttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtaagtactaaaacaaggccatttgatgattttgtttcattaattca

SEQ ID NO: 66542 - DNA, 1026 bp, Homo sapiens
gcctgtagtaccagctactcaggaggctgaggtgggaggatcgctttagcctggaaggtggaggctgcagtgagtcaagattgtaccacttcactccagcccgggtgacagagtgagacccagtcatacacatacatacatacataagtaaattaaaataaaggtatacacttgcttaagcgcaccccagattggaccaaatatcaagggtttgtagggggctcaggaagtctaaggcagtgaatttttaggtggggtggaaaaatcagcagtagggtgcacctgtcggcacttccagcccacacaaaacatggctggacctcctagagacacaggtggcaaagggttccccttagtgccaatacctcctagtgtgatagatccaacaatccagccttcaagtccactgaagaaaacactcctcccctcagaccatgccagctacaatcccctgggtgcccacttgaagactcaccatgacctatgccagtttcccagcctggctcagaggaggttccacatggggcccagcacttctgaactcctagttcctacaaccagcttcagtaatcctttccaggtggacctgttctctgaggtactagaaccactgtctggagcagggcttcataaaccttagtgtgcacagaaatcgcctggggattttgcttaagtgcagatactgattcagtaggtttggaggaggcctgtcattctgcgtttatgctcagctcctaggtgagctgatgctgatgaccacacataaggagcaaggatccagtcatgattctcaagcccacatcaggatcactcaggaagcttttcaaaataatgccgatgcccaagctccaagcccagggatctgatttcacccaccaagggtggggttttcccaccattattttctaaaatcgccacagataatttgaatgtgaggccagatttgagaatcactggtctagaactatgacagacagaggccatggttagcttgtctttatgtctctagcagctagccagctgtta

SEQ ID NO: 66543 - DNA, 1034 bp, Homo sapiens
agggcttttcagttgttctccacacatgtgtgttctcttccccgccctcgtggccccccaccctcacacagatgaagcggcagtgcatttacccaaaagcctatgattaacccacatagaaatgacaagggtgccacgatatgcaggcactttgcagcagggaggagaaaagatgtccgtctatttaacacaacaaaaggagaaaaattaggtaattaatcaggggacagatcacttctattagcctgtgcagccaactctgtaaacaagaaacccaactattcatggagcactcatcagtccaaacagatggaagagaaagatggggcatagctaggcagacaagaaaacgcctgtcttggcacttacagaatgaaattaatgtacattcacgacaggaccatgagaaaggcttcccagccttgaggctgcctggtcctctgtgtgaaatcactctccagcctgaccagcctaagaaggaacagttggtgctccagcaggttctcagcactcagaggcccctgggcatcttaaagcaccctgctggccagtgagagacacgtgggtccccggagcaaaggccttgaaactcacaaagtgccagccactttctcatttttacaatggtcattaataattattgagggctagttactacaagtcagatgttagaatccctgttttatcaatgaggaaatgaagacttcaaagtgaagtaatatgcccaagttaatacgaccagaaaattttataattcaagtctctccaccttggtgaaggcttcctgacccttcttccactgccttccccagagaaaacatagtgaaacaaaagtgaccagaatctcctgtattttaccatgaccctcttgagtctgtcctttcttgtgctgctcacatggtactgattcattcctgtgcctttccatctaaactgggtgctgcccagggccatgtctcatctgtatcccacgacagttcatggttatgtctgattcttgcgattctgaacctgggatggaaattactatcacc

SEQ ID NO: 66544 - DNA, 1016 bp, Homo sapiens
aaaaaaggaggaaacatatatgtgattatttattgattaagctctgagcttcctggcagccagtgtaaataagaaaacataattattttcatactttatggcatcagaaattgaaaacatgcccatttctcagaagagaacatttttttcctgacactgaaatctgagattttcaatgagatttgtatggatgatactgaactatgtaatgacccatgccttcaacttcagttgtacagaaaacacagaagtacatttcacatgcaggtcttggattaaagcctagcatttaatgttgaaacattcagttagtggtggcggctgcaaaggacacagccatgacccagggggacatagctgggaagagtcagaaggccaggtgctgtccagccctgctgcacattcaccatatggccttgggctggttacctggcgtttctggtttccagtctcatgtataaactgaaagagtttgtggtttgggaacattttgtttctgatgttcagtgatctttttatatattcatggtatgactttaaacccttcgtcaattaattgttttcttcggtactaaaaactttctaagatgaaccaaagtagaaaggaaaaaatgaatcactttctgccttgcagttttctaaagacaaccagaagacagagagcctgggttcagctctgatattaactgccacctggatattggcaaatctcttcctctctctgggcttcagtgtccccatcagtaaatgttggagatggattttaaaaattatagagttgtatctcttcctccattaactgtcccagccactcccagtaatatgtctggccccatgactggcaactgtaggctgtgtgtgtgcttccccggagcagactcatgtctgccttttgcttttccagcctcagtgccagcctgctgtgtcgggcatgctcagtacagaaacccataatccatggggcatcttcctctacagactccttcaggaaataagcatctttgcctcgtcccaga

SEQ ID NO: 66545 - DNA, 1069 bp, Homo sapiens
accaggcttggggttctaacacccagatcaaggcttgccctactttattcactgacttttcactgggctttcagctctgacatggttgaaaggccctaagtaccagcagcaccactgtcagctcttgtgtatcctgaaaaatggctctccacagcagtggttcatttcagcaaattctctatgtgaatcattttatggggtaaaaaaaaactgctttctaaaatcactgccattgtttggagctgcagtcaaatatttaggcattagagcctccctcaagaaatgctgagaccctttggtgtaattttctcccctttctttgtctctctctttctcatcctggttcctgctcttcctgctccccgccccttctcaaccttcccctcccaaacagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggtacccagctttcctaattgcattccaccatgcttttatttcattttgggggtggaggaggatctcagagacagtggaaagagaaaaaacacctctgtagggcttgggtcaggtcccatcagcctgttatgcaaaatccagccaccaaaccccacagcaggcatggtgtaagggcatgaggggcacccctcttacacatggaaaacacatgagtgcctggaactgcctggcacactctggtttatactaaattctctctgtctttccactctcctggttagttcacttctgcctactttccttttccccagcctcctgtgtccctctgtcattatttctgttaaaactacttaaaataaatggttctaccaagaggaatgtgccaaaggatcccgaagagtgagcattataat

SEQ ID NO: 66546 - DNA, 1054 bp, Homo sapiens
catgaagggagcttataagtctggctaaaattctgtttgacagttaaaaatgttctatcaaggcacagatgctattcagttctgtgacagaaaaattgttctttgagtatttccccaaaaccatgggtattctcctggagagccaaaacctgaattattgattcaaaataaaccccacctcaggtgtttctctgtcattgaatgatggtggtactcaacttcatctaagtgaatgaggaacaggcaaacgggtgatagctcctgcaaagggtggaagagtcaggctttggagcttggagccccaaatctggggatgccatctaccaagagcagaacttgacactaggaaaggatggttccatgcggaatcctttcagtctctggaggagagaagagcaagctgcagcaatgggcccattcccacatggtggatttatcagagtcaagatcagatcctgcattgaggtctctcacaccaactgcccagatgaaccttagatttaactgcagtaacagccaaagtaagaagggacgtagggtgtttagtagatgtcagttcaggagcagctgatgctgtcactcatgcatttattccatcaacttttaagcatcaagcactgggctagtttctgaaaagacagaggactcaatgtccctgggccagagagctcaacaagcaatgacagtgcaatgccatgcgtgtggggcagtggaacccagggaggaagctggaattctgactgggtaaggctgtgtgggggaggtgaagtttgagctatacagtttgatagttaggagttctccatccaacaaagccaattaagacaggctttgaaaatgcctactacagccagggtgtgacagaaggaatggactagtttgaagtcacccaggagacagacatcaggcccagtgaataagaagctggaaagagagggacccacactcaatttaaaaaaaaaaaaaaaaagttctaacagtcagaactaacctaaaacagaacagtcctcctgtggatatagcaatctcctcatctctggaattgcataagtag

SEQ ID NO: 66547 - DNA, 1070 bp, Homo sapiens
ttctggcaggagatggccttcagcctgagacaaaaatttcagtcgggagacttggccattagagcatcatttatcaaattgcaggtcacaacaaacccattagtaccttatgaaatcaattcagcaggtcgaaactattcttttcaaaaagagaagtaaatttaactggaatggagtagaaggaaatagaaaatatcagtgcatcactgtaaaaagaatatgtatttcatgaaacttatttcagttacatgtgtatgtgtatgcatgaactactggataagctgtattgcttactgtgggtttcagttgaacaggattgtagaaagcattctatactgcagaaccagtgtgagcaacagcataactttccaggacaatcagagaatggagaaaattttaatgtgtctggaggataattatggtgacattattttccacatcaaaggtcagaagacgtgctctgacatttgaaatcaagatgggcttaggaaatctgtggtatatgagcatggtgagcaaagggggcatgtgggagaaagaggaacatagggaactatgaggccagaaaagtgggttaggggcaggaactgagaaagatctgaccctcacccgttcactaaccaagttccagcatttcatctcaatcaggacctaaaactggctctaaacaggagtgaaataaccttgattccacctaagtcttagaattccattcacaccctatagaaaggcacaaagcttccaggaattttaaaagcaagagttttcaagagtgaaaaatgatggaaaagagaaatgaccatgtatgcaatgtgattttttatcagcccactgtgaacctaaagccatatgcaagcgtcagtggcatagcagtttcagaagagcatttgctccccaccccacacctccacccaggctttagacagccttcaggaagccctcaagagggcgagcagcagagatcatctaatggacttcaaataaacaccaacttcctgacagctggcctctgagcaaatttattattgaattatactcctgcattttcagaacaagctgagctgacaggg

SEQ ID NO: 66548 - DNA, 1066 bp, Homo sapiens
tgggaacccgggaggcggagcttgcagtgagccgagatcacgccactgcactccagcctgggcaacagagcgagacaacgtctcaaaaaaaaaagaaaaagaaaaaaaagaaaaccaccctggagggttagttcaaccatacaagattcccataggaaggcaagccttccgagaattaacagaatcatagaacacgtaggaaatgattgaccatgagctagaatcaacaactacaacatgcagaaggatgaccactcccgagaacttaacagtctgaaaaaggctataaaatgaatacacttttaaatgactaaagagagaaaacgatatataaaaaccatagaacaagacaatatcaagaaagaaacaggtggattttgaaaaattccaaatagcctattcagaaattttaaagtaagataatttatgacccgaagaacaaattaaacagcagaccagacacaaatgatgggaaaataagtgaagtagaatagagatttgaagaaacaaatcaggatagaacgcggataaaaagatggaaattaaggaagaggttgagtgacatgaaagctagaagatcctctaagcatttagtagttaatttcctgaagactagagagaaagggagaggaggatattcaaagagctcaaaaccaaactttgcagaactaatgagagacacaaatactaattaaacggccatggtgtggcctatcagttcctatgtggagcaggcatacatgctgggtcccatgcttgcagtcagagtctcagtctaaaagttcctctctagaaaatgtttgtctcattgtcacaagacatccaagggaagttttgtgcttcacgcttggctgtagagacagattggtgagtctaaggaattaaccatccttctttttctcccctattgtgcatatgaagaaactgaggtttagagaagttaagcaacttggaccaagtcacacagtttgcatgagaattgggaactggggtccaaatccaggtagtttgcctggagagagggctctcttaagcaccatatggccaccgatcacagaataaaagg

SEQ ID NO: 66549 - DNA, 1412 bp, Homo sapiens
aatgagagcagagcagcctggctgtacctgcgttgcactcacagacagccctagttagtgtttcacaatggcgatcacagctcctctgggtgcagggcccttttctaagtgtagctgtagacaagatgttaagaaaaagccccaagccctcttcctcaaagcaaagacagttgtttaggagaaaataagacaaaataaatgaaaagcctagggtccaataaaattgacctactacaagagttggaaaaagtaacaccctttagaatgatacccagaagtgatgaaggaagcaaggaataaacagaaagatgtttcctttgtgctaaacagccgccagagataagaggaacacatgagaatgaacaagaagcaaggatcaggcaaaaagctccattggttagattctgataggccaacatccactgactccggctccagaatcccggtcacttttgaaagaggggcttttagatgcagaaggtgtgggtttcagccctgtccctgccgcttctgactgtgcgaccctggcaagtcctttcacctctctgagcctcagttgccttctctgtaaagtggcaattcctaatgatacctacctccctgggctgctgtgggcattcgtgtgctgatggatatgaaggcattttgcaagttggcaggtagcgtgttagtgtgtgtgatggcagttgactctgggtgatcagacctcaaccctgtactttgtctttcagagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggaggtagggctctggcacccatgggctccaggcggctccagagggtgggaggcccagagtggagaatggatattactgagctaacaggccaccaacacaccagtcatccagtcagggggacctgcggggcaagcaaaaaactgcacatgtggcttagggatgagtgcatatcacaggtgttccatttgaatcaattgaaattaactaatgtaaatgaaagtaattgatatccagcagccactatagaagagaaggcatatggaagaaagaggtttctaacaattcaacagtaggatgagatgtctggcaaagttatgggtccccctcactggagatggataagaagagaccatctaattctttatcacagaagctgcagagggacgcttctcccagggaaggaggttgagttacctttggtcaaggtctcttctcctctgattctggaggttaccctcactgcacaccagcagacaccttttgtaatagaaatggcctttgctttgggtttttttaaagtgctagacagtcaaagcc

SEQ ID NO: 66550 - DNA, 1098 bp, Homo sapiens
aggcaaatgtttcttggcaaaatcaaggtctgacccaagccctcatctggctgatattttggtataatggatactaattctaaaaaaataattcagagatctgtgtcatggaagctcaggtcttgtcagagtagagtactttactgttcaaagatgggccggattttgttcattgcttcccagttgctttggtagagactaaagaaacaatgtttactcaacaaatatgctgaactcctaagtggtaggaaatatgaataccacataacagatatggtccctgctctcaaggtgcctgcagtctagcagagaagacactaaaaccaataattccaacaaagtgtgatgagggttatgacaggggagtccagaggctaccacttagcaagtaaccaccccactaacttggattgttggggccttatagattgcggaatttaacatgagggtataagaaagcgtctgaaggtttttaaaagcaagatgataactaggtcacatttgtgatttggaagttcagtctggccctattgtgaaaggagaattgaggggggaccattgagaacaagaagaccgattagcagactattgctgtcatctaggtaagagatgatgatggctttgtctagggaagtgaatatggagagagaaaaaaagtacaagaggaccagtaagagaaacataaagaaatgggccatttgatatatgataagtgtattgcatagaatccatgccacttaactaaaaaataaataccttcaaggattctgaaagtcttctaatcatacctggtgctagctgcaagggggacttcttcataggcctaagcaggagattgaagataaagtggtcccttgtcatttaaagggcatcatttcttttgaaaagctttgttagcccttctctaaactttaaaattacattactttgactctagcaaatgcctggtgtgagtctttccgaagggattattaatgtcacgtgggctgtctgaattattgatgagtttcagggtttgcggaactagcctcagtgggtaaggacgggcatattgctttaagaaagtcagcaagtcatcctggaagagccttcctcatg

SEQ ID NO: 66551 - DNA, 1519 bp, Homo sapiens
aacgtggggcacaatccctttgtctgtgtagcatctggcatggttatgtggcaggcgatattgcacttactggatcctaccttaaatgtcctgtcttttatctccctagctcactatctggatagggtagttaaaggtatggtcttccttcctctattttcctgttgtctttgtgtgtgtgtttgtgtatgagtataaaagaagaaatgtgtatataaaaatgtatatacaccacataagcatgatgtctggaagctaatgcatccccagttttgtcgcagcatccattgcccaaaggggatgggttttcggtcacaaggtggttgatatacctggagtgtcattctccccacaagatgctcagatctgtttgtgacaataccattgtacttttgtttttccctccccccgccccacatacatacacctttcactctttccaccccatctcatgtcaccctgcccatctgttatggcccctggtccaccagaattaagatgctggcaaccagggtgggtggcctgagaaaggaagagacccaagagcaagttaagaaattttaaggactactttctagtactactgtgttcattcgtccaacgagcatctatggagcacccactgtgtactaggcacctgcgccagggtctggagacaaggggacaaacagatccctgacctcagggagcagatggtctgtttgtttatttgtttgttttccttttcagagaaggcctgactttggtaagttttgtctttgaagagtgttccctagaggcaaagtaattccttccattttaaacatttacattagttgggtggtacctgattttccaaataggccacatagctctaagaacaagtctcagaataatcagatatgtgtgctctgaaaagactctaagctccttgaggagaaataccatgtcatattcatctttttgttctcaggccctaacacagcacctggtacaaaatgtgtgctctgcagatagggacacatattctagagtcagactgcttgggtttgaatcccagcttcaacactcagggaactaagtgaccttgggcaagtgatttaacttctcttctcttgctaacaggacccacctcataaggctagtatgaggattaagtgaagtaacaaatacaaagtgcttagtatataggcaggaattatgctcaataagtatgaattatactgctttatcatcatattcttattcttattctcacccttaatttgaagaaggacttcattagctaaattaatttttgaaactgtaaaggaaaaggctaaattggcttttaataagagatagcaacagctgttttaaaacttatggaaagggttttggggaaacataactgactaaatgcttttcagctaggacagctttgccaaatacagcaaaggtgtcgcataggatccaacagatggaggaagagcaagggtcttcatatttcatgtgctggtcctcaactgacaataaaatcattccagcaagaaagagtagt

SEQ ID NO: 66552 - DNA, 1011 bp, Homo sapiens
agtcttcattgtttttgttttgaagcctaacattagtttgtatccttggtccctgcccctgcaacatccctgggttttggccatggaataccttacatttattaatattaataataataatggcttctgatttttaagtattcacaacgtgccgagagctgcactaagaactttagctgcattattttatcctccttacaatcaccctgtgaagcagtatgtattatttcctcattttcaaggacctgaggcttaaggtcacggaacttcaaagaggtagagcaggaatttgacactcgatttttccttaccagctgcttactctgcagcccttgcacgataaagtcctggttttccactgaggcatctgctcctgtccctcctggagactgtgccctgtcgtggcagctgcactcagagtccctcacctaatctgcccagcctccaccctcaacagagccactccatcacaatggcagccactgcaggttgtgctgcgtcatgttactgtgtgcaccttgatggcttctttatatcggtgtcatcctcccttacacttgtcctggaaaccccttagtgagaagtggccctggtcatctgagggggcctcttctttaaactctgctttcccctcaccttcccttttctgcatgactgaggatgaaccaacctttcaacctcccagcccagaagaaagcccacacctatctaaaaaacaaaaacaaaaaaaaaaaacaaaaacagaaacaaaaaaaccagagcccagagagggcccattctgtttgctgtctcttgcttacagagtcctcagctcatcttaccaaactccaaaacgtttgcaaatgttggacaaaaatgttataagataaacgcatctcatcttagggaacctctcccttcgtctagtcacacatgactcatgttggggcttgtgggcaggctgttttacaggcagtgttttctggatattcatcagcctggccttaagaatgtcccttttattttgatgcc

SEQ ID NO: 66553 - DNA, 1055 bp, Homo sapiens
tgtgtgctgggcattcactgttttaggcaccgaggatcagacagccccacagcctggtcaggaaatgagacgcctaattattcagcatgagcagagctctgattgttgtgtgtacagtagggtttgggagcacaaaagcagaagcagtgaacttggccagtaatgggatgggagaggaaatggagaaggttgtcaccagccagagatctgtgagccagaccctgaaaggggactgaagggaggccccctggtggccaaggaggagagggcagtgcaggccaagggaacagcgtgtgcacaagtagagagcatgcatgatcagctggacagtcgcggctcagtccagctggagatagaagctgcaggggtgggtggcaggaaagaaggccagaggtaggcaggatccaaacctcggagcccgctgaatgctgtgccgaaaatcttggcttaaaataattgtcaatgaacattgactgttgccctttcagactccacatcagatctctttctttggctctctcaactcaatctggcctagattctaccttaacacagtggaaccctccagaattcacactcagatcctctaagctttcagtttattctctattaatctcctcccctacccaaagggaaagagaatcacaaagcataaataataacaataacgactagatggatatggcgctgaaaagccctgttatcaaattaggtcacaatcgacagcaaaataaactcaatgctttaacaaaaataagcttaaagtagcaaccgggttaaaataattaaagctctaaacatagcagttgcactagagctaaattcaattttatttacgaggcaaaatataattacatttaaatttgagggaacagaatttaattcttattaatgacagaaagactgagtgagatgctttaatgccagagaaattgtcttatgttcatggatgggagagaaaattagattcagcattgagcattctcccctgttacaagtctcatttgtgtagctagaattgttccttctctgagaagcattagcttctcagtcca

SEQ ID NO: 66554 - DNA, 1092 bp, Homo sapiens
tgccagccagccagaagccctcctggacaagagctggcatcatttcacctccttcaagccatcttccctagggagcaggcctgctgggctgaatgcctcatcaacttttgcataaagtgggtacactcagcagcactgctgagcagaacaactcctcccatctccccttccttgtgctttagttggcttttcaccctcttggctcagagctgtctcagaaaagggaaagaatttaatctctttgagatggtccttagaattggaaaggctcacctttctttcagagcttaatggcttctaaagattttagcctctgtggcattttccatggtacgctttcaaaagccatcccttagactcatcatttgtccctgttggttctccctcaggtcttccttccccacccttacccccatagcctctctcctcagcctcataaatttattcctcatttccactgctatatgagctctctccagtcttgtctcccataaatgacttttatttgagagggccctctccctatattttattccttagggttgctggctcacagaagcaatacatggcagagattttgcctgtaaaatgctcatgctgcgggtttatgattcttatcatttgattgcaattgagttttgtggaataacaggtggagatgttttagagattcagtggcacaggtttggaggtaacacgtgcagtcagcaagaattgcatgaaatttggagtaggaccaggctagattttcaacactaagcttaagcatagactatggctaatgacacctgccttgcagggttgttttccaaatcagatttcacatgtatatggtggctgcattcagtaagcagtcaataaatgaagtagttttatatagttttagaatgcatgattagatttaagttatccaaacagtccttagactctaacaagtgtaattcttaggacagtttatacagtgaaggtttggagccagaaggcctggacctgaatctgtgtaaccgtaaacaactcacttgctctctcagaggcgcagtttccttgcagtttctgaatctctctaccatcccctttccccagccccaacac

SEQ ID NO: 66555 - DNA, 1037 bp, Homo sapiens
caaagccccagcccaaggatattatcatcaccagagaccctaccccagacctattaaattggaaactctggtgggtagggcccagcaatccatgttttaacaagctttcagatggctgacaaggataaagtttgaaaatcacagagcttatacaggagtaaactaatatttcctgagtatcttttatgtaccaggtgcatatatatggtggttttatttttcacaactgtgtaaggcaaatagttttctcatttcactaataagtaaactgagactcagatacagtgacttctccaaatcacaccctcagaagtcacacggttggaattcagacctagaccggtgtagtgactctaaaggctaaagccttcccagtgctcctcgagaataaggactatgctttggatcctccctcctgacagctttaacacagtggagtcaatagagacttgatcaacaaatcaatatttttgtccaagtgtgatacatttgcgagtggctggagcagcattttgatttttgaatactggtaggcatgtttgaaaaccagagtttcagttaacaaagccaaaatagataccagttggaatgtactggccctggcagcatcctctgcagtagtcctgactctataattgactaatctacaggcaaaaggaatgggatcagcatgtgatatagtttagatgtgtgtccccatccaaatttcatattgaaatgtaatcccctggtggcccacgcctgtaatcctaacactttgggaggccaaggtgggtggattgcctgagctcaggagttcgagactagcctgggcaacattggtgaaaccccatctctactaaaaatacaaaaaattagtcggacgtggtggtgtgcgcctgtagtcccagctacttgggaggctgaggcaggagaattgcttgaaaccgggaggcggaggttgcagtgagccgagatcgtgccactgcactccagcctgggcaacagagcaagactccacctccaaaaaaaaaaaaaaagaaagaaagaaatgcaat

SEQ ID NO: 66556 - DNA, 1050 bp, Homo sapiens
tattatggttcctggttaaatgtttgaaaaattatctttaaaatcactaataaaataaggtgcaccgattagttagcattgttttagaagctttgtccaagataagatatgacatagaaacaagaggctgagaaaaagtcatcgttatttgtgaagggtgtgtttgtattcctagagaaaaaaaaaacattaactgaaaaactattttacttaataggaattcagaacttgtaactggggcacaagatagcttttccaaaagtcaatagatttcccatatacctgcaacaaccacttatgaaatataatgaaaaatgccccagtcaaaaaaaatcaataaaaattaaagtatcatctgaatgaggactacatgtgacctgtgtgacaaaaactgcaaaattttattgagagctataaaacaggacatgaataattaggaactataacatgttcctagatgggaaggtgaaatactctaaatatgtcaatttataagtttaatggaatgtcaaacagaatcctaaagggaattgaagagatttgattgcatggctaaagacttcatctggaataataaacagatgaaagtatggaagaaattacaggaagaagaatcatgaaagggtactcatctttaaatatcttaatatatcataaatccttaataaatgagaataggagtcaagcagattagtgaagtactacaaatattaccagttacatgtaaaaatttattatttgaaaaatgaagaattacaaattaatggagaagagaaggctggatcaataaatgtttttgcaataacttggaaaagcatcaaatgtaacccgagtctgcaaagtggcattcagtgagatggatgcagttgataagacacagagaaggagttttagcctgcagtgttggcccactatttaacattggatgaccctccataaaactacaggtttatggcttcccttaaaaaattagaagaccaaaattcctgtgagaacaaggccctgccccctttggatggaactcatactctgtaattcacccatctccac

SEQ ID NO: 66557 - DNA, 1618 bp, Homo sapiens
tctgaagtgtctcttcgaacatctctaacatcacaaaaaaaccgcttggaaccaggatacccaggaagtccttcataacaacaaataaaatacagcctgttgacttgatgctggtctttcagtgtgctaagggtggtcttcctaacatccctagagtctctcctgttccttctcaactcttcaggaggctgatgtctggcaggaagttagggtttgtatttttcacatatgagtgtgcttaattactaaatagaaggagtttgataagctgccttccttgcttgcatttgtggtgcccccagagagctgtcaccctcctaatcagtatagaaatggccgagagactttactcatgacaccctgcatggatgcttagcacagggttgggagcctgggtggaatttccaggtatggcataggcttggtgtgtgaacttgggaaattccctcagcttgacccattttagcacagatattatatttaccctcatccaaagacaaaggaacattttgcagaaatatttcctcttttcagaagtaccttttcctcatcttccccagcccctaaccctgccctaagcacaaccccccatccacatatcagcctcagaatttggcttccaatgtatacacaaattagtgagctttttaaataccttactccatcaagtcatgcttcccactgctgggggactcattctgagttggaaaattaataacactttgttcccccatcctttctattttaccgtgagccccttaacacaccaaatcacagagctattttcatgtgaccacaaatgattatttttaggatcaaaatatatcttaacaagctgtggaattatgcagtaaacagatggcccttggggaggacccatactgctttggaagaatgcatatttttagcagaataatttgagcatcgctggggggaaaaaaaagttctggacctttttactcctccatgtggggagggccagggtggggaggaagctgacagcagaacattatagagaaggatgtgaggctaaggagagtcccgggtgttcagatgccctggtttctcgtttcccatgtggctaaccgagatgtctttgtcttcccttccctctatcttggtaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacaggtaaccagaaccccacataccctgttgatctgcatgggctcctacctcaaatcttaacccaaagttaagaagcccaatccagagccttaagcctgaagggacatttatatattttatagcccattcattcatgtagtccctctcagacccaccctttcagatgagtaaggttatatcactggggctttctaggaggaaagaattctaggaaatctcttaacagcctttctgctattactcagtctcctaagttaaattatccaggaaatgtgatctaga

SEQ ID NO: 66558 - DNA, 1870 bp, Homo sapiens
catgtataagtatatctggaggaggaatttctagaattggaagctttatgtcccaggataaagggtatgtgtattttaatgttgctagcttttatcaaattgccctccatagattttgtacattatattctcacaccagtaaaatatgggaatgcttgctttccattctctgccaatatagtgtattttcaaccttttttatctttgccaaaccatatgtgaaaaatagtatttcagagtctaacttacatttcttttgctatgaataatgccaagagtcttttcatatgattatgggctatttgtatttcttattcagtaaactgttcatatccaatgcctattttcctactgagttgttggactttggttattatttgtacaagttatttttgcgttaaggaaattaacattgtcataccaattgcagtttttcccccagattgttatttatctttcgaagcaaagaccaagacctcctgagactccccgatcctgcctactcccagttccaccagactgtgagccccttgagggcagggtctgaaccttgatcctctctgtccccagtctcctttgcagggctggcactacaagagcttccttttggggctacttgttgaactgaactgaatgcctgtgttcccccaccctgcccacctttcccttatggcttgggagtcccgtttctgcctccagcagaaaaagatgacttttctcattgctcaccacagccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggtagggttgctgcgttgtccgtgttgtgagtcctctgtgtctgcctctgagctgaagagccctccataacgtgcgtgcatcatgtgcctggctcacagctccatgctctggcgctccctccatccttccacactccacgccagctgtcaagctgccagtccacctgtgtcttcatcgcagttccttgtcactgagagttcgtgggaggctcaggaagggctcatggtgctcagcagaatcccatcccatgccttgagggaagcattaggggcttcacactgctggggtggccatctttgtgtggggtgagaggagctcttctgggcaaacctcatgggacagttgggcatctgtgggagtggggtatggggaggcaggtagatggggtgttgtaatggaaagattcttggactcttgtggtttaatagaaacaccagtttaagtggtctgtcatttactaaacgtgtgaccttgagcaagtcacttatttgcctgagcttcagtttccgcatccgcaataataacaataatcattagtgttcgtacagcatgtttgttttaaaactttttgccaaaagcatttcacatttaattcccacagagatcctgtaagataattattttataattattctagatatagaaactagaattggtgcaaaggattgcactaattaagtgatttggccagagtcacacagccagtaaatggtagagtctgggatatgagcccaggtctgtgactccagggctctcgctatctccataagcttccccacctgacttaccccaaggttacaaggccctgaaggagatgtgggtgtgaaattctattgtacaatgagacatggatatttcctatcaatgatggaaatggtggtggcattgggtttgctattcctgagtgggatatccataggcccatgttctcaatgtcttagaaatatttctaacatgccatggac

SEQ ID NO: 66559 - DNA, 1064 bp, Homo sapiens
caagcaggcaagcctgggccttgatgccgagaagactgacagtgcatgttttcaggattggaagagtttgggattatagtctcgtctctgcaacctgttagccatttaaccttgcgtgtgttaattagtcttgttgtgccttagtttctccatctgtaaaatggggttattaatacctcataggattattgtgagagttaaaggaattattgcttgtaatgctctcagcctaatgcctggcatatcattaagtactcaataaataatagttttatggctatcttaattttaattaaccttctgagccttaatatgcacctctgtaaattcagtctggtgagattgccatgaggattaatatatacaagttcccccacatactgcctgtcacacagtaaatacaattactatgggccttcatctctctgaagatccttccctgtgttcttctagcccccctagcgggtcaggcaccccctcctctaggccttctggtcttgctgaagagactttgttatttgtctgtcttccctacttggctgtgagctcactgaagcaaggactctctgatttcattctggctctccagaatctgccatggagtgggctttcagacagtgttcaccaagcaaaggagtgaatgttacatccagggtgtcatgagggtccagggacttgagcgcttacttccatgtgtggggaattcagatgggcatcagaagaggggagcctgaaccactgacaaggcccaagcctggaatcctaaaatgggatttaagcagatattttgtgctagatcacaaacattattggagatgaacttcccagccttctcaagcatgtatatctcaagggacaatgttcattcttttgcgccttatggtctctttctagattgtcgtacaagactttttagcagttgctaccttggaaaaatatctttttttttttttttttttttttttttttttgagacggagtctcgctctgtcgcccaggctggagtgcagtggcgggatctcggctcactgcaagctccgcctcccaggttcacttcattctcc

SEQ ID NO: 66560 - DNA, 1052 bp, Homo sapiens
aaaggtgcccagaaaacacagctttcttattctattactgcaataatagcagtttattctgtacaaattaggtttcagttccagttcccctacaacttgccttgtcaccagttttcagtgccctccagttaaggtgacattcctcctctgtattggtggtgggctcacctgttccctgcctctgtggctgactgcacctgatcctctggctcgggaccaactccgccatgatttaaagaaacattgagcagcacccatgaatccttgctgaaaggcctccttccctataactttgcatggcacagagaaatgattaactgtgccagaatccattctccagaaaacacttaatttgggagtgagagacagtagccctgattattgcagccaagtttttccagagacaggaggaaaagcagtatatttacttgattaaaaattacccccacgtagtcatcagtgggatcctgacaggcagttttatagcaatcatgcttttaaaagatgtttcatctattgggcaaatatctctagttcccattaccaaagtctgtcagctaatgggagcaggtgagggccctcaatttaaagaaattggcaactggcatggaagggaactaatagggaacatatagaaagaagaaaaaggcagtatcacagagctggcttaaagttttcagtagatataggaattagggaaatcagcatagcaaaatgacagtgatgatacaactgccatttactgagctcctggtatgtaccaggcatagttctaagcaaattacattatctcattcaatcctttgaggtggatattatcagcttcattttacaggtgaagaaactgagattcagacaggctaagtactttgcccaaagtcacaaaaccagtaactcaacaagctctgagtgcttttatagaaagacccaaacacagactgactgtgcctgtggcaagttgcttactggcatctacatggtttttgtttgtggggatcagttgctggtcaggcagtcaggatatgaaaggatgggggcccatgctttgtccc

SEQ ID NO: 66561 - DNA, 1098 bp, Homo sapiens
gcaggcagctagattgatcatgcccttgagcctagagttagattttgttcacagcctccagtgggaaagaaaaaatgccagtatcattaattgtagtgtggcctccatttcatcacattgtctcaaattttaccactcagatcatctgtagaatggagtatattcctcagacccctgtgtgtgtctcagcctgtgtgtggcactgtgtatataagcacacacttgattccaactctctttgcaaaaagggtatttgagaggagatggagtaggagggtaacaaagctttaaatgaaaattttaggataattagcacttttctttacctagaagctgaaaattcttcttttctaccttgtttatgtcttctgacttttctgtagtgcagtaagtctattaaatagcactatgcatacacctaattgttgaggtctgaaactgtgtgggtggtttcacatataaatctttgtaacagtctgtgtattaaacacagactgtattacattaggacatttgggtgttctttcattcattaactattaagcaatattataataatgccttatattttcaatatactttataatctctaaattctaaattctaaagaatcctcattaaatttaattcttacaagagcctgggagatggttttctattatttccatttccacagatgaaaaaactaagagtcaggttggttaagtgacttccctgttgatgcacagctggtaagggccagagctgggagccttactgtctctctacagatctgttccactgggtactaagcctggtagagaaatcagcaagggacaggaagcacaggtatgcataccatgagggcagtgtttatgggagaggggcagaaataatgataagggcccagggctgagggcagtggctacttttggctgggagtgatggtggaaatcctcacagaagaggcaatatttgaagtatgtcttgaaggatgggggaattttttcttaatagagaaggtggtgaccgttcaagcagagggcatcgtatcagcaaaggcatggaggctagatggccaggcaggctcaagagacagagaaatccacacaaagtgag

SEQ ID NO: 66562 - DNA, 1080 bp, Homo sapiens
gtgggcgcagggtcacaagtggctctgagaccaaaaaaggctgaaggattcctgaagagagctgcccatcacctcctaccccacttctaccaatcagttctttctcaagagcttagctcaagtgtcgctacttcagggaagcatctgtgagcctctcctgctgagccaggaacccagttctatgcctttatggtgcttgtggtgctcctcacaattgctgctaaatgactgtgacgtggatcgtttaatatctgtccccagcattagattatgagctccatgagggccgaaaaaatttccgtcatacttagtatcatagccacagcttcttgtgccgggtctggcgtgatgttgcatgtgtccagcaaaagtttgttcaaggaaagaaaggagggcaggatgacaagatcagaacccaacagatgttgcaaggcatggagaggggagaaagaaaaaggaaagaatagaggttccaagttctcacagagatcaaaggtggaaagtgtatatcagtgagtgaaaaatggctgctcgaaactatgtggagggaaaaccagaggagacaaagccagaggcggctgctgaaacatagccggcacggggcacaggctggctttgccctaactgctcatctgctcctaactacttatgactcaagcaagaagtgtactcttcccagacctcagtttcctgacccatgaatgtagataagaggctgctgtggagatgaaatgattctcaggcacctagttcttaatagtaagagccactcataaatgaaatctgcctgccccttccccctggcaaacaagatgtgttgaatttgagggccaagcagtttctgagtttggaaatgtgtcaaaaagaagggacccacatttactcatatattcatttttaataataacagcagcagctgcagaaacaacacactctcctaggggttggaggccctgggggcaatttaaagcccccaggggaggcagcacagccatggttggtcaggaaggacccccaactgcatctctgggtgctccttttacaacattgcccagggagtatggaaaaggagttgatttt

SEQ ID NO: 66563 - DNA, 1133 bp, Homo sapiens
agggagaagggaccaactcgctctgcagggctgaagagggaagaaaatgaacgttttccagtttgcagagcctccccatgatagaagagtttgacagtgcccttcctggcaatggaagtattcaggcagcgggttatggggtttgtcatttgatcattcatttgcttttaatttgaggagagtttaagaagctgggtacaaaagtgagggcagtgtgtcaaggaatggtactaccccctggctaatggttctaggataccatgaaggggcatgaaggggcaagggggaaggaggggttactagaacctggagaagttagccagctgagagtgctgcttgacatggatgtatggtcttcaatagaggcatggcggtgagggagccggagaacggaaatctccacctcactctcttcccaccctgacaacctcctcctggtggtggaacccaaccagaagtcacagctcaagggaaccattgatccaggccatgtggaccagcctcccagggcacagagcagggtgaaaaaggatagagagtgagtgtggaaggcagcgggatgacatctgtcttcccctgtgtcataattcctttccctagccatgcacagggctctgactgtgctcttagggacctaactaggattgaaaccccagccactgctcagacattgtcccttacctttgcacccactcagccaccaggcccaggccacttccttcatatcagatttattgagatataatgtacatacagaaaattaacacattttaagtgtactactgtatgaattttgacaaactggtagagttacgtgaccaccaccacagtcaaaacacataaccattccatcacccccaaaagttccctcatgcccctttgaagtcaacccccctctcattctcagcctctggcaatcactcatctatctattctctgtctctgtagtttcaggcactgtttttgagaaatatagtaaagaagtgatttatttactggctttaaaatcagatattacctaaaataatctccaaactcagatatttcagtgttgttgagaaattttttaaggtatcatccagaattcaagatactggggcaaacaacagaaacattctgcggttttctgtgtg

SEQ ID NO: 66564 - DNA, 1049 bp, Homo sapiens
gtgctcagtaagactagcctttgagatggggatctatggcataagtgtcatggattgagtcaatacaactaaatgacaagttggagaggctgaacagcaggtagcctctcctgttgggactgtgtggctgcagtgaggagcaggaaggaggtggagcaccctgggcttggagggaaactggcaggaaagcacgtctgaaggtagatgtctggcaaggcagtctgagggtattgtgggaaccaaggtccagagttaaaccatggtcaggaacccagggaaattctgactgagaagcagaaggtcccagccagcacagagagcagagaacgctggctgagggcgcacagacacggagcagtgctcacctgaccctgggtgcaaacacagatataaggagctcctcccgacctctgccttgatacagcagatggctccccctgtgcagtcttctgatgaatttgtaacacagtctgaccccttcctacttctgaccccttgctttggtcttttcccaggaaagatattaatccaaagagatctgtgggtgttgtgtagcatctgctgcctctatataaatcagcctcttagtaaaggcattggaagggagattggcttaaccctagaggtcctttcctgtaattcaaaggcttaaggtaggttgggccagcttgagaaggcctcgaacccatgctaaggaattctaagataattctgcaagcaaaggggactttttcagcacaagcccagtaaacagaaatagaactaactggcagaggccaaaaaagacagtgctgcccactgtgaaaaagaacttggtaaccagcaaagtcactgtggctgaacaggggctgtcttgagaagtagtaagaggtgtcactaagaatgattaatacaacatgggccatcacatgttcaagagatagagaagtggttcaagcatggatggggtttgagtggcataagctgtaaggtcaattccactcaagattcttgaattttataaaaataagtgaccaggaagatgacagtcctgcaaagagggaggtccc

SEQ ID NO: 66565 - DNA, 1041 bp, Homo sapiens
gccaagctgtggaggagctcctgacacctagtttggtcacaaccatgtgctttgaccataccccgctgccctcatgactaggctgtagggtgcagttgcctgtctgtcccccgacacagctttcaccttggacttgggaggcagcagtctggcttctggacagagtgctttgaaggcatttgctgccattggctgtgtgacagccactaggggactaatggccatggcataacttagtggtggtttcttggcttcaacaccaataaaaccccctttaaaaagaagggtattccaatcctcagttgagatacaccggcaacagaagcattggagggagaagaacaattttaagtctcattatctccagggtacacaacaggattttagatcctttccaagttactgtaataattttagagaataggaagtttattccccaagaaacagtatcccagccccatccgttcccaggaaaaggatctcagtgccagccttctgttgagttggttaacaccttctgccttgccgtgggtgggttttcccatgggtagggctgtcccatccgtgttcagtggaaacgtgtctctgtgtgccctgttccatggtctagtccgtagctctccttgttcctgtcctttcccaggtctctgtggtgactctctctatccaggctcctctgcatgcttcttctactgccgcctctggcctccaggtttgtctgggtgcctggtctgtgggcagcccctgacaccctcttgctgctctccatctgcaggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtgggtaagcacctcttcaccccagctccccttg

SEQ ID NO: 66566 - DNA, 1042 bp, Homo sapiens
cttccctttgtgtatcctgaattcagcagtattcagcacatatttattgagtgcctgctaccatgtaccacatattcctctagactctgggcacatagcagtgaacaagacagataagacttctgccttgtggaacttaaaatgcattaggaaaaagcacaataatcagataagcatatatatattggatatgtgtgtgtgtgtttatcacttcctaatcacttcctggccccttgctccggtattgctttatttttcatcagaaagagagagagagaaagagaggagtgtgtgtgtgtgtgtgtgtatgtgaagtcctgaaaaatcagtacaaggggccagggagtgattgggaagagtgggctgggagctattttagttagggtaagaagctaatagttgaggaggggaggaaggaggttatattccatgaagatattttcaggagggttctgattcataaagatagttgagggaggcagaggaaagccaaggtttagcttgtttaagaaacagcaaggagaccagtgtacctgtagcatagaaaatgaggcttgagaagtactagaggccagagcttataggagcttgtgggccctggtaaggactatggtttattctaaaatgcttatgaagccattggagggttgagagcagagaagtgatatgatccaaattacactttgggttttgtaaaatgaacaattatccccttctgtggatgcttagagagattgggtcacctgcccagggccagtgaatgatgattatgggacctgaagctagatctgtctggcctcagggcctgtatgcctcccattgggccaccaggcctcccatcagcagggttatctgcctggtgatggaaatagagccactctgagggatgtccacacctctgaagctcctcccaggcactggggaagactttaggggcttgcacaccagcagaacagactgccacccaggccgctggcccagacagtgcttcacgactcaccaaaagaggaggtccccaccaccactgcatactcagcactgt

SEQ ID NO: 66567 - DNA, 1029 bp, Homo sapiens
tcaggggctagtccaaggcctccccacatgcttagagggaaccagtctatcccctctttaagaacagcccaccacttagctgaaggttcctctccaagtactcaggaacctctttcctgagaggcagctcagggctgtgaggtcagagagatctggtttaaatcccatcttcacctaatttttcctgtatgctgggcacttaacctttctgggccttagtttccatatctgtaaaatgaggtaatagcacccaccagtgtgagggtcaagtgaatcaggtgcccacacttgagctctcagcagcagtgagcaggagaccctgcgtgactatgacccaaggtgggctctgcagcttagggtccccatcaagaaaggtgggcatttgtttctcagaagaactagacacctagagttttggggagtgggtggataggagatttgaggggaggttcctttaactggaagtcagggtgcctgggttttagtttcagctctgccactgacttgctatggtatgggtatgagggcagggcacatgtctctctgggcctcagtttcctcatcaatcaaatgacaccaagtaatttgacccagaactaagtttaaaagtacagaacaagactatttcgttttttcttttttttttttttggagacggagtctcactctgtcgcccaggctggaatgcagtggcataatcgccggctcactgcaacctctgcctcctgggtccaagcgattctcctgcctcagcctcctgagtagctggggttacaggcacccgccaccgtgcctagctaattttcttgtaagagacagggtttcaccgtgttagccaggatggtctcgatctcctgacctcatgatccacctgccttggcctcccaaagtgctgggattacaggcgtgagccacaacgcccagcagaacaagactatttcaaggcggtagtagcattctgaatagccagaattgtcttcttttttttttttttttttttttttttttaaggccgagtctcgttggacc

SEQ ID NO: 66568 - DNA, 1079 bp, Homo sapiens
cactttctgtttctcaaacacacctggtgccttcacagctctgcagttttccacaggaacacctttgctaagcacgtaaggtgctaagtgcttttatgtctctggtctcatttcatcttcacagcagttctaagacaccagcattgtcctcttttcacaagtgaggcaaccgaggctcagagagatcatgcaatttgccaaaggtcaggcagctagcaagtgtcaagcccacggggatccggtgctagagctgacagtctttgcacccgccaggctgtgagctccctggaagagctttaaggctccattggcttgcgggggacatgcctgcctgggcattcaaaatgcaggatgtttgttcactctttcacttgacaaagtgaggcaatttgtcaggttcttttggtaacttttcaggcaaaaaggctcaggtgaagacagctcttggctttaacagagaatggcttgagggtgctatttctggtaggcctaggaccagggagagaagagaaagcagctgtagagattgggataagtgcttggcttgtcagaaagataatctccccacacctgtgccctggaaacacaatccaggccctgagatgcactttcatctgtcaccatggcatccccagggtgacctgcccaagcatatccaagccagtggggctcaggttacagggcccattctcagggtccttgagtcccaacaatgcctgtttgtcctttggtactgccatctcccaggaggaatgttaatgggatggagaatggaggggggctgggaggaagaagagactgacttcagtctgagcctgctgccctgtcagcctcttgagtgagctcatccgtgaatgtctgctagtccttccaagagacacttaaaccatccccaggaaagaggaattcgtcctctgctcttctagaccagaccatcatcactcctaagtggggatgggggtcctctgtttaatgtgggacttagcctaccccttggcagaacttatgattcaagtcaagaaatatttccaaaaacagaaaaactgaaaatgacttagatgtctaatagtaggaggttg

SEQ ID NO: 66569 - DNA, 1116 bp, Homo sapiens
ttctaggaaggaagggctgccatggcaaaggccagctttacagcccactctccatccatccccttccagctctcagggagcagcccttgagcacgctgcattttcccggggtttgatgtgggaggagacaagcaacataacctgcaggcaggtgtgctggaatcaaagagggcctgatcacacctttggacagcagaacagatgagcaaatcccattcctgagcacctacagtgtgccaggggcttcgcctttctcattccattgagtctgctcagctgggaggctctagagcagaagagctaagagtgtgggtttgaatgttggctctgtcattattagctgtgatctttagcaaatgcttttaacctcggagttttcatttttcccttatgtgtaaaacagggataatattaataatacctacatcattggtggtattagaattcaatgtgaaataatatatgtgaagtacttagcaaagtgcccagttatcgtacagtcttaataaatggaaatttctatcattgttgtcatttttctggttagtgttttactcaacagagcctaagaaagatacaataacttgcccaaggtcacagagatagtaagtggcatttttgcatcccaggtgtgcctggctcttcacaatcttttctcactcccaccagactgcctcccttatctaacagccatctctccctttcttgacaaccctcaggcagccatagggtctaagggaacctctaaagcagatcagggatttattctccccccgccctgcactataccctaccctgctgcacagaggatcaagctgcatgcacattttgggagcagtttatgacccctggccagaggcccctgaatggaaaccgctgagttgcactccggctctctgctctgttcagatgcctctattgggccctgtgtggatgacaagatgatgcatgaggtctggctaagcagcttatttgtctgagctggtgatggcctttgtcctgaggtgggttaatggtaaggggcagtggccctttaaggcctggacaatgggcaggcttctcaggtcatcaaatcactcagtggaatggccctgagtcccttagagccccctcaga

SEQ ID NO: 66570 - DNA, 1041 bp, Homo sapiens
gtatggcagaagagctccagggtgaccagcttgtatcccctgatcaggtgctgttagacttgagccaaggtgcttgccctctctgtccagcagaggccagtcagcttctttgcaaggaaacccaggaaggaattcaaacctctaagaggtggggcaggatgtacatgaggtaacctaggatcaccttaatagccccaggatttcctgatgtttggagaagagaggaaatgaaactgtttccccacaaataacactgtaggttttgtgttgatttggcaaacatttatttataagtgcttgtgtggtactaaattccaggccagattctgaaaaaggaggcagaggttcaaagagggataagacagtctatgggctctggaaccaaacagctttgaattacatacaagctttattgctgtgggacattagataagtcacattgcctctccaggcttatttcttcaagggtcaagtggccattgtagtgcccacctcatgatgagcacccatcacagtgcctggaacacagaaggagtgtggtaactgttagtcattgcctggtcccctccacctgcctctaggggatttacagacagcctgtctgtgaaagctcccagcacactgcttggcacttggggatgctccaagaaatgtcagatgccatcttttctcttgggagtacatcattatagccgaaggtggcaaaggcggtaggaacctagtatgttctgtgactgaggaagaagcctctactctgcctaagagaattaggaaatgcctcctaaaggaggcacttacaggacttgaagaaattagtgaggtgtgccagacagagattaccaagggtgttctgggcagagggaacacatggacaaagaacttgaggtggggacaagggaagcctgccccagctcttttaaacctgagagcctgggctgtaaataggtgtgaaccttggaagggtatggaaggccatgtggtgaaagtcacctgagctcttctgagaactggcttgagttcccccaccaaatgacaatgaag

SEQ ID NO: 66571 - DNA, 1040 bp, Homo sapiens
tcacactactgcactccagactgggtgacagagaccctgtcaaaaaaaaattaaaaattacaaatgaggagctggaagtatttttcctaatatcataaaactaataggaggtaagtctgtgatacaaaccccaattctgttgaactccaaagctcattccacaagtgcactgtaccccaagaatatactatatactttcatgtaggagacagatacagataaatagaaatatagcagagcagatatatcagaactgaagacaaggttaattcagagaaaggaatgcagaatgttcagccctctagtactgggtggtcagtggtgtcagggaaggcaggctctcaaggtgaatcgggaatgctggcttaaaagattgtacggtgaatcatagcctgaatttttaggtaaagaaaccaaaacacagaggaagaagccacccagaggttgtaccttggtcatttatttctgctgcttcaattcttcttgctgaatttctaatatcaaccagccaagtggcacacacatcaactctgtaaaatgttgtcacataaagttaagctcaggggttaaccttaagagtcatggaacctggggccaggcacggtggctcacacctgtaatcccagcactttgggaggtcgaggcaggcagatcacgaggtcaagagattgagaccatcctggccaacatggtgaaaccctgtctctactaaaaatacaaaaattagctgggtgtggtagtgcacacctatagtcccagctactcaggaggctgaggcaggagaattgcttgaacctggaaggcagacgacgcagtgagccaagatcacaccactgcactccagcctggcgacagagcaagactccatctaggggaaaaaaaaaaaaaaaaaaaaagtctgggtgtggtggctcacacctgtaatcctagcactttgggaggctgaggtgggtggatcacaaggtcaggagttcgagaccagcctggccaacatagtgaaaccccatctcaactaaaaatacaaaaaaagaaaaaaaaaa

SEQ ID NO: 66572 - DNA, 1048 bp, Homo sapiens
atgctttgggttttcttccccactggttggttttttgcctggttcattggttacacgaatccctgactgtcactctaagatgctatggaaggagctttagctgtaggctcaggaggcctaggctggaagcccagatccacacctcactaggtctgtagctttgagcaaatggcttcactttgaacattattgtcctcttcccagggctgatgaaagatcaaggaagtaaactcataaatttacaaatgtacattattatgtttattactattatttattaaggttattttagtcggaagcatgtgggcatagggttcagcagaccaagattcagcacccagactggtacccaccggctgggtgaccttaagccgcctctgtttgagcctccaagtctgtatctgtcagctggagaagtcttcacactttcaaggggcatgagggttgattaagataatttacatcaagggccttccacagtgctggacacatagtaggtacccaattaatatccctgccctcccaccctcccacagttgctggtttccctcagaatcttcctatctcttgcccctttcctttgtacctaatacccccatcattcctccagtatctgagtaggaggctggactattagattctggtcttactccatcttgaggcctggaattttgccactgtataaattgaatggagggaggaaaacatatatatatatatatgtgtgtgtgtgtgtgtgtgggtgtgtgtatcccaaggaagtaataaatgacttgaaaacagctatttggaaggactttcttagtcaaatctcagtaccaaagtgcagagcccaagcctccctgttgaagagagcactctgtgaccacagattattcaaggtctgccataaatttcagtgactccttggtcacgttggccagcagattttgacagtcagagataatccagcttgctttgtgcgtttcctctctcccacatcccatggaaactggcctttccatcagcccaatttcagcctccagaggtgtgaatgaaccatctcaca

SEQ ID NO: 66573 - DNA, 1039 bp, Homo sapiens
ccggtggtccagattccctcatgaggaaggggacttttgtaacttgccagtcaggatcttccaactgagacacataaccacagtgtggctagctgagcaaagtcaggattctgttaggagggcagtaggtattgctatgcaaccaagagtggctgctacaaatggaagataatataattagctctacttcccccaccacaggactgtcgtggggatgcaatgagataatgggtgtaaaaggattttctgaatcatagagtgttctgcacatgggatgggttgttactatccttatagaataattatatttctgttatagaataatagatgacacttgaatgcagtcatccatcctgcttgtggtgtgctttcttgttcatcatcccctcctcgcatacacacacctgtcatagagatataaaaatcatcagcatttaaaaataggccagatacttcatagtaatgaggttatggatgtcagtgctctctgcaaagccgtatacatgggggagagattattgtgggatataacatagatttggaaatcagtcacaggttccaatccagcttctacacctttcatgccatgtaactttagatacattatttaatttctctaagcttatttctccatctagaaaacaggaataataatctctttccaaaggtttctgtgggaattaaagataaagtatatcaacaccatacctggcacagagcaggtagcaaatcaatgacagcaaacacttcagtagagctctcatagaactctttaagcccctgtacaaccctgtgaggtaggtactattatcccttttctataagtaaagtaactgaggctcagaaaactaaaactttgcccacggttgtacagctactaagtggtggagcgaggattcagactcagacatgagttcatgttctgaccaccctgctaagccagacttcgctactgttactattgttgatattaatggcacaaaaccatttccactgctgccttcctataggaccttgggctcattctgtcaccttccag

SEQ ID NO: 66574 - DNA, 1028 bp, Homo sapiens
gggtattgaaggtcaaagaaatagtcaagcaaaggccagaggccaggaaagtgccaagtgcctcgggaaaggtcacagggagctaactcctcagacccaggccactgtgtggtcagtaactgcgagagctgccctggagacccttgcaggggaccagcaaggacaatgctcagggctgctttaaaaaggctgagctcagagactttgccagagcatctcagagaataacaagtttccaaagggcaggagaaacagggatttagcactaatgggcactgcagggtctgggacatctcagctgggcatcaggaaataatttttgacgtggagagccatctgttgcgctttgtataagcccttctgagggatgtgcataagtacaggcctggctggattgttggatgttgcagctgggtggaaaattggcagcaagaagaggaacaactttccagtgagtgtgaatgcatccctgggccacagggcctattgggggtgtgaggagagccagaggggcagggcccagcatgaccacttgagatgctgtgattcccggactcactgcaggggaccctctgagacttgcgcccagggtgtcagccagttgtcaatcacttaagcagacaggaaacaggagcccagggtgagtccatggactctggcctcatccctgaggaagaggacaactcctgattactggttttcagaggaggccacagccgcgagtggacctggagctaatgtgggacaaggcctccaagcatgtattgtatctgccttgttagacaaggagtgtcacaagaacaggggtggctctgctcactcaccactgggtcccagtgcctggcacatggtacttgccaaccagaagatgcaaggattattactgattaaggcaagtggcatttccttggagggagactgaggatgccaccctctccctgccccacaagcagtctgcaaagcggatattattatcctacttatcggttgaagaagcaaaagcctcagaatcattatgcaaccaaact

SEQ ID NO: 66575 - DNA, 1011 bp, Homo sapiens
aatcactgccaggttacagtctgatctcacctatgcagcatttatcatctctctgggccctgtgtcctaacagcactgctataaaacaagtattcagatgcagaacattattgctcatgtgtatttctttttaatatcctttttctaattatgcaagttaacacatggtagttgaaaaagtcaaagaacagagaagcatgacaagtaaaacaaactgaaaatccccggcatgaacattttaaatatttatatgatttttattataaaagtaataaaatcacatggttaaaaattcaagcgctgctaaagggtgtaaaatgaaaagtaaaggtctttagcatcaacacccatcctgtcgttcacagttttatatgtatctttctaggaatttctatacagactcctatctgtgtgtttgtgtactcctttcaaacacacatggaatcgtatactttatttgctgctctgcaagttgtttttttccactgaacagtatatctcgtggattactccctcgcagtatatttagatcatcctcattctttttaacagcttcagaatagtccatggcatagggtgccccggggttttctgtcttccctgtttcaaacagcgctgccatggagattgtcctctgtgccagcggcagggtgctccggtcctattgttctcagtgggaatttgaggacagacattcagagcaggtgggaggccacagccaggcgaccccaagctgagcagaagagactggagactcatgatgcgaagtcagaacacctgggttccaaatacagctcagccactctgtctgagtaaccttgagctgtcttctttgacccatgcttcttcagctataaaattatgggttagaacaaagtgactcctgtacctctaacatatctgtgagtctaaaacttaaaataagttctaaagtgaccctgggacccaataaaggaggccaaaatgccaaatcatctttttttttttttttaaacaaagcctcactcctgt

SEQ ID NO: 66576 - DNA, 1129 bp, Homo sapiens
ggcctcccatgtgtttgagaagaactcttctttggcaccttcacatcgcaccccttgttaatattctctctgactacaagccactgggaaggtggaaccatgccccggcccttacagctggagccctccacaagaccaccattcttctgccccagggtcatcccaaagctgcaaacccttaatcactgcactgtctacagtgtaccataaacatgctgtttcctagagaagggaagagaaggagcctcaccttgactccatgctaaccttgattcctaggccccaaagcagcactgcttgggtccactatttaatagcttcttcagcttcccaataaggctcagagctgaccctgggcccaggcaggagagcaaaccttcctatcccttctgggtatcctttgctgtgtaacaaactatcctaaaacttaaaggcttaaaataacaaccatgtgttatttttcataattctgtgggttgactgggcagctctgtaagttctgctcagggtctcttatgaggctttagtcgcatggtggctggagctcttggctggggctaaaacatcgaagatggctttactcatgtgttctgtgccttcacagggtcagttggaaggctggcaccgctgtctctccatgtggtttttccacttaactagcttagacttcttttcatgatagttggatctcaagagtgttccaatagggaggaagcataggttactagttctcttagggtgtgggcccagagctagcatctgctgcattcaattagttaaagtagtcacagggccagccaggattcaaggggaaagaaaataagccctagctcatgatgaggttagtgacaaagaatttgcagccatctttaaaatccactgccattccccctagtttttgaggctgttcctaaggaaacagtcctccttgcggctttcttctctccacgtaaatcagctgagcaaaggagcagctaaggagctgatgaccttacataagcgatctcagtttaggctcaatgggaaccactccactgatctcttatgagtcttactgcaattcagccaggtaggttttcttatcccccattgtgcaggtgaagaacctaaaattcagagagcttaagtg

SEQ ID NO: 66577 - DNA, 1015 bp, Homo sapiens
catgctaccagaaccattggccctccccacttacctgctgccaagagtcactacttttacgacaatgccaccagccatgggcatcagctgctgctcccactgaccttgtaagccaagttgccaatcctcatagcaacttcaccctggcagaactgtgctggccaaggcgtggtggacagaacaagcccaggatgataacaccactgagtcccactgttcttacctaaaatatagcagtttttcaagcataatcacttcggagatcattatatgccttttgtcaatttccagaaaattaaaatagttatttttgtcaattttgtcaaactttacatttccttttgagaagagatgatttgtcaacctcctcatttggccataggccaaaatcccccctataatttctaaagtcctcttaaatctcttttgattctaacaacgtctaggtgagactgacagagcaatgttgttagtgccatttcaaagataaagaaagtgaagctcagagaggctaagtgacttgcccagtgtcctccagcttgaaactgactgagccaggttttcagcctggatttctgtctttcagtgcttttctactgtaccatgaagcctgggtgtggttccattgaccactgagcaaataagctaccttagtcagcttggggtgctataacaaaataccatagactagtggcttgaacaacagacagttatgtctcacatttcttgaagctgggaagtccaagatcaaggtgccagcagatttggtttttggtgagggcatacgttctggctaatagacagcagccttttcactgtgtgttcacatggcctttcctcggtgtatatacaccaaggaaagagagaagagagagagaagacttctcttttcctcctcttataagggcactgatcctgtcatcacggtcccaccttcattacttcatctaaacctaattacctcctaaaaaggctctaccttccaatgccatcacatcatgggtagggcttcaac

SEQ ID NO: 66578 - DNA, 1005 bp, Homo sapiens
tccaccaatttaaatgttattcttgttcaaaaacaccttcacagaaacatccagaataatgtttgaccaaatatctgtgctctgtggtccagccaagttgacacataaaaattaaccatcacaagaactcatcttttaagcttctaagaaaattcaatgttctatgtgctttttcacattcagagttttctgcaactctattctttgtaacaaaagatagcaaagtttctaatgtaggccttaaggcctgtgcctgtatatctaaatttggtggatatatatcccaggcctgatgcaccctatgtggctttgggtggtgattgacttaacctatctgagcctcagttatctagtgtgttaaataagagaatcacgtctacacctcatagagttttggtgaagattcacaggaatcagatattaaaatgccttgtgtgatacctgaccaaggttctgaactcagtaaatgagcctgccctgtactttcctgccttcttagtattgctagagcatcacatttagatctgcgtatatcatagctatcctattatgtgtttggggtcatgaaaatgaatactccatctttatagtttctgacactgaccatcaaccaacttgaaggtatcccaataggtaaggtgccacccattttcttggggttgcaatttctaactgaaggtagaaagggaggtactgagtagggggtagaaagggaggtactgattagggaggggaaaagagaagtggtgaggaaaacattatgactgcctcaaaaagcaagtattcccctcccaggagagggatagcttcccatcacctggctactgtaggccatgttttgctgaaccagaaagcaggtagagttcctacatttctttttgttggtgatttctaatataattctgttgtggtgaaaaaaatactttgtgtgatttcagactttttcttgacttagctctcagcttaggcattgttagtgtatagaaatgctactgatttttgtac

SEQ ID NO: 66579 - DNA, 1009 bp, Homo sapiens
tcacctttatggaaagcaacttggcaatatataacaggacactttaaaatatgtccatcccttggccccattattgtgtttctagaaatctattccaaggatctcattcgaaataggaccaaagctttatgttaccagatgttcatgatgtcattatttataatcacaaaaaaaaatcagaaaccagctccatatcccacagtatggaaaatagtactaccactttatggcataccaagctaatgtaatattataaagttacttaaaatgagtcctacaaagaggctttcatggcttcaaagtgtttatcataaaatgttaagcaaaaggtataaaactgtatcatagctatgtcaaaactatgtcaaaaatatgtgtatatataacaaaatgttaatagtgttgtgtgaatgatgtcactacagttcattttcctttttttctaaatttttattattctatgtttaaaatacatgtttctaaagaagggaagtaaaagtttgctggcagccagaacgagtaggacccatttgtctttgcaatcaccagggaccgcctgctaaggaagcccgttaaacccggggtggcagagcccttgtgctgaaatcgctctgtctctggagcatattttttctttgctaaggaaattgctttccataaaaccagctctctgacacctctgagtaccagggaaccatgcaagcccactttcctggggacattctctaatgggtaactccatcacgttccagcttggcgcttccaacgaatcccagccagccataaaaatttttagcaccctgcatgcaagactgattccagcggcctcataaaaatcccattcactgaccaagagctgcgggtttgaaactctcaagtcccctgctgttttaaacccagtggcttggcgcattgctaagtgatgcctggtagaactccaggcatcaagtcaagacagggatccagggcagaactggtgggaaaaaaaggaagaaatgggcctgtgccg

SEQ ID NO: 66580 - DNA, 1073 bp, Homo sapiens
tttcatgttttttttaatgccaggaaaaaaaaaattgcatttacattccagggtttaaaggctttcagaggtgggatgggaaggaggaattagagctgcaagctattgttcatgcttggctgatatttaatcagtttgttgggtcataatagagaatacagctccaatgacacataaatttgaatgatcaagtcaaagccagtgagtcttcctcattatttatcttacagtagagataaccttttcattattgaaatagaattgccaaatgagatagttaatattaaaacagaattagcgacatgagctcaacatttggaaataaatttctaatagtgctttttgtgtctgcaaaattagtgttcggtgttgatcttgcagtagtgttaattgatggctaaggctggtcccagctgccctgctctccagcaagggggctctcttgatttctctggatcagtaacacacactaacatcatctgtgccagaagacaagaagctttgttttaccctgagcgagagccattgttgatctgttctatttaacaaagaagtgatgagttttgggaaagggcaagggattgtggggataagaaaatgaatgagccgtggcagtctccacaaagctaacaggctggcagggtggtgggatattgagaaaagtaatagcaacagaataccaggtactcaggtgcctgaaggccttggcacctgtctttcactttcacctttattccccacccccaggctccaggcttacctttcaagatgcaattcaagtcttgtttctcctaggaatcttgcttggaggggatgttcccttaactcccaatgctgccttctaatttcactgtctaatgtcatagtgtctgtgtctccacttcctcaacccccctctcacaagactgcaaacttgaagataatgatggcatcttatttgcctttgtagcctcaacttctagcacagagcctgtacatggtatagaacacagtgcatagtgggtgatgaataaatattcactgaaataataaattagaatgtgggaaaagtacttagagagcaaagtaaagga

SEQ ID NO: 66581 - DNA, 1914 bp, Homo sapiens
aaagtgctgggattacaggcatgagccaccacgccaggctgataaaccttgatttgaatataattcaccctcattttcatttatccctaatgtgagggtggtggcattttcttgacaaatggggattaggaaggtctagcaggtatcataggtatatctgagaccaagtaaacattcattcaatagatgaataaattttttaaataaatgaaggagtaaacaaatgaagtggttatgttagtggttagaggcacaggatttggagtaataattcaagcagtaatctctgtcaatcctttttcatgcctaaggttgtgacctcaggcaggttacttcacttctctgagcttcagtttctcatgtgttaaatggaggtgctaaactttgtcttacagggttattgtaataattagagataatgtctatagagtagccaacatagtgagtggcacatttatgtgctcagaaaatggtggttgctgctaccatcatcatcaccatcttcatcttcatcatcttcaccttctcaatatattcatcatgcttatcaccacaatcttcatccatcatcatcatcaccatctcttcattgtcttcatcatcttcattttttacaaagttaatttttgtccttatttggtatatcagtttctgaaaaccaaaaatgctatcgtgtgtgtcttttaaaaaccttttatttggaaataattgcatttccagacaggaccctttattctgcagttggcagagtgattgccacagccactgccacactgaaaggtttccagggccatgtgaattgaggaatgcatgagagtgcggactgctctcccctggtcctgggactcattatcttgtttgcctttaatcacaaatctgcacaaagatcctttgccgggactgtttactgcatagctgagactggtggcacatcctttgaaggtctgtggatgaacagctgtagagaagggcaccacagggtcacggaatgaaaaacagattcacattcccaccttggttttgtgtcgactattgggcctctctgaacctcagtttcatcatctgcaaaatggtatctttataacatcttccaaggttgctgtgaagattaaataatacaaattcatatatgtgaagagtgaaacacagtgcctgatgtgaaataggtggtcggtaaagcatcagattatttggtggaggccagcaaggtgattggacctccctaacgcttatgttaggacttaagccatccatctctccatgactatgggttatctcaccatcaatgtcccttggtttctctagagacagcacgattgagccaaattgtctgcgtatcctctgccaccctcatgccacacacacacctctccctgggtcttttacttgctcaacccaaagacaaagggattttcttctgaaggtgatttgtactttaaaagccagtatgctgaagtcatggcattctagaatgttagtactgtaaggaatctctgatgtcctcttatctaacctccagacctatgagtgtctcactttccctttgaatgttctggaggcatcccacatcatcatgtgatcacaattactcacctgcagctgtggcagtgggcaccccatttataccctatgaccatttcagtacagccagcccaacttccaagtctactttcttctcctgaagctctttctggcctctaaaggcagctttgcccatacatggagcagatcagaagtgaaaaggtatgaacaccccctggaagcagcccccaacaaataactgatgggcaggcatataaataccccagctcccccgcccaccatctgatggcacaattctgcaacacacccattcttaggggccttcccttccctatctcacatccccactcctttgcctataagtagtttact

SEQ ID NO: 66582 - DNA, 2175 bp, Homo sapiens
tgttagaatctatatagagtggccagctttgcacagggttgtttggatggaaggatcccaggaaatttatttgttttgcccttttaccagagtccaagaagctggcttttctgctgcgtgatcatcttgattaattcattttgtgaaggaagccactctgtaaggtttggggatcagaccacccagtacttcattcaacctaacaaggagtgattgaatcccttctctgcgaagctggactaataataccctttcttggttgctgtgagaagtagctgaagtaattcatagaaaggacccaacagtgcctgacccaaagtagatattcaaaaaagcactaaaagtactacttctaacaccactgattaggttctaggacgtctgatctctccaaagtttgactttgaagggctggaagatgtcctccctgctcaattccttttcctaccagatgcctttggtagaaaatagtcctatgcactgtgtccatggcgctcttgttaagccttccttccactcgcttccttgggcaattgttagttccctgctacctgatcactgtcagaaagagctctgccttgaattccatctgcacacgtttgcttttgtttctccctgagataacagtgcctggttgaacaaccctttcaagttggttttactgtaatcactgttacatttttaactatttctggcctcacacccagggtcatgtaggactggtagaatacccttaatgaatgttatacataacaaaatcgactgtaccacctgtaattcctttcagaactgggacatttgccctcgtgttcacacctggccaggcactgccctgaatcctgctcacacatgctgtgatcactgacatcgttgccctcgttggagcacagagaatcgaaggcttacagcatctagaaatatttaagaaaagagaactggatgggtctgttgtatttttttcctcagggaagacaagtagacatgcatacacaacactcccccacatacactcacaagcagagtgcatgtgtcccggagccagccccgtagcacacacacagattcacattcattgtaatcgagagagatcgggtttgttcctgttgttcctgtaaaattcccaattagcctccattcagcagagagttgtcagcctgacagcacctcattaggacatcccactccaagcttcaggaatgttgattcaggcagattagccgtaaagagcaaatgcccacactggggagccagatccttttggctttacataaaatgactgcccatgggaccttacacaggctactttctgcaacctcagtttcctcatccagagaatagagataataataatacctaccacagagtatctatccttgccaaaggctaaatgagctattaccaggaagctcattaaatgatagctacttatgctgtctccatggccttgggcaaatctcccaaactgagatgataatccttgtcctacagaagtgtttacaaaacttcacggagctagggggatgtctattattattaattattattaaaaagcgcagaaccgtccttagggcctgttaggccacacctatgtgaaagcctctagatgtccccttctggcagactgaatcactcattcattcattcattcattcattcattcattcattccagtgttatgccaagtcttcctggatgtgataggggtaggggaaatagacatgaatatgacccctaccctgtctcagggaattctcaggctagtgtgagagacagaggggtacttagccaaatcttatggcaagaagtgggggttctttgaactggaagagtctccccatccctttccttcctcccctggcatcctccaggggttcccaaaggagcatgccaattctcaaaatgctgcctccggcaggtttttcaagggatgttgctgtcttcaagagaggcatatcctaacatcttcccccttcttctgagggaggaattggtctctctctaagatgctggtgacaagagccccgggtaagaatcaagaggcctagacccattgctttctggtgtgtggcccttggccaaactgtttggctcctctgagccctcatttccttctgtagaaaatgaggatagtattctcagtattgctcaaggtgaactctgcagtaatacataaag

SEQ ID NO: 66583 - DNA, 1072 bp, Homo sapiens
gcctatgagaaagctcctttccctgctgactccccaccctggctttaaattcccaggttcagaccctagcctggaccatctgttgggtgcagctgttgcctatgagccttcatctctcattacttcttttccctattgaatctacttgggctcctgtcctgaaaattgggtatctcccctgccccaaatacattatctgtatgtaggcattttgtcagtcagcgagcctttgctgagctcctctaatgtgccaggatttgtgctgtctgtatccttacatctctttatctgtgacatcatttgctaagtacttctgagcccctcctccatgtcaggcactgtgctgggtgctacggatacaagattaagcaaaacaagacgtggtccctacaatgcagtgggagggacaggctttcgtcaaataatcgatcacccacatatatgtccctttatccaccttcgtgtctcctttctctgtccttctctgccttccccccactttctctctgtctcgctcctctttttgcctctgtctcctgggtctctctggtgctttccatcctacgccccatctatatccagcagggccttggcgggggcctgctgagaggcttctcaggggcgctggatcttggtcagaaatctgtcaccctggcttcctcctggtaggagaattactgtcgtttaaggaggtctgccgaggctgtttgacaggagtcggctgggctgggcagtaagtaagaaggatcactccttcctggggattgtggaaggatacggggcccataaatcatccaccaagagtcctgcctgagcagcacacggcttcactctgcttggcatgcagctcgaggaaatttctaaaattggagaggactgacaccctgagaaggacaggctgccagatatccagtggggagctgtctctcctccctgcctgctgccgagtttcattggtggtatgtccagccgaaatgactctagctttttgatagcagcacagccttcccatagaatcaagctagggtggctcccaacctagcatctcagccaaggcagtgagagagggctt

SEQ ID NO: 66584 - DNA, 1051 bp, Homo sapiens
gtccttgcatgttctagagcagtactttttcaagtgtttaggggatgtgctctgcaagggatgaggggaccttagccccagccctctgtagctcctcagaccccctccagtagcctctgggatcctgttgagcacagtgtgaaagccagttttgagcagaggttctgaaagttctatgaaaactagttccccagatgtcctgaggaataaaggtttccaggtaagtttgagacccttcgctcaccatgtctgctcttagaggtccgtgcatatcatcatggtccacgtatgccagtcccacagccatgtgctcaccttgttatccaggcattttccaggcccgtctgaccacagacagctttctatggagcacccgttagcatcttacagatagagtgttccaaaagacagttttgagatgctttttaggccccatagatacctaatttaaaaaaaaattttttttaattaaacttccacaatattttctacatggtggtttcagatttcttcagaacattttgttctttaaaaaaaattcctagaaagctaaaaatgtctgtaattatcctcacaacaagagcaggatctccagcgtgtgcctctgagtgctggaggttaataaggattgcgccttcataaggcagcagaatagcatttgtggttacactagttaaggatgctacaaattacaaggccctctcagccccagcatgcagtgggaaaggaaagacagtgaactcagaaactgacatgcagaagtggtccaaccactgtacacacttcagggtggtagtttttaactttttccatatacatgatgaaagcttctttgaaattgagccttcataagtgggcataaaatgctgaaatttctacaactgtaaaaatgcttgtatgtcgctctgcagtttgcaaaaatgctttcacctccatgtcctcaaaatagacctgagtgagctgcatgttattactcccattttacagataaggaaactgagaatcagctcctaaaaggcagcatggtgacccaaccctgctcttttcacgc

SEQ ID NO: 66585 - DNA, 1022 bp, Homo sapiens
cttccctggctctttctcttctatgaggctaggcttcttgcaacctacctgccaagttaaactcttgcatagttttaagatggttttttcccaagccaggatttgaacttctgcagttagtgcccagaggtcttggctttctctgtttcccccaaatagggttctgtcctattgcagctagaaaagcaacagagagaaatgaaacggaagagaaaaaaaggagtttctgcccttcagagagagctcaactgcctgtgtgttgctcagcctcccttccctgttcacaaaaagtcaaagtcatcacctcaaactcaaatctatttttaaataagaaagaaggccagtgaagaggggcaggcaagatgtggccaaggaaggcattggggaaaaggtaacatttgtactgggagtttggtagatgaagaaggtaagaaggagaagtacagacagttaaagatggcattgaaattccagagtcccagaggaggagtttgcagggacagcaggtggcacttgatgagttagaatttcagatgtgatgagtttgaagcacctgggaggcatctaagtagacatgattaccagacacctggagctgaataagaggtcctggagatattgatttagaggtgattgttctctcatccatgtatccattcattcacccaggcaagggaaatgtgtacagtacctactctaggcaggccctatgctggatattgggaatacaatgatgaacaaaacagatgtctcaggcgatggttgtctccggcttcctttgtccagctttgactttgcaggacctctgggtaggatggtctggccaaatgtccctattatgctttccctggagatgtttcataaaaagaaggcatcttagagcagaggctgactgtcaagcattggttctgagtgcaagcccttctctctgttccacaataggaatcattttctagtacttgattctgatttgattagggaaggagtctttatgatgattctcatgcaggtcaaattcatga

SEQ ID NO: 66586 - DNA, 1016 bp, Homo sapiens
gctttttatagaagtcttttttttttttttaatcattttgcctcttttatttagccgagaatatagtagtggtccccaaaagattcagtgaataggtgaattttcatttgctaatatgattcatcagaataatataagctagcattagcaagcactgagtacatgtctgacactgtgttgaatgctttagatacgtttccatctcatttcattctttcacagtttataggaggtactattttgtttgtttgttgatttattttattttactttaagttctgagatacatgtgctgaacgtgcaggtttgttacataggtatacacgtgccatggtgatttgctgcacctttcaacccatcatctaggttttaagccccacatgtattaggtatttgtcctaatgctctccctccccttattatagatgtcttaagtgaaggcttgagtgtctacctctccctctgaggggttcctgcccatctgctgataaaagggttcttttctgtagaggagttctactggggaccatgtgcaggaccaacacactcagtcctatgacaacatccacatctgaggatctgcagtttataagtcaaaaggtatcttcttgcccacagagcctaaaactggcttctttctgcgtctcacagcttcctgaaagatcctgaaatgtgagccaggctgacagctgtgctgacgtacagcaagtgtggggctgggatttgtcctctgttggtggcattcactttgccatcaccacaacaccaaaaaccctttgaggctgtaaggcaagtgggcatgactcagcagagcaccaggcacagatgctgcaaatcacaaaatcatttttgctctggatagggcttaagggttgtttcttcacctagctagaaaattgggcaaaggggacagggcttaaaaagcaggtaacagctatttaagctggaagaatggggccccaagttccaagagaactttctgcattctctttagaatgctccaacacaagccccta

SEQ ID NO: 66587 - DNA, 1887 bp, Homo sapiens
aaaaaacaacccagggcaccttattcgctttattcacttcagcatccatttattgagtgcatccgtaggatcaggccccggggatacaaatgtgtttggggttaggggatgcagactaatatgctgctgaaatgtgttttccgttttaacccaagtagtctgcgtaatcctcaaatcactgagatgttgttatattcacccctactttatacatgggaaacctaaaaatcacaaaaacaggagacttatccaaagccacacagctcttaaggaatgtaataggatatgaacccaccctgcgtttagtacgatgtgtttcctccataatagtttcaggcccagcactcacaagctaactgaagcatagcacagctagaggttgcagaaaccatgtattactgacatattagcaaaacagaccttggctaaggacagttcctctgcatcctttggctgaaggctctaccatcttccctacccagtcctgccgcctcctatgcgccccaccctattcccttgtcagcactgctgcacagggatccctctgacctgattagctagatttggcctgctagatgtttttattagtgccctgaccttcttgccaagcagtaatttcacaaacctgtgactttggaatgacattctttatgtttgtgtttgtttttgaaaatatgtagaattcatccaaaattcacagccctgcttttgtgtttaactgaaacgtgttgaaagatttaaggataattattgaatattttccccacatgtaaacatatatttggtctaatgaggccattctttaatctgatggggttgggagagctgttagaattagcagcctttggttcagggagctcaggaatccccatccttgggaccgagtccagatgtaaccctggaagcatgaagttcaaagtcagtgggattatggcttagtgcaaaaccggcaaaatatgtcaccagttcacctcctctagacagtgagccataagccatggtctgcatgcagtttgggttggcatcagtacagagatacttcagagagcagaatcaacaggttaaatcctgcctctgaggccaaatggagataagaatagcactgtggggcaagagatgggggtggttattataagctattttcttttgactccggatctcatgttcatttttctaggcttatttgttcattcagccattcattcattcatcagatgtttatagagaacctgatatttccatgtcctgttttagtgattatagacaaaaataaggtttctgtatttgtcagcataggttaacagctaaattaacaacagagggttaatttatggtgcagtgacaaacaaccctaatatatgagtggcttaacagagtttatttctcatgttatgtacccaacatgctttggggctggggggagactttgttccacacagtctctcatggacccagggtgacagaagctccaccatcttgtggagctacccactctggagcaaatagcctttttggctgcttctcacagcccataggcctgaattactcatatggccccacttaactacaaaggagcagggaaacgtgcaccttccatgcaccagaagcagaagagaaccagacacaatgagtacccaaagtctctacacaacatagaataaaaagatctgaggtatgaacacaatagaacattatcctctgaggtgtttccatctagcagaagagacaagtgaacagacttaagtaacagctgagggaatccaacaatgtgttggagagggggaagaggaattgtgctgttagctctgagaggagggagccatttactggaatatcccagagtggggtgggattgctggcagtctagccaggaaatgtcatggcatg

SEQ ID NO: 66588 - DNA, 2006 bp, Homo sapiens
tgatagctaacccagggctatccaaatccaaagctcttaccctagtcatattacctgatggagacaggaatatagaactacttgagtgaatgactgccagtaattttacaggttaaaaaggtgttgatgtatcagactagcccctgcaaacacacacttggtgactccaacttataagcacatactctggagccaggctgcctgggttggaaccctagcacttccacttattagctgtgttaccttgtgttaaacaaggcaggtctcttcatctctccatgcctcggtcttctcacccgtaaaatggggataattctggtatctctctcacagtgtggttgtaaggattaaatgaggtaagaaagttaaagcacttagaatcgtgtctggcacacaggaagtgctatttaagtgtatgttgttaaatgcattgcacttcgtgatttacaaagtgttttcatattttgtttaacatttgtgacaagctttgaggtagatatcggcctcattctcatttggaagtgctcttgagatcatgcagctggcccatggaggagatgggattcaaccccaggtctatctgactccacacgcatgcacagctgttcataactctctctggcagctggtcagcctggctctaactgccagagatgattccctaggtaccaggaccaagtgtgaaaaggctccagtcagcctgattttcttcaggccactttctcccagtttgctctgtgagaaggatccttcttctggaagaaactctccctcaaataaatagccaaatccttttggtcccaaacaccgaagagggattttctttctgccattgctcagcagcctggcttctaaatgagtttgctgtacttagtttgtgtagtacctaaactacaaaacaaattgctttcctgaatgtgcctccaaaaaggaaataagtgtatggaacaaaccaggttcaaagcatggtataaacaaagggaaattgtttgcaattccagctgcttgtaaagatgcaagagggaggagagaagagccctcatgggtgtgaagtgggctatgaaagtgcaaaagaaggtgcttcaaatgggaaccaaatgggctaagtcagaagttagacagcaattagaagtgaggtgcctccaggcgtctctctctcactctacatgcggcctcacctggtagcaaaaagagggaaaccgcttaagcccaaaggatttgcccttctctctacctgcatccacagccttcaataatttataaccccagcactagagctagtgctaaaagatggattttattttgaaaaaagatcgtgtcacttttttccccagatttcaaaagctcttcaagagtctgctctggcagcctggccattattattcacatttagggagtgcataatagctcacaatgccctttaatacctgacatttcataagtcatgacatcatctccccagtccagggcacctgagcccataccctggctttaaatgctgacagtggccctttggccttggagcctgggtccggatgtgcccaaggttcaataagtcactaaaagcatttacaggacacaacatggagtggggctcacaatatttgttacagcaaaagggaaaaaaaagcaaatcagcaaagggaaaaggttcatgggacaaagttcggaggaagccgggcaaaagcttccaagagtttttctctcagcagagtcatgcgggaagtgctctgttcctacagccaggagctgtgatgacacctacaaagtgctgtttaccatggaagctcaagactcagggccccaagtgttgatcaggtgctagtcacataggtgccctctgcctagcatgcaccaaattccaatctcccggaaggaaataaggtgtttaacatacactcattattggtacaatctaggcataatacaatctaggcacagatagcccctcctatcatttaggacctaggcaactgtttaccagccaggttctcaggcaccagccc

SEQ ID NO: 66589 - DNA, 1406 bp, Homo sapiens
aagcaccatgactcatgcctgtaatctcagcactttgggaggccaaggcgggaggatcgcttgaactaaaaataacaacaacaaaaaatagccaaggatgatggtgtgcttctgaaatcccagatactcagaagactgaggtaggggcctgggtgatcgaggctgcagtgagctatgattacaccactgaactctagcctgggcagcagaacaagaccctgtctcaaaaaaaaaaaaaagatggtacctggaatatgcctggaccttgtgaatgttaattcccttccttcaaggaccccttagctcaaaaactccatgattcatgatgtaaaagtcttggtcaaaaactgttggcctagtatttctaggatcccctttctgagaatgactaagtatctgggcaggggctcatgattcagctgaaagaagattgactccgggatcagaggcttaatcaaggtcacacagcttgtacagtgataaagctggaatccctaatttgtagaacctgtacatctctcctctctcctctcccagttccctcctatgtaaatggtcattgggatgattaataagccgtagagtaactatgggctgtggggacagcaggaaaagcatccccgaacagggagagctgacttaggaagatacaggggctagatgaggcataagctgggttcacgcacccacctggatctctccactgagcacaaaggcaactggagaggaacccagagcagatagcaatgggcacaacatgaaactagcatgtcaagagaaatctggcttcttccaacccatagatccttaccacaaatttaatttcacactaatcaacccaggcagatggacagagcactgtatagtaattggttgctttcctttgacttcagtctggaagggagcataggaagcaaaggatgaagagggactccaggagtttatatgggtttgatacatgaagcccaggaggcagcaattacccataccccacaaaatatctctttcaggaagagcccttagggatgaccagaccttcccaaaactctccccaaagtgacaagcctggcttcctctgatggtgggaagcagcagcaatcaggaaaaggggcattggactgcagacagagaacatgggtctgacttctggctggtggagactatttaggaaacagcaaagatctattatggctaaagcctgtgagattaagaaaagatgaggccagagaggagagctgggttgcatcatagcaggagatggttctgaattgctggctcaagggttcagcctttgtcctgaaggtgataggaaccacagggaaattttaagcagggagaagttaaaggtgacaaatgccttctctgattcaggtaagaacagacatgacatctagagtgatcttgtt

SEQ ID NO: 66590 - DNA, 1928 bp, Homo sapiens
tccagaaaagaaattgaacccataacctattagaaatgatcaggacccagagatcatactgggccactctcaaattatgacatgctagaaaaatgacatttgaagtacatgttttagaggattaagagaaatatcccatcagaaggtatctgagaaagctttatggaagaagtgctggcccctaggttttgagggctggaaaggactgtaacaggcaaagaggggtaagaggggacattctatgtgggcaaagcttgggggtaaaccaagagaaggtttgtcatatgaggctaggacataagcgcgtgcaactgggaatagggtggcagagtgtactaggaggtaaggtttgcaagttagctggattgtctgtcattccacaactatttgttgagcacctactatgtaccaggcactgttttaaatactggggttccagcaatgaccaaagcagacaaaactgccccctctcatggagatacattctagtgggaaaattgatgatgaacaaggtaaaaaataaataacataggatgtttctctataatagttgttatggaaagggggacagtaagtccccagggtgagtctgggcagtgtcatggggaggtgcagttgtaaagatggtagccagagaaggcttcacagagaaggtgacatttgaacatagccttgcggtaggtgagggagcaggctgtgaggatgtctggaagtaaaacaatcttgggagagggaagggcaggtgctagggccttaaggcaggagtgtgtgtgtggctagtttgaaaagcagcaaggaggccagagtggctagatggtagaggaggccaaagaggggagggagtaggggtgtgtgcaggccagtgcaggggagccacggagggttctgagtggagaagtgatgaggtctgactaatacttgaacaggatgattctggaagctgtgttgagagtagactaacaggcaaaggctgaagtaggcagctattgcagtcatccaggagagagacaacaggtgctcaggtcagagtgagccataggtgaggaatgggcaagggttgtagttcactgaggtgtggcagtgagggtagtacctgtacctgtggatggggatagaactttctcttccctgctcctccccaccatcttgttagcattgaggatgacttcaagactcttaaattctgtgaccaaaatggcttgccagtactgtaaggacggggggcttgcccctgatccttctcccagcctcacagctaccttggcccagttccgggtcctttagccatggcctgtcccatgccataccctgtgctttcttgttcttagtccacagctttggtgatgagccatatcccttgcccactcctcccaccacgctccatcctgctgcagatcatcttggtttctgaccttggtgcctgactccctcacccagccttgccttatcttccacatgagactcttggaaccatcattttttgatacaatctcagcttccctttaagccataattttagcctttccttctgcttggttgcctcaagctgccttagtgaagtttgacctggggcctcctccgcatagcacgaaattggctggaattgcctgtgatctgggagccaacactgacggctactagctttgttgttcttaggagtccctttaagaagtcctggcccagattaaatgcaccccataaccgcttcctgctggcaagctctgtgactctccctggtggcagcacatactaacacaacagcaccttgcttctgaaagggaaagggaggaaaaggaaggctcagagccatggtaaattaagacagattgcattcccgaaactgggttgagacctgctgagtgtgcagagaggtacagcaaatgagagttttgtttttaatttgagacaacacgattttcaattccagt

SEQ ID NO: 66591 - DNA, 1058 bp, Homo sapiens
gctgagctccttcagtgtgcagcatgattctaggatgtggactctagatgaccggtgagggaggcagggctgtgaccaccttgcagctctttaatagaggtgcagcaggcagtgttgcagagtggaaaaagaatgctagtttcagagtccaatgtggagacctggcctcaagtcctggttgccccagtctaagctctgagatcttgggcaaggcatttcacctcttggagccacagttttgtcattttaaaaagagcacatcagtggttagcaggaactaagaagaggctgttggggagttattgtttaatgggtacagattttcagtttgggataatgaaaaagttcagagataagagtaatggatgcacaaccatgtgactacactaatgccactgagctctattcctcaaaatgattaaaaagattaactgttatgtatttttcacatgataaaaaattacaaaaacagcatgccatcttccttccttgaagtgttgccgtgagcctgtactacagcatttgtgaagcgtcaggtctgtgttgggccttaattcacgggagctattaatattaattttttaagaagctggatgatgacaataaaggagcagttcattttgccctgagggtgcagaggctcattccttcattccactcatgttatgcatggggcttgaaagcctagtaggatttcactgagtgtgagggatctgagagaggcattcccaatagagacaattgcatgacccaaggcttggaggcacgcagaagcatgatgggtctggggaacagtaagaatgtacatgatttaatcccagaggcaaattaagaaacctactttgaaaggaaacaatgaaacagaatcacagttacccctgccccaaattgtcaagcagcctggtgtcaaaagggaaattattggttaacctaattaggcagccaaattgctcattcagagtcagtagattaggtgagcatctccaaagcacagtgagaaaggaactcattaccaattaactccatttatcctctgctctccttggccccatacccaa

SEQ ID NO: 66592 - DNA, 2232 bp, Homo sapiens
gaaggtgtgcaagaggaaaatgataataataacagcattaatacttaatagttgtatggctgggcatggtggttcaggcctgtaatcctagcactttcagaggctggggtggatggattgcttgaggccagagtccaagaccagcctgggcaacatggcaaaaccccatctctattaaaaatacaaaaattagccaggcatggtggtgcacacttgtaatcccagctactcaggaggctgaggcaggagaatcactggaaccccagaggcagaggttgccatgagccaagattgcaccactgcactccagcctgggcaacagagctagactctgtcaaaaaaaaaaaaaaaatagttgccaccgattatctcaacctaagcacagtgctaactgctttagctatattatctcatttactccccctacaaccctttaaagaaggttttattatccccattgcacacagtaaggaaaccgcagcccagagaagttaagaaatctgcataggtcacacagcaagcaaaatgagattggaactcaagcctacatgactctaaaatctttactcttacagccctagttacagtgagttccctctgtagcaaaatacttgggttatttgttcttttgaaggcttcttgccatggtgacaaatgatcacttaacataaagtcatgacagaaagaggtgcacacttgcgcacattattgtatattccctgagagctgaattacagctgaattaagcctctgttgggtgataatgacatattaatcaagcctgaagagtttcagcctttgatagtgggacagagaaatggctgcctgctcccctggccatgttgtcatttctttgtgatcgtccatttccccactggccacagaactcaaagcctcactgtactcagggtagacgggtgggcagaggaggtaggcagatgaatctaataaagggcttctgtttcccacatcccttccaagactggactccctaaacctagactccccataggtgcccaaaggctgtctacttgctcctggttaggaagttacattaacagcttcgttatgcggtactcagatctaaataatgacagcaatcatgggaatggctcccttttattcactgattaggttcaggttcctcttacactattatctccccaacttatagcggaggaaactgaggcacagagagattaaaggctgtgcacagggccacatatctagttgagctggagccaggctctatgacaaaagtcttggttccttttaccctgtctctcccttttcttttaccttccccttctcccatctttctctagttcccactgacctcaacaaacccctgggccccagccagacctctccttttcttgtgatgagaactcggatctcaccatcagaacagggctcagttccactggacctgtcagtgaacacatcacagtgtggtcacttctcaggggtagagcaaaggcagcaacctcatgctatgggcctaccactgtacatgtgcaattgcctttaatctccctggcaactcagtggcattcccatttgccaaatgggaaacctgaggctccaaactgagacacaatagcctgcgagtcagcaagttggcagagcttatatttgaagtctggtttctctgagtcctttgcctgcctccatttgagtctgcaggcgtcctcagctctcagttgaggccaccaaaaatgtgcaaccaagttctcagagatccttaccagataaatgtaaaatgtgaagcataacccccagcaacctccagccacaggaacatttactctgcctccacaccctgccttgcattagtcaatagtaattgtcaacagtattgatagcggtagaggcttttgcagaggtcacactgatgctgcatgcagctgccatcaataataacttttatggggtccattaaagacaatttctgcccctgaaggttaatgtcagcagcttttatgtcactgcttaatatctaaaataaatacagaattgactgggtaatgtaaacacaaatcttcctactcggggccttcaggcagagccagccctcaggcctctcctcccctgccgtgagaggccaacaggctgggggtcgggaggcagtgagaagctggcctgtcaggaacagtcggcatgcaatagatgttttttagaaagcagaggttgcaattcaagcttcgctcccaagcactgggtcaagctgac

SEQ ID NO: 66593 - DNA, 1062 bp, Homo sapiens
agattatcatcccattttaaagacaagaacattgaagctcaggtgatcacaagcccaagattgcacagctagatgttgagtgagatgggatgtcaactcatgccccgggcctcagaaaagaggccaaaaaggacataaagcaagtaaaccatgaggacttcttaaattggatgaagtaaatcttccaaactcacacatcagaggagctgactggctcaacaggatcatggaacccttagagtgagcccttaccttgcattttcctaggagttaagttcctaagacatcctagtcccgagatgtcttaactcacttgtattgatgctgagtctggctgcttaaaagggcatgcaggacaagccagatggaaatcaatgcagcccaggctgtttgttgcaaataaatttgatttttcacttaatgtaagagtcattcttcataacacgtgagtggcttctctttgagagggccggccgaacagagcacagatagaactgtggatggggacagggggcgagagcaggacaggagagaggagtgtagatcagagagcggccagggagtgtgatacgcagggagagcaggaagccgactgaggaatttaggctctaatttggcattttctttttctttgaaggagagcaaaatcggagggcagattggagtagggcacggaggagtggtatgcaaaatacttaacatctggttggcccagcctctaaccaatcagaatgtctgcctggccactgagcagagcccacgggcttcttttatgcctggtccgcggacattaaccctttgtttagtaactggatcatgaggagattgggggtattgggaaggggctggaacagccagagcagaggctgaaaggcactgggtgtggaaggaggcactgaggtggcttggcacaagttatttaccaagctgtgtggaagtacttcatgactgtaacctggcatcaaggctgtcccagcctgagccagctgagtaggaggcctgagatacacctccacccaccaccacagcctagcatagcagcttgcatttcagcagcacccc

SEQ ID NO: 66594 - DNA, 1032 bp, Homo sapiens
aaaagggccagtttccagccatctagcctgttgtggggcctggccctcttgggggctaatcccctttgtgatgctcccttggagcaggcacagagtctaagccaattaaaaccctccctttgaaggtggttcaggtttcccagagagcacaggcctgcacagtgacccaaggtaattgtttcaaggattgctctcctctcctccctgctggccagagctggaggaagaccagggctttgtctgggaaggctccatcacattttcccgctccagacccccagatgaccatgtgggtctgcaggagaggcaggatggcagggatataaacaactgaccatcttacagatgaggaaagtgaggcctgggatggctatgcagggctgagattcaaactgcaacatacctgctcaaaactggtgcctgctctgtctttctaggacaagaaccaaacccttgtcaccttcaatcccagcacagatggggcctatagtaggtttctagtacatatttgttcagtgatgactgaataaacaaataatgctgaacaggaacattcgtcttaatgcaatagtgtgaatgggccggagaaatccagaactgcatctgggccggagtgaagtattaaatacttgataatacttagcaatagtagtcataataaacagccaagtgcgaagcctgttctaagctccttctaactcactcagtccccccaacaaccctattgggtaggtcaattatctccacttcaaagatgatatagaggaataaagaggttaagtgaattgtgcctggcacacagctggggcgcacagagctgggagtcgaaccttggcttcctgactgcagagccaatgtctgggctgctatgcacccctttctttctaacaggaatgtcttcctctgtgaggttcagatggtgatgaccttcaccctccctgtctccccgcaatacagggtctcagtgacatgagatgtgaaggagctttccattagaaacaccatactagacaatctggaccattgccggcc

SEQ ID NO: 66595 - DNA, 1114 bp, Homo sapiens
tttggatgcaggagatgacaggtgtgcaggccagagtggcactaagtatatttgaaaaaagagggtggagatgaaataggagaggtcacatcaggtgtgaggatgtgaaggtctgtgttggcatcctgcagtcccatgtttttcagacctcagtgtcataggagtcacctggggatctaattgcagattctgattgagtaggtcttggggagagcctgtgattctgtatttttaacaagcatagtaatgctgatgctactagtctatgtgtcaccccttgagtagcaagactttaggcagtagagaaccatttaaggttctgagcagggacaggattgtggtctgatttgctttttagaaaaattacgctgaagactgcaaagaagcttcctccgcagggtagaggaatgcaggcaggatgagagatttatttttttttatatctccaacacctagaatggtgtctggctcataacagataatcaatagatatatgtaaaaggaataaattagccatttatgacggacttcttaaatgagaaaacaggaagaatgaatgaatcaagttatcccaggctgacaagctgatactttataaatcattcattcaggccagtccaaatagagaataggtcttaaggcagtggtttttctagcttgtttttagacaaagatctgattgcttaaatgaaactcgaaatggaagcccaatatgtgaatcacataaaaaataagtaagcgcctaggctggaccgggagtaagagctctgaaacctaacaacctactccttcccctttctcctgactgccagcgtctgacatttcccactgtacctccagactctcacaagtatcagccaccccaaaaagccagcctgactcccccacaaccccagaatgggtgagggaggcagcccttcagcaggatctgggatggggattatctgtttctggctcagtttctcccactaaacagtgaagtcccacaagataggaccataaaagacccatcttggcagcctcatgcccaacacagggacgtcggttgaatagggaacttaggaaaggatgatgggcagagatggagtggtgagccaccaagtcccaaggccag

SEQ ID NO: 66596 - DNA, 1044 bp, Homo sapiens
gtcatcttattcaatctagacagtcaccctttgagggagacctttctatccctactttatagatggggaaagtgaaggtcagagaagttgactcatttccccaagttctggagctgggattccaattcaggtcttactagctgcaataccacgttcctttcacactgaaattgtccagggatgatgatgatgatgttcctgatgtcgttgatggctatgaggtaggactcattagcctcattttccagacggaaggtctgagccccagagaagacccatcgcttgcccagtatggcacagctggtagctgggagagatgggtttggatgtacacttttcgtctgcaagccttgtcctctgtctgcttttcttccgtacaggtgtgcatgagctcccggttactcgagtcatgggagcaaattctgatggactcagccagcttacctttagggtgagtcctcctcaggagagaggttgggagtagatggtagctaagtgtcctgttttctacttggactctctcagactcgtgctgagtggaggccagtgcacaggcaggtcccttgcttaaagcaaattcctgggaagtgatgagcaggggttggggagtaggctgtcaggagccaggggtcaggagaagggccctgggggcagagctagctgtttggctttgagaagggaagccaggagagataagcagagctgggagtgatgtgatcaaactgtgaaagatgattctcactgagctgggagatgggggggggtgggggagacacaagagacccgcatgcagggttttgaaggcagcagatacaggggcctgggaagcccagaccaggatcgcagacaatcctgggaatggatgatctggtgagttgagaataatccatgtacttttacgattatacttagttctttgcagtcttcattagttatgggataaatacttcccttccttccttggcttcaacctttatgctgcaagtttaatttatcttgggccactatcgttttttgttttactaagttatctgtatagtttca

SEQ ID NO: 66597 - DNA, 2000 bp, Homo sapiens
gcctcacatttggggggcactttatgtcattttcagagtacttttctgccagcagtgcttatggtaatagtcgtcccacagttacagcatgttttctggtttataaagcaccctcatttgcatgttctcattaaatcctcacaccagccctgagaggaaagtgaggcgcagagcatcatttacccacgtaacacaaggaacccagagaagtaaagcactgtgcaggattactcagccctccaggacgcaacggtttcttaattctgcttctatcaatcaagagcctctccgccatgtcaatccatttcaaagtcaagccaaagtaagggctgtaaagccaggaccctgtgtgttagtcctggagcatgccaaggtcaagacatggcccaacaatcagaaataacatcagaataactcagacttccacctaatatttctcagaagttatcaagaaccaccaaatccacagaaaaactgcttaaaatccgccttttctctctgccctctactgcatttactgacatcagcttctcctatatctcttttaaaatattttttatgaaaattttttatattctacagagagtgtttataacaaatatgttcagtgtaaacaataatgagaaactctcatggccccaccagctagcttaagaaacagaacatgatgccacctttgaaaccctggggatggcccccaataccctcccctcttcccaggtagctgccctcctacacttattctcttgcttttctttataatcctggatgctttgcaaccctcccccagagaagcactctccccagtccagcccacacgcctctgcagcttccatttttgcttctttccctaccccagtctggtgtgaccttttctgggggatgggaaagggcctggagaaaatggacagaggacacaggcagactcctttccagataaggggagtggaaggttaagaacacccctgctaaataccttttgtccacttgaaaacacattgggaggagagagggaggggcttccttgtaagtttattcctggagcaggttgccacttgtcacttggagcaagtcccttcaccatatggacttctaaactggagggggactggcacagattggggtttcctaaaattgtcattgcttctacagatatttactgagcacttactgtgtgccaagcagcgccataggtacagggatgatgtcgtgggaaatgagacagacaaattccctgacctcaaggaatttaccatcgagggcaggcctcagtcctgccccacaactagctatgatcctccctttgtcattgtaagctattcaccattaaaggttgaggtggggatgaaattagatgataaatatggaagtgcctggaaaatcagaggcaggtcttggctaacactacttagaagacaccccacaatccctgaaacgaggtccactgggcacggaagaggctggagctttgggtactcacacctgtagttacccagatctgccactggatgtcagtgatgtgtaggagggggcggggacctaagggtgatgagctttttaagttgagaaaagtgcgaaataactgcttacagtgtgctatatgctgttctccatgtatttgttatagcatttgatgtttacggaaaccctatgatttgcatatccttatacccattttacagacagggaaacgtgctcaggggagggatataagtggttgtctcccctcctccacctgagagtaccaggcaaagattgctaaagatgctaaaaacggccctggcgtgaaagtgctcaaccagacagccctttactgctgctaaactgctatgaacagcatctccccatacttggggcagcaaatggctgcacaaatgcatgagaaacaaaaagctccacagctgttaaaacccccatgggcacccatgaaggttacagtacaagtgtttgctaggcagatagatgggtacagattaacaagagccacgtggtgacagcag

SEQ ID NO: 66598 - DNA, 1033 bp, Homo sapiens
gcctcatctgcaaagtgagcccttgttttctcagccaaccttcccagcatcaggagcaacaaaggtggaacttatattatagcttgtgatgtgctgtttttatatgaaggatcagcatcactctgctatctgacctcaatgaaggcaggcagggcagagctgggagggctggggagaattggatttgaattatgtgaactctagaggatgagaagtcagtgtttccacacatcctttgttcctgtgtttccaaactgtagttcttcacccagtgtcagactggatttgcttgagcacacaggtgatgggaagttgttgtatttaatagatttcagctcaactagaattgcaaggaagcaataacagaaaagggaattccaaatgaagccaaattatattcatttgttttacaacaactattaaatatgttgagagggtgaaaataatgatttcaccctttcgaactgaaattggggttcgttggtggctcacacctgtgctatattgagttgtgggtttggtcaggtgtgattatagaacttaattgtaaattgcatctttctggcacatgcatgaatgtatttatgtattctaaaaccttttaaaatcatttttgtaaaaataatgtctatgactaaaacctctaatggctaagtcactagctccaagcagccgttcagttgaggcttagaaacttcacaagggtgctggacagtatttgcccaagggatggagatgagcccacctcctatctccttctcaacccccttggagccttgtaaagtgctttgtgtacagtaggatcgctcacctgtgaaatggccccattctcactacttagccaaagcctagtaatatcacatactctttgacccactaataacgttttaatggaaataagcagaacatcatgcaaaggcatttgcagcaagatgctcattggcagcattgcttatcataatgggaagacctggagcaacctaagtgtccacctgcagggtccggttaaatcaatgagggttactccatatgg

SEQ ID NO: 66599 - DNA, 1046 bp, Homo sapiens
aagtaaatcagggttgatgattcattttcagaaacaaaatcatttacttgctgtataggaagagtcctttaaaaagtaactatcacctagtgtgttcaacataaaaccctgattataaagattcatttgggggagagcattttcaacaataatccttcccatctgtaaggctacaatactattttactatttcacagcaccgtcacgggtattatgttcaacgtcaacttgacttagacaaaaacttatcactatttttctctgtggcaacagcatgcatttggcatctgtcagtggttaaacaagcaggctgtggtgccgaagtcctgaatttgaaccccagctttactccttactagctgtgagtttgagcaagctacttagcatttctgagactcattttcttcatctgtgaagtgggcagaataactttacataatgaatgttaagttctgttccaaagtgtcaccgaataagtgagaaatgccatttatgatttactatgcccacccaacaacattctgaggataatgtggcttattctttgtagaaacctacggtaagaccaatgtggacaattttgtttctcagtgtcaattaatatattgttattctgctttgtgcttcagtctcacaggaacttttcaagtgtcttcaggtcctattgccattggggtgctgataaatttgggtttctgaaagggccaagttattgtcctgactccaaggcagagaaaattcccccagattctgcctctcctgtctgcccatctggggcctcatcagagtagagaaacctagactcttcgagtcagagcagaccttggagattacatagaaggacatatcttggcctgtgagggataggtgaggtgcctggcagatatgataggaagagcagaatttgctactgaaggcccttgggcagccctcttcactcatctgtgcctcagtttcctcaccttgcttgcagggttctgatgtcttggacaagcactttggaatgcccaaatagggacagcatctgaggccagcatggaacatta

SEQ ID NO: 66600 - DNA, 1052 bp, Homo sapiens
acatttgcctcttgatttaatttcagcagaataagtgagtacaggtgttactgtgtgtttttctatgagcatttgcagagaaagcctcagctatctctatcttagggaagtagatggtcctagttacatattttgcatattccctcatctgttggtttataaggtcatttttcactgaagtcctttcagctgtcctgcgttgacaatagacaagcactccctcttctactcccatgccttcttcatccaacaatgagggctttgtgctgggaagatgcctgtggatgcttccttcccaaggcttcaaagcctcgtctggcttctatcaagggtattgatgggggaggggacccagacagttggattcagggagcagtgcctgtggcctggtgccaacggaatatgtcaggctggggtagataattcaatgtctattctgggatatagacagcctggttacctgagctggttatcgagctatttgcagccactgccctgcaagtcatcaagctctagtttaccagagccttttgctccaggatcaggagaggatggacatctggagaggacagatgggagagagtagaggggcgggctgccagtctcagggtgtgaagagtcttaccccattggagcaagaggctgttgtggctacttcctcttagggcttcagttcactaatgagattaaaatgccaacagcctgcctctgcgcacacttacttaggaacacattggtttgaactgcttaatgagcgttaggaatctaagaaaggtctgggcaggcgcctggctgatgccttgatgattagaatactaaatgtgtccccctttgaaagccagcagttgctggagagcaaagccagttctgagactttctttccttgattatccttgcattcccactgttttcagatagttataaatcaatgacctgaagtgggtatggaattgttatgacaatgatttttataacaacaaggacaataatgataatgattatcacaataataatgattatcaaacctagatgctcaccagaaatacccagac

SEQ ID NO: 66601 - DNA, 1283 bp, Homo sapiens
gcccatagtaagcactatgtaagcataagatacatgagacagtcctcatctattgtcttattccagtgtttacctcccagggtctgagttccctttcccaacgtttcccagcagactgaagattctcatattcctgagtgaggcactctgcaaatttgttttctgcccccactggcatcaggaagagccaggatgacgttgcttcatttccagtagtcagggctgtttgaggtaaggctcaggttcccttcccggttattggtgcttaaccatgcaggctgggtaaatatttctgagggagtccagcacatctattattaatttactgcaagcagttgctgtactttccagaaatacctctgcctacagatgttttctagactgtgtagagttctcctgaccttaatgcttttcacagggtgtggtgggaatcagttcctttagtgggggaaggatggacagttgtgtgggcagtggacaaggggtaccagttggatcttgttggatctgatcatggaggcagtggactcttgttctttttatgccctactttcagcttcaaacctggcttacaggccagaaacctgggtatcgttttttggtagcaccctttactgtcatgaccccatatccagtcagtcaccaaggcctagagatgctatctccaaaaggtcatgaatccagtcccctctctgtaccgccattgctaagctagtcccagcggacatctctcatcttccaagtctcagcttccttgattgctaaactcaatcagaccccctgctttgtgttcccatagaaccccactttttaaaaatcaccttttaatctttaaatgggctgtccaggctccaacttctctagtggacgattagctccattctcttcttagtaacagtgcccgacaaatataaatctcccagtgataaaagaaaagagtgctttcccttcctcctttctttccctccttccttccttatttccttgcattatttttattaattaacattaaaaggggactagcaatcacctggtcaaattgcattccctagaggaacctcaaggcccactgtaggaagaaaggagacacatttttaagcagaaccctgaaccccacaaacccctcaccaaccagcagcaatcctgaatctctgttagacattgaaattttaccttagtatttttcttgagcggtggggaaacaaaaagtggttatcctatgataaaaggtttggacaacatcaatctattcttatattctcatttttcagagcaaaactgtg

SEQ ID NO: 66602 - DNA, 1029 bp, Homo sapiens
tgtaggctgggaggctaggccagtccctcctttcacatttttctgcctgcttatattctagccaggaagctgattagattttgccaatccatattaagggtgggtctgcctttcccagcccactgactcaaatgttaatctcctttggcaacaccctcacacacacacccaggaataatactttgtatccttcaatccaatcaagttggcactcaatattaaccatcacaccattgtggaagaaaacttgcagagaactcttctgatttaggcctggctgaaggcaggagcttggcagagatgcaggacaaagtacccagcctcagagtcctgccaacggacccacagtcaaaacccaatatgaatttgacatagtaggtattattgtaggacaaaatatcccaggctcccaagctgtgttctgtgatacatcagccctataaaatgggtttaaaaaaagaagaagaagaaaaagaaagttttccctgttgagtgatctgagaagccctgtacactgactcctcttggttgatctcagggccactagcacactaaaggctctgagaaggcctgcagtaagggtgctagcctcatgtttcccaaacttatttgccccagaatcccttttgcgtgtttattcaaacccctctgttcttcagttcatcctagagaatggcctgaaggctaggttagagctctaaggaaggagagaggatggggcttccccgaaaagggacattttgtgtgcattgcacaaggcccagtccaagcctagcacagtctctgtcccccagtgagtgctcagtaaattcttaataaaaaaaaaaaaaaaaggggctactgcgtttgtctggagagaagagtccagagttctcaacagaggctggagacagagaggatgcatatagcagggtgtcgtccaagtgtacttttggcagtttaatgtagggcctttttcctctgacttgaccccctctcttgactactggcaacaaggggcagccaaagcaaagtggtttagggcatata

SEQ ID NO: 66603 - DNA, 1050 bp, Homo sapiens
tcttctctgtttcttagtcttcaaatgtatttcttaatgttgagtcacagtcagaaaataagagccgctgatttaatctaatccttccattttcaggtgaggaatctgaggcccagagaagaagggaattaggagcagaggtaggaggaagacagagctaggaagaagtctctaggtctcctgctgctgatgattctgtgttaagcctgttttcactgccttgaatggtatattcacattaataggctccgtctagcaccttaatctcagggaggcaacctggtacttttggtccaaggggaaagattgtttttccacccacagacggtagagtcagaggcccagctacctctgcagggacctggctccaggtccacagatcccctccctcttccttcctgcctcttctgtctaaatcagcttccctcagagcagcagaaacgccactgcactaaatcctgttttcatttgtggaagacgactgtcatgccaaagctgtttgatggttttagaagttagaaaactgtgaagaaaatacatttggagaataagatctgacaacgaaggcttctattctggcttggtgcttttattttattacaaaaatgtgagtccattaagcagacttcttctgtggtggtcaaacagtgctaccaggcttccagagtacaagaacaagatgtagccctgtttctgccaggcagagcagcccagaaaagggaaatgtggggattttaaaggctcagtctgagcctcacacaagacttggaagcgtcttaaacaggagggtaaataagatcagtggattgctgactattttgactatgacccacagcacaaaacacatgggatatctacttaggacacatccccacccactcaggtaaataggtgaggcttaggactgaccagtccagaccatcaaagtaagggcatttagcccaaccttgggggtagggagcccggagggaaggggatggtatgtcttcaaagaaggtttcaaatctcaagaggcttgagcaaaggattaaagaaagggaaaccacacag

SEQ ID NO: 66604 - DNA, 1073 bp, Homo sapiens
ctgacccaggaaagactgcataattgtgtatcacagggtgcttcaaattgtgggttgtagtccagtaacaggtcatgaaattaatttggtggctcaagatcagcatttattaaagtaaaaacagagtaacctagtaacccacagagtgggtaaagatgttgtatatttgcactccatatactcaacaaaggtctcatatccaaatatatatggtagaaaaaaaagaagaaactcctataaatcagtaagaaaagacagacagcctaatagaaaaatgggcaaaagactcagatacttcataaaagaagatgtccaaatagccaaaaaagcacataacatttttactcttcagggaatgacaaattaaaaccataatgaaatactactatgtactcatcagaatggctgaaataaaaaatatagactctatctagtgttggcaaagatgtgaaacaaccgaaacttacacactgttagctgaaatgtaattggtttgatgacactggaaaactgtttggcaatatcagctaaagctgaacatatacataccagcactttcactccttggaatatacccctgagatatgtacacagatatccaccaaaacacatggccatcagccctggaatggatcaagggtagcatattcacatagtggaatattgcacatagcaatattgatgaacctcagaagcatgaaggtgaaagaaagaagcaggcacaaagaaactttatgactgcactttaaaaaagtacaaagccaggtaaaactactctgtgttttcagaagtctggatggtggttgcccccgagggaggagttggtaaatgggaaggagtgcaaaggggctctctagtcacattctgccttttaattcagaggtaggagggcaggttaaatgggtgttgtcaatttgtagaaatgcatcaatctattcatttatgatatgtaccctctactgtacttaagtcatacttcaataaaagtttataaaatgagcataacagaggagaaaatatagcaggtcataaggacaaacatcattaagtgaaacttcagttacatgtccctc

SEQ ID NO: 66605 - DNA, 1046 bp, Homo sapiens
aagttgctgcttcttaccatctcaggcactggaatgggccaggtcttgggaatccatggaatctgggtccaatccaagccctatcacttgctgactatgtggccatagactgccatttctcatctctgatcatctgtttcctcatttgttaaatgaggatgccaataaatgttgcaaagggttgcgtgaggatgtactgagataatgtacataaagcacctagtacctggtacatagaaagtgttcaaaacatggcagttgctagtatgattataagtaatggcagaactacttacctttagccagaggagaagataggaggtgctagagactctcataaggagagaaaagaacgggcatactcattagggatacagtagtgttcacatctcataaactctcatgcaaacataagcccaacctcagaaaattcatgaggttaaaactctacttctcagagtcagacaaggatgatgggttgctatggaaatatacagttaaaagggaaattttagagtgggtccgagaagctgcacaaatcctgccaatctctcactgatgccatagccccggtcctagatggtaaggattagagccccccagaatgaaggtccttaaacacacagactgggaggcctgcaaatcatcaaatatttatatatgttcagaaggctggtggtgagtgttggatgagagattgagtgttttgtaaactgtaaagtttcctacaaatatatgtgcctttgtgtgattcatgtattatggactgtatcaatactttgcaaatcagaagaaaggggggaactcagatgagctgactgtgtaatgaacctgtagagtccagccccactgatttctgagtgaaatagcatatacgtatgcatgcatgtacatatctgtatacacacgtctatgcatgtgtgtgcatgcacacgtgtgtgtttgtgcatatgtgtgtgaatctttgaccctttggaggtagtcaccactctttatccagtgactggctgcctctaaggagtataacagaggaatgaaaacacagg

SEQ ID NO: 66606 - DNA, 1448 bp, Homo sapiens
atgggctcctgcacactgcctgggagccaggagggagaccttccaggacctgccacctggtgccagggaggggtgagcccgcaaacccaacaactagaccagatgggtgactgggcagccagggaatgtggaggaggactcgaaggctgtccagagcttgccatttcatctctctcagacctagtttcctcatctgcaaaatcaggctaaagaaaattaaataagttttgggattccggtggagctagaaaataatacttatcttcctggcctaaaatcaaaattaattaagacatagaggagtcagacagataacaataataataaataaataaataaataaataataacagcaaatactttatagcatcatgaccactagttaagcattaatacttatttagtatttcctatttgtcaaactctgttctaagccctttatgatgttaactaatacaacatttctataaggtaggtactattcttagccccatttgatggatgaagaaaccaaggcactgaaagtttaattaatttttcccatatcacagaactagtaactggaagactaggatttaatgccaggtggtctggcttccaaggccatgatcttgaccactgccctccaccaattaccatggaaagcccacagggcagctttagatctgcacacagggtcttgctaacacttcgacctatagttagacagacttggccatcccgtcaaggagaggagaagagctgtgctttccataggccacttcataggccatacagggggtactgggtgaggcaggtccggttccttctcccacacccaccaacccaatcattgtcactcagattaccacaaacttgctaatttgtaactgggggtaatgatagtacctgtgtccatgttgtgctgtggattagctgaggtggtatgtctaagtgcgcacttgggtcattttctggtgcagagttagtactcaacccatgttagccattcttgttatcatctcttctctactgcaaacccttcaatgggtccccactgaccacaagataaaggttgaactcctttcacagagaacaagttgttgctgacttaaaacaacagaaacatatgctatcacagttggacaggctaaaagtctgcagtccaggtattggcgaagtggctccttctggaggctctgagagaatccactccatgctcctctcctagctatggcggctgtcagcactccacagcactccttggcctggggacacacatcactgcagtctccacccccacttcacatggccttcccctctgtgtctttgtgtgtcctttctgtctggtaaggagcccctcgttggatttagagcccaccctaatccagtgtggtcttatatcaatcttttaattacatctgcaaaaccatgtttccaaataagattacattcagagattttcagtg

SEQ ID NO: 66607 - DNA, 1039 bp, Homo sapiens
ttaggcactaaccacttactttctactccacagcgtttccatggctgggtttccctctaggaaggcacagtcttggaagataatcctcactcatcctggctctgaaatactttgtgaaatgcaaagatccactttccagctgcctttccttcttaaggatgtctaaatatgcagttgtgcccacagaggcattagcatttcacacaaataccatatactgggtgaggcatgctgatatttggagaaggacatttgtagataccaaggttctaggccctctctaccctttcctgctgtgggactctgacacaaattcttcccctctctgggcttttatcttctcacaggtaagataggagaagatgcctctctgacctctgtgtgcttctacctctgtgcttatgtccttcatgtaatgggaaaagatgcttcaacatcatactcacggggctgggggagttatagcacagtcctctctttctcaagtcaaatttaaactgacttgagctttcacacagagattggggcatgtccagatggttctcttatgatccctttccctagttcctcttccccaccttgtcctagaaccaaggaaatgtatacaatcctctcccgcataaaaaggtctctccggctcctactcctgtattagtttgctaggttccataagactgtaccaaaaactgggtggcttaaacaacatagtgtcccatctggaggctagaagtctgaaaggcaggtgtcagcagggttgcttcctttcaagagctgtgagaaagacttgttccatgcctctccattagcttctgggggtttgctggcaaccttgggcattccttcgtatatagaggcatcccccagtctctgccttcatcttcacatgacattctccctgtgtgcatgtctgtgtcactatttccactgcttaggagaacacgagtcatattggattaggggcctgccctacttcagtataacctcatcctaactaaactaattacatctgcaatgcccctgtttccaaataaggtcacat

SEQ ID NO: 66608 - DNA, 1088 bp, Homo sapiens
tgacccagtggttaaagagcagccttgcagggcacagaacaggctggaaaaggagagcagtggatctggaagagccgatgaaagacatgcactaggcacagctgtagctgtaagcacaggcatcgattttttcattttaaatcagtctgaagacaaagggaagaatgggttgaagaaaaaaaaattaaagatagtgaggaaacaaaatcaaaattccagcccagtctttcacttgctgtaggggtatctgagacatagggaggtatgagtcagtacatctctcccccgagagcatcatgtacaacgtttcacctttgccacctcttgcaaacccctcccagcagagtgttggtttttagaagcacccgggcaaagaacagacaaagggaggataagctgtgggggcggggagaccaaggtagtcttatgtaacttacatctttatgaaaactcattttgcttttattttaagaagtgctatttatgaattccccagggggttaaaaagcttaagagatgggttttttatgtgatgtcaatagaaaaatctctaaactcctggaataaatgatgcttttgttttggctttctgtttttcaaaaaggccatctgttttcataaacataaatgagactctctagccaccttttcccttataaccctctgtctctttgcacaaatgacaacattcccttcgtgattcattcctgaagacattcttctgggctaaatgcggctgctaaatttgtacttcagttttcactgtgagtcccacatgatccttgctcaggcggcaactgcactattacagctttcacttctcgagtcccagattgctatacccttgggttgccagcagctctgcaccaggctttatgcaactggcttctcctgttttgcaagggtatctgaggtctttgaggcagcccaataagtagcaacccttctctacctaagtcctaagcgtgttgagaaataaatggaagatagcagatgaaagctaaaataccatgtttattattgataatgaataatttagcttagtgtaacagctaaataggcttgataattggacccagaattaggca

SEQ ID NO: 66609 - DNA, 1009 bp, Homo sapiens
atatattttattgtgatatttcctcatcagtaaattatacttattttttcttgaaaatttagaaactatagatatgagaatggaagaaaattttaaaagtagctattaccataccacactaaaataaataccgttgagctctgtaaatatacacacaagtttgcctttaatttctaaaaataggactgcattccacattaaattttgtgatcttctttttcatttaacaacatatagtctacctttccatgtcattaaatattcatctcttaggcttattttgtaaggctgcattgtattgcgtcctgtggaatgccagagtttattcccatttctctagctgttagacatttagattgtttcctccttttatttattcttctattcaatactacaatgagtacccagcactgatattcagttggcattgacatattaatacaacctgccccacttcaactagtgagtgcccataccagtcattaaatgtttttactatcacccgtggaaaaaattttatataaatccatggcttgcttgggatattttttagaattattataatttctcagctataggcattggacatttttacaggtttttgctatactttggcaaattaacctctaaaaaacctgtactagttaacaccaggtttgacggtccaatatgccctgctgaactcaaactttctagggtatttgttcaagaagtctgatggggacagcaaagaaagaaatagagctctatttgaagtcaaataaagacagatgtatagatagagatattgatatagagatagatagtatattacttaggatcctggcaagaaacagtggcattgtcatatggggtagctgaggagagtgtagtgaagggattattttaaaagtatgagcaggattaaggacaaccactaaggttggcaaagtaccctgaggctaacaacagctgggagctgtcactcctagacctgatgagcaaggtgaaggagaagttcctgcaactt

SEQ ID NO: 66610 - DNA, 1518 bp, Homo sapiens
gaggaaaggaggggaggggaagggagaggaaaggagaaagaaaagagaaaagagacccagtctggtggaggagcactaaagtaaggatgatgggtgcactaggtttgaaaaccaagggggctccaaccctttgcccctgctttaatgagaacagttcttctatctgtttatatactgaataccaatataaattttattttggaggaaaagtttccactgctttgaaaaaaaaaaggtttaaacaattcgtttaaaacaactgttctaggccacgggtcaccatgttagggcttagaacagataagtggcacggtcatgtctgcatattgtgaagtttagtctgtcaggggtatggttagtggagaaggggtgaaaccagagcagagaatctagctggacaagaggtaaaagcaatgttatcctttcaatcagaaaaccaaaggaacctgcccccaccctgaccggtctcctacaggaacctcagtaaattcccatttatttctctgttcttcagaccgatgttagatgcattctttggtctgtgctttctcttcctgaataaaatgattgtatttacatgtgctaaataccatattattatcactgactatacactatataacatatattactatatactaaatactgtattaaaaggaacatatcttctcatacacatgaatatgcatacagcttcatgttggctaattagtttcactgagtcctttggaaaaggaggcagactaaaaaatgaaggagtaaataattaggtgtcaagtaattaaaagtactattgagaaagaatgccttttaaatagtttttttaattgggtttttaatatgactgacttggaaagtttctctcagaagatggtgttgattgacagacaatatagttattaataacatgtagtcaatctgttaggaatatattaagtgttcaggagatagaacatctgaaaagaattgctaaggattcaggcaacagattcagtgtggaatgcatctttttcttggcaaggagtcagtggccattgagcagaactggagtaaatggagtgtagaagatggcccaaggaccctgttggatcagcatctcactgtttggaaatgcaaccacctttaatgagaccagaagtcatcagttgaatgactgaccctatgggcagtacattgagtaaacagtttgtaatcagagattcccaacaaatattttatgaacatctgagtagcacatctctaaaacttggttgggtgatttatttatttatttattttgaggcagggtcttcctctgtcacccaggctggagtgcagtggtgtgatcacggctcaccgcagcctcgacctcctgggctcaggtgatcctcccacctcttcctcccgagtagctgggaccacaggtgtgtgccaccattagtgccacccagcaaattttttaattttttgcagagacatggtctccttgtgttgcccaggctggtctcaaactcctgggctcaagtgatcttcctgcct

SEQ ID NO: 66611 - DNA, 1022 bp, Homo sapiens
tatgcagtggtccttgctcagtcctcatatgactcaaactatttacgtggttgatgtcacgctccttctggagcatttcctttttgtttgctgagggtctctgctctcccctggttctgcctcaccacactactcactacttcttccacctctttcactggttcttcctcctcatgaatcctctgaatgcaggggtgccccagggctcttctttctgttctacactccctgggagatcttatacaacctccaggtttaaacccatctatctatcgatgacgcccagatttatatctctagtctggacctctgccctaaactccaatttatatatccctctaaacaggcaacagctcttctcaaacctaacatgcacaaagcctgttccctgattttttcccacctgcttgccaacctgctcttcctgtgttagttctattccttgcttcactcaagcaaaacaccttagagtttctttgtctcccctttctctcacatcccacatccaacccatcagcagatatcttcagttctgccttcaaaagtatgtgaagtatatgatcggactacttcctttcaccttcacaccctcaccttggccatctctctcctgggttattccaggagcctcctacctgttcttcctgcttcctctttgctcttcttcaatctgttcacatcactcctctgcctaaaaccttctaaaggttccccatctcagaggaaaagctaaaattgctgtcatgtcccatggggctctacacatctgtcacagcagggcccaccctgatgctgtgctcccatctcctccctcagtccttgggtcacctttgtctagccacacctgcctccttgctgcccctcctacgtgccaggcacccttgcacctctggacctttattgtcctagctgcctgcagggatagctgccccattcccttcaggttcctacctaatgccaccttatcagagagacattcccgccctaaccataccctccttcctccttatcccactctactt

SEQ ID NO: 66612 - DNA, 1960 bp, Homo sapiens
ccttccctccttcttcctctcctcctctcttttcccttttcctcacctccatcatctcctctctactaggacttcactgaaactctctactctagggttcataagctggggtctatgaatcctgcagagtctgtgagtgagtttccaactgtgcattaacccttgaaattgaagtcagcattctggattcatggccatgaatgtgttttgccagggagaagttttatagcttttaccagatcctcagatttctagacttggatctcccacttctcttctcaattcctagtcttcggtttcttgtttccccaaattcccatgacaagtgagagtcatagtttatctacaattgactttaaaatttgcagctgtggagaaagtaagttcacagaagcccttcgtgaagagagctcactggttggaaagtgcaaatgtcccagcagttgtgtggattaaatgaggtctcatgagtgagtgtttggcatgcaggcaaagctaaacaacagtgagtttttctccctcccaagctctactgaaacactgttctttgcagatgagtagaattatatatagtctgctaggctgccataacaaagtagcacagactgggtggtttaaacaacagaaattaattgcattccattctggaggctggaagtccaaaatcaaggtgcctgcagggttggtttcttctgaggccttccttggcttgcaaatggctgtcttcccaccatgtcctcacatggtctttcctctgtgtatctgtgtcctaatctcttcttataaggacaccaattgtactggggtagggcccaatcatatgacctcattttaccttaattaacttttttaaggccctgtctccaaatacaatcagattctgaggtactgggggttaggacttcaacataggaactagtgggaggcaccattcatctcataacaaattgagtaaaattcctttccttgtagagtctcactagtgtcctgcctagggaggcagtcatgggaggagggtgagaataaagcctatccattgaacactattgcatctagaacttggtcttaattcaaaccactattgacaaaaggttatttaggaagcactttctggctgagtgggtccaggataattattaaggacccatgcatgggttgagcaggagttgtggacaccatgttagcaagtagccagcccagtggttgcctcgtcttcctgacagataggaagaaactgtgttttatttatgtgtgctgctattcttagtcttgcacttttccctttatccccagtggaaaggattattgtaactactctatcttgaacccgtctcatagtcaaattaatagatgaggctcaagtcgttgccctggagttcaacagcaaaaacatattaacccaaaagcattatcatatcattagagcagtgtgtgtaaaagtttaacattcagaacaagaatgaaggggaggaatgggaaggggttgggcaatggggctaaggaggatgtccaaatatcttgtataaattactctactctccagtgagagtttcttaacaaaaccttttctataatatcacctgcaatgtaaatacatgatctgagaagaatctttcaccaaagccaatagccagagaatcgggctccgaggggctgtttcagatgcagtaaattagagctgtgtgcataataatatacactggaagcaggtgaatcaataatctcagtgcattcaagtatagattcaaagcagtttattccaggaacaataacacacggtatttatttgcataggtctagaaaacttaggcaatttctttaaaaaattcaagatggcaaggttctctttgccctcatcatcctacccaatcccccaatatttaattcctccagattgcctgtctcatgggtgatagcctagtttatcatcgcaccaccctctgcttttctccgtaaactg

SEQ ID NO: 66613 - DNA, 1046 bp, Homo sapiens
ttattcccattttacttatgaggaagctgagacttgagacataaacacagtgcccagggcaatttaactggtagctgacaagaggcagccacgggagtttgtgtctaagcgaaaaatgtgaccatcttttaaaatgccgtggtggtgaggtctaccaagtaagacaaacaggcaaataggggagtaccctgtaatggggataaagttagaggatttcttttttcctttcaagctgcagtaggagcacagagaagggagagattcacgttgcttggactgaaggttccagaaggctccccctttaaaaagaatgggagtcatctctatctaaatcctgctacatgtggaaaagcaacctctaagcctacaggtgactgcctctgaagcatttcttctaaccgtcagtggcgtagagatcccagagtgctctgtgatctgacaacaggagtggggccatcaacggaggctgcgcaggcaagtctgagttggcaaaaccagcaggactgggcaacttctgatgttgcgctctcaggcctctcttctattattcttgccagctgtggtcagtcaatattagctttggttccatttcaaatcaaaggaaaatccacttggcaaatacttatggaggccctacaacaccttacacaggcactacatatccagagcataaaaagacgattaagacctagctttggacttcaaggggctctcgttctaggagagagagtagtgctaaatgacatgggaagagctgtcacaggacatcacaagagtgtttaaaaaaggtatgtttgattcatttgcagtgtttgatgaacacctactgtatgctgacatggtgctaaggcctgggaaccagaaaagaacaggacacagtccctactcttaggaagcatactccttcactcgagaaacagacataaatcatataattatgataaatgcttgtgtgatggaggagcaggagactgtggtgggaacacagagagatggtggctaactgcctctgaaaaagggaagggatcttgtatttgccaaatacc

SEQ ID NO: 66614 - DNA, 1038 bp, Homo sapiens
ctcccctctcattctgagttttctccccgctcaaatgggcatgataccacttgaagaaacaatccccagtcccttccagcaagacgaactgctctcagtaacctgtggtgagtcagtgggaacatcccagcctgtttccagtcacacctttgcctccaagagaaaccagtgccagccctacattctagttggctcaggtaaaatgaaagcatgggggaaaagggccccagtctggcatggaatattgaggactcagagcctttttgctttttgctgaaaacctcttaaccctgggcatgaccaggcgccatctgctgaacacgcatccataagccttgctgagggaggcagcttgtttcctcctcatgctgaggctactgctacaaggctctgtcagtgaggctggttggaaagttctagaaatgtgggtcaggtgggctctcaggcctgtcacagctgagagacaagtctccaggcctggaagaggagagaaaatgaggcttccagcctctagaatgttctgtttgatgagcagcacaatggggccagaagcctgagaacaagtgtgactgaggccctgttaagaagagaatgcaccccctggaaatgtcctcaggaaacatggggaacagtgtctgatctgaacacacacctgtacagaccttgtccatgataggaatggcaaacggctaccatcaacagcaccagccgggggctgactcctcagacacaggcactactctccacaacaccccgataggtcgggttaggaccccagtttcacagacagagacactgaggcttaaggggacatagaaccagtcagtgctgaggctgaggctgtggacttccatagtagctttcagacctgttttcccatttgatcttctcaacaagcctacgagatgagccaaggtgaagaaacaggctcagagacacacggtgacttctccagtgtcacacagctaaggagcagcagggcctggactcagagccaggcctgttgggctcaggttggtgctatctcccctcagtcca

SEQ ID NO: 66615 - DNA, 1560 bp, Homo sapiens
cctactcacaagatgatggaatagcatgaggccaagcccaaacttcccaactgccttcttccagccaagatcatattctctgtgttgtgtgatgtcctacttctggaattactaatgtccatgagtcctaatgatgggccccgctgtaccagttggaacaaaagattcttcctgcagaccctctgcagcacgaactttttcaataatgtcagaaagctgtgtggggcataattataatagtgttcatccttcaagcatactttctgctgggactgattaaacaaggtctgacaagcatctctcctggatgactctgggtattaaggcaaccagagtatgagtcacttgtaatgccccagctagaagtttttccagggcataataatcccctagtatggacagaaactactagtgacaggcaaaacgttcagaggctgtgcttgtgcctggagcaacagctttgtcctcctctcctgcccctgccttgactttgaaatgttctgtcaagaacgatcagcctagaattgaaaggcatccatgtgtcagctgagccaaagagagatgggatgaaaatagcagctgcctctagtgttttaatggatgcccgtgtcccttaagggcaccaggcctggccacacagtgatgaggagtaagcctggaaggcccagcctgcattgctctgatgtgtgactttggatgacccttgcccttcctgggccaagtttgctctgggagtaaatctctgaggtcccttccagcactgatgaaggaacctatggcatgtcctgggggacactagattcaatgcggagtaaggtgaagtggacttttaaaagtggagatatttagaaggagataaacctgggtgagaagccccagctctagctctccccactatgtgatgcccagcatcggactgctgccctgcctctgggtccttctgaaggattctgagactggaggaagagacagctaggaagcacaactgattggggttctatttttgaaagaggcctgcgttggcatccctagagacagagcacggtgcatttccctgaataaccactgctatttttagagggcagaaatgaacggcaccccaggagagaaggcgagaagagtgactggatgcttctagagatgctgcaggtcctgagctggatctcagtcagttttttccaaggtgtctgcctgggaagttgcttatcagcctcaccgtgaccttggttggtatggtgaggccactgctgtcctgtatgctgcaagggcagagaatgctgggtgccaaccccagggaaccacttttcacccttgtgtggcacacttcttacagccattgtcagctgctgtggaggaggagttgtctggattgaatgtctcccaaccacagcaggaaaacaggcagcagaggattactgtctgggactaaaccctccgggacatgttcctgaaaaattttagagatgggtggaaatcaatagagattacagatgagtagaattgtggattcttagactacaagggcaccacatccagccaccctgcttaagtgagctgtcc

SEQ ID NO: 66616 - DNA, 1089 bp, Homo sapiens
agccacactgtgcttctggaactttatgtgtataattgatatagtagtaataacaaaataatgttgttgttagggtcaaataagataatacacataaagcacttgggacaccacctggcacatggttaacactctcactccgtgttagttgggatattattattcttggcaacagcagcagtagttgtagctttcatagcagtgcttcctggcctttgcacctttacaaagctcttctctcagtatgtgcagccctttggataccttgagcctggcaaactcctgctcattctcccaggtccccctggaggtgaacttgcaggcagcctgccccgaccccacaggctcattgccttgcttctgcccctgtcccacagccgatagtctctgtggccttcccagcatatgtcaccattctctgggcacatgggggcatttctagatgtcctgactgggagctcttgaggtcagggagatgtctgagcaccacgaaggcccccagtaaatgtttatatcatgaatttgtcactgtcccattcttagtcctgcccaggactaagaaattcataattggtgtttgcagggatttaggcaaagaaggttaaagctacatggtgaggagcgtgtattagtccattttcacgctgctgataaagacacctgaaactggaaacaagaagagatttaattgttccacatagctggggaggcctcagaatcatggccggaggtggaaggtacttctaacatggcagtggcaagagaaaatgaggaagaagcaaaagtggaaatccctgataaacccatcagatctcatgagacttattcatgagaatagcatgggaaagaccagcccccaggattcatttacttccccctgggtccctcccacaacatgtgggaattctgggagatacaattcaagttgacatttgggtggggacacagccaaaccatatcagagtgtaagaagtacatgggaagccagggctacacctgtgtcccctgcacctgagtgtcacagagaatcagggagggcctcattatctaccactggcaacaaaagccccacatagctttgacctcaaa

SEQ ID NO: 66617 - DNA, 1042 bp, Homo sapiens
aggctaagagtatattgtcccatatggtgccaattatgtctgttaagtaaggataaataaacatttactgaactcttactatggcttggtatctatgctaggcatattgtatgttttatcttcactataaaaacctatatatttttggctctaagagatagaaatgtccccatttccagtaatcaaactgcaatgcagagaaggacatatagctgatacctggtaaagctggagtttgaagccaggcctgcctgtcttgtcctttggaaataccatactttccccacacagggagaaatgctaaggctggttctagcagggtgccatgcactgactggtgaggttggagcggtccttagcagtgctgcagtggccactggtaacctcatgccggtttcagctctttctttccagaccatgtctatcttcctaggcttcttctgcttccctgtgattgcacctccagtctctactcagagcactcaggatgcccgcggcctccccataccaccattgtcttccagcacccagtgttagcttcattactattcctggtggactaactgaacacatgaataggcttagggaagaagaaggagcagtgaacctaagatgaaatttaaaaggtgccacagattgtgctgggaacccaggagttcccgatttgcttaaaaaaggaatactgtgagggaacgccttctggcccagggctcccatgctttgggaaggagcagcagacagccacagaagctaagtgtggaattctgccctttcccaaggccggccgggttggggttagcagagtgaactcagccactgctgtggatgttgctgctcttccaaaacccctttgatgcaatccttctttacctatcctgcatcctcggagtagggaagctgcacagtgctgggtgtgcagtcagaatgattgcagagccatttacaagccaaatgctagtttatttccaaatgggaaggtcagtgtcattatccttggtggattcaattaccaaatcctcccaaacattgggctcgcttcctg

SEQ ID NO: 66618 - DNA, 1040 bp, Homo sapiens
gatcccagtcatgggcagaaattgctgcctgaggaggctgcccaagaacactaatataccttgtcctcccctgccttcctgccttcttcacagcatgccctaaagcacctgtgctcaaactctctcatttcagcattctgttttactcttcaacgttattgaagaccccaaagggttttcatttatgtggattatatctgtcaaaatttgacatattattaattaatactgaaagatgttaaaattgtcatttatcacttatttaaattaacaataataaacccttactttaacataaataacatatttttatgaataatgacttttccaaaagaaacagaaatgaatggagtggcattgttttacattttggcaaatcccttcaacgtttggctatatagaggtatctgcttctgcattcaacctcgaaaactccaccgtgagttcataagaaagccagaatgaaaagggaaaatgatgttgtagcattgttataaatagttttgacctcacagacttcctgaaaggttttagggaccctcagggatccctggcgcacactttgaaaactgtgggtataaaaggtgagatactcccgagtccagcggggagtgaggaggaagtcaaccgtgaatctagtaaagagaagacgggaagtgggaacagtctcagtacagaggggacaggagttctcctggaatgacgcctcactgctgtagggagaccttaggcctttgcacatggtattctcttggcctagaatgcttttcccaacttagtctgtttagcagaatcttcttggtgctttaaggtcaagttggtgtaactgccttcagattgcctttcttaccatctttccaaacccaaggctgaactgcactccccacctcacccagaaccctggtgggtgagcatttaagcagaagagtggttgcaggtgtggttccaggttggggtcggtgcctaccggggaaaggtttggatgccaggccaaggaggtggggctttttgtgattgttgtttaaaaagtaagaagccat

SEQ ID NO: 66619 - DNA, 1049 bp, Homo sapiens
gtgaaagagacaagcatgaggggccagccttgctttataacaacccatgattgagataactcactcactgctatgagaatgcattaatccattcatcaaggcagagccatcacaatccaggcacctccattaatccctacctcccaacactaccacattgaggaatttaggttccaacacttttgaggaacacactcagaccatagcagcaagagagtaagatttagagaaggccagtgacttatttgtctggtgaatctgtgacagaactgttaacgggggccactggccactaaccctagaccttagccccatgttgcattccttgtctactcccatcacagtatgcagtcaatcctttgtgcaaataacacgcagttcctactttgctccaagccctgtgctgggtgcttgggttgtataaagggcagatcttcagtccctgtcctgcaagcttcagttcactcaaggaaaggtgtgtaaacaattattttaaggcaagaccattactcccatagcacaagatgagatgggagaacagaagaaggtacatttgagcctctcaggaaggctgcatagaggaaccatctgtgtgggatttgcagggtgccaggaccccactttcttctcttcattgctgtgggaccaggaacaagcctcattttcccatagtgtgtgtttgcaatgactgctggagcggagggtctgtgagaaaggattggggcatcttgccacctcactcagttggatctgtgttctctgcttcaacagaaaagatcccgcaccatcctccaggatccaatggccttggagagagggctgcagggcccacggacattgctgactcttcagaacgtgctgacatggagccaggtcagtccccttgtctgctctgattttctgtcattagctgcaaatttgtggccttgatgagaaatgcaatctcagactctgaacatttgcatgttttttggttggaggcttttacgacttggcagcatagaaagtagaggagttctggccagagtaaaggtagccttctccgggaa

SEQ ID NO: 66620 - DNA, 1069 bp, Homo sapiens
gggcatgtccagagctggttggcttgacccacagaggacgtgtaaaaaaagaaaaaaaacaacaaaaccttttcaagtcttcatgaatgaggactctcagttcaaaattcataggaagattacataaaaccatctgctgcctttatttccccttgtgtgcattaaaaatatgcagctgctcaccgagaaacattccattacgctgtgtggctcacgagctgctctttgacgttcaggacagagaggaggcaaggtgggaggagaggcaggggtgagcacgcacagggatttccactgggctctgagtgtctagaacagggcattccagatttttccacctcactgacgtgctctctgaaggagatgctcttctgtgtatgcagtgaagtttctcggtgagtttgtgtgtgggtgtggatgtttttttttccccctttttaatgtgaaaattggtctttgagtccacaagcagcagctgcagctgccataattaaagtgaaataacctgcttcatccagtccttagaaaggcttaaaaaaaatccatattctaaatggactcaggaatgtggtggatcttctctccctgtttatttgcaacaagttttatttctttacttttctcaggagtcaggagaagggtattaacctttactgagcatttatcctgatcccaggcactatgctggcttgtcccaactgcacagccaggatttgaatccaattttgatgcttcgtttcttcccccgctgccatgccccttcaggatgcctttgaactctggatctctccacctggtctgattctgtccagaggcctgggaggattggcattattaagatgttattgaaaatgctggcacatataatcggcttggattagaaaccaaagctcttcgcagagtaacaaggtgaagtattttgtgctaataatttacgtgataatgagatggttttcagaagattggatgtgctcctaaaggtgttgcttaaagtcactcttcaaaccaggctgggagcataaaaatcccagaagaactacagactctgtagtttgtacagatctcaaaa

SEQ ID NO: 66621 - DNA, 1070 bp, Homo sapiens
ctgaaggtgccagggaagaatctgtcctggacttttctttctgctgtttctttggcttgggacagcgtgaatcccatcttcacctggcatcttccctgtgtgtatatctgtctctgtgtcctaatttcccccctcccccttttttttttagacagagtctggctcttgttgcccaggctggagtgcaatggcacaatctttgctcactgcatcctctgccttctaggttcaagtgattctcctgtctcagcctcccgagtagctgagattacaggcatgcgccaccatgccggactaatttttatattttcagtagaggcagggttttgccatgttggccaggctggtctccaacttcagacctcagatgatccacctgcctcggcctcccaaagtgttgggattacaggcgtgagccatccacctggccaagtttcccctttttataaggacactagtcatattagattagggcctgccctaatgacctcattttaacttgattgcctctataaagaccttatctccaaataaggccccactctgcagtactgggggtttggactccagcatattttcttttttgaggatacaattcaacccataacacccacatggccaccaactgctctcagtttttgcatcttaccatttgcactactagatactacattcttccttcacttactgatttcagaaatcccagggaagaattctaattggttcatctttgatcaggttctggtctcctcaagggaagaaaccgggtctggaacgatgactaactcggcgttgttaaggtgcccagccctgaaccaatcaatgacagccagtgaggcaggattgtttaagaccatgacaatcgtcatgggacccatgaatctgtcagatcagtcagtccatgctgggtacaaatcatcctctaaatcatagagaattgatagcaacaaggagttcatcctgtcttacactccacatcttctatgggcaatagagatggtgagaggagaggggtttctgcttattgtagtccccagggacccagactgacaagccatcccaactgtgct

SEQ ID NO: 66622 - DNA, 1020 bp, Homo sapiens
cccagtcttatcatgagaagaacattagacaaattccaatagtggggcatcctacaaaaacctttccaatactcacactaacagtcaaggccatcaaaaacaaagaacatctaaaaaattgtcatagccaagaggagcctgaggacacatgatgactaaatgtaatgtgtcctgcatgggattccagagcagaagacattagggaaaaacgaaagaaatctgaataaatcatggacttcatttaataataatgtttcaatattggttcattcattataacaaatgaaccatactgatgaaaggtgttaatatggggaaaactaggtgttaggtatagcaggtctgtgctatcgtggcaatttttctataatctctaactggtttaaaatttttattaaaaaacaggagacttttttaaaattagaaaaaaatgaagtgggggaacatatgtaacctccaaattttcttgttttttttttcgtctccagaaaggactctttgttttccaacttggcttctcccctgacaaatgcgttcagcttcaccaaggtagaaataagcacgtgtgtctgcgtgggtgggcacgtgaggtctgagaaggtgggtggggatggcgaggtggcaagcaagtctgcactggagtctcggcattggtttcctccctggaaccaagagaggtttcccgggaggtgaggcatgcggcagttcattaacagccctgctgttctgcacctggtggtcctttcagttcctgtgggcgacattggtctgggacacttgggtcagtcaataaaaggccacctgtgacaagggcctgagcagaagcaaaaagcaaatgtgtcctggctctgggattccagagtcccctgttctgacagtgggaagctgacctctgctgggaagctggcccaccacccgaggggcctgctccatggagagcttgcaagtctttgtcccttcatttctagtgggctttattttgcccttgtctctttctcagtcccggcctgtgtcggtctg

SEQ ID NO: 66623 - DNA, 1050 bp, Homo sapiens
tgtttactgaatatatgcatatttgctatgtgtcagagttcatgctagacttgggatgcagagctagataagaaatagaccagtctgtagtggtggagagagatatgttagtaaataacattgtttgggaagggaaacccaaggcatggcgtctgactcagtctggcagcctcagcggaggcttctagaggggctggcatggggtcagggcaactgtgcatatacaaaggcttgaccctgcattgcccatgtggggagctaaaaatgcccaacaagcctagagggaagggtggttcctggcaaggcagagaccaaaccatgaagtgctttgtgctgtgaatctggaatttcacctgttggcaatggtacaccccggacagttttaaccaagggagtgccatgggcagggagctctaaaccactccactctcctgacctcacttgggtgtcctggtgagcttttgcccaggttccaacctccaaccagatcactgattcacctccttttctggctgactgaggatctatccaaacagcaattttattctcccagacactgctcacccacaagagttcggaatcacccttggagaaattcctttatattctccctgtgttctggacacaatgtgtcttgaatattagcacaattcactggactggtgcctgttgagtgtgtggatggcgaattgttttgggatgcactcagcagctcctgcctcaccacatctgcccatcatcctggagtgcctggtaggagcagataataaatgggccagctgccacctcctgcttttctaatcatctgtcaaagaaatggaaaactcactcgcagtcactgctgaatgcagatggggtcagtgcatgttgggttcagaagtaaggaaaaggaggggcacaggctggggctgcccgtgcagggtttctgcgcctgaagactctgccccagcatgctctcttggccttaacctgccctttcttcatgcgtcctgctagcctctgtactatctgaaacagtcctcaccagcttcacttcagggccccttacac

SEQ ID NO: 66624 - DNA, 2082 bp, Homo sapiens
gcgtcacaaagtgttagattacaggtgtgagccactgtgcctggcctgcacctaattcttgagtcctgtattagtctgggttcttcagaaaaacagaaccaacaggagagagagagagagagagaaagagatttattatgaaggtttggcaattatgagggcttggaagacccatgatctgccaccttccaggaggcccaggaaagccagtggtgtagttctggcccaaaccctaaggcctgagaaccaggggagccagtgtaatatgtcccagtttgagtcaaaaggctcgagaaccaggagttctcatgtccaaaggcaggaggagatggatctcccagcacaagcacagagcaaattcaccctccctctgcctttttgttctattcaggtcctcaagggatcggagtgctgcccacacacattgttgaggggggtctccaatctctcccagaaacaccctcacagacacaaccagaaataatgtttaaccagatatctgggcattcctcagccctgtcaacttgacacatgaaattaaccctcacaggtcccatccccctgagtccccaagtccaggacagctggacaagtcaaggaagggcttccttacaggtaaatagagaaatacaattcagacagcactcccaaaccgtgagtgcatattaatctgcggggacaaatatcataacataattagtacagcagtgctcccagcttaattgaaaatgctgcatatgaggggcagttaatgagaaatgcaagatgtgatgattcagaactgctgagatttagcagctcggtggctgtagcgaggaagtgttgggcttttttccctttgctattctctttgtacatctggacaggaagggggctgaaaggagttactaacagtgtgtatggttagagaactttgattatctggaagtccctcagctatttggaatgcagcagagagctagccaagcaggaaacgaaaaagagcctctgagccgacaaaacacatttctatttggccgtgcactgcagtcttcagatttttgtgatacgaaatcctctcaacccacactcacaactgatttgtttgtgcttactttatttttttatttttttgagacggagtctcgctctgttgcccaggctggagtgcagtggtacgaacttggctcactgcaacctccacctcccaggttcaagtgattctcctgcctcagcctcccaagtagctgggattataggtgcctgccaccacacccagctaatgtttgtatttttagtatagacagggttttaccatgttggccaggctggtgtcaaactcctgaactcaggtgatccgcctgcctcggcctcccaatgtgctgggattataggcatgagccaccatgccaggccctatgtttactttataccagagtttaataagccaggtgatctgatttcccaggcattagcagaactgtagcagggcatcagggcagtggtgggtggggcctccggaggagcttgtctctccaccctgtcttagtccagtcatccagttaatacaggtctttaaggcgcaatgtatgtttggggcataggggagataaagacataaaaaaatctcttctctttaaggagcttacagttttgggacagacgggtgttggctcagtcaatgttcttagtttcagacaacagaatctattctgtctagtttaaacagaaaaggatttaatacaggatattagatggcctgcaaacctttcaggaatgccagggactcaagcttggctgccagagaaccagagaagtacctggcatggcatagggctcctttaacggaatcccctttgtctcactccttgggactcaacattccgggaaccagacagcagagcctacgccacagctgtccagataaacaaacacctccaccactgtgtgggtgggaagatccagtgcacccgagcatagtcaccacctcctgtaacaacatccgccctctacaatcctgtgggtgcatttgctccatagaacttgggtctcgccgcaagggagtcagtatattgtttccagctgtctaggctcgtggaaaag

SEQ ID NO: 66625 - DNA, 3829 bp, Homo sapiens
ctctcagttgccgcctgctcttggctggcacatgacttatctgagcctcagcgtcttggttagcgccctgcattagtgcattggaaatatttgctctcctggtttaggaaaatgcctcccacagtcccggctccacgggaggctctcggcactgttcttcctgcctgtccctggtgagcgggtgaccttctgccccctctgacactggcccaccctggagacagtggctgtgttcttgcagccctccctcctcttgtgtttctgtttgattctcatgattcaatatcccctgcagcgttttgttgtcattttctgttttactcttggaaagctcacagggtttcccctttgaagtgtttcattttttgtttgtttgtttaaattcagcattgccctctgattggggcacatccagtgactttatagcacaaattcagaaagagagttgctccagtgccattcaaaatggaccgcaaaatccactgtgccgagatgtgtccgagtacaacgacaagacagcccatgcacaccgtggtgcctcacaaaaggagaaaacacaatacctggagtctgataaatgactgaaaagtgctaaaaatgacccccgaaacacagacacctcctcccctgttccctgcctcctaccgtgtcatgaatttgtgatggggacaaggagcacacaaggcccccctcagtgccccgatgaaagtcactgaagccaggaacaaaagtggagccccagacaaggggaggggagcagaaagggggatggaaatccactgacccttcctggagctcccaaggggcactagaggaatgaaaacccttcctagcccccaggccccgaacaagtggcaatctccctccccagggtacagagtttaaaaatgcatcagatcaaggcctgcatggagggatacctcacacactgtggaaggggcagatttgggaactaaagtttggcaataagactcaagagcctcaaaaaagtctacatgccttgacccagtaattctgcttctgggaatctgtcctaagaaaataatatgaaatgcagacaaaaatgaatccacacgggtgttcactatagctttatttatgtgagtgaaaaattggaaaccactaaatgctccactttagggaattggttaggtaaattatggttcattcatagagtggaatattttgtagccgttaaaaatgatgtttatagagcttttaatgacatggggaaatgcttatggtatgcttatggtgattttataccctgtcttttgcaagatgtaaaatcacacacggtgtgatctcagccatgtaaaacagttacagaaaaataacaggaaggaaaaacacacacacaaactgttaacggtagttgtctctgagtggtaggattgcggatgatttttcttcttttctttccacctttctggttttttatttttatttttttctatatttggaaactattggtcatcggtgttgggtatttatttaagcctcacaggcaatgaaggaaaaaaacatcaccattagtctgaggcctggcgagggatatgacagctgtttttccctcctgaacatgcattgcttttgaaatcagagaaaaaattaaataaacgttatttaccaaattaaaatcaaatcaaaataaataaagcatctgagcccctgtcgaggaaggcctctgctcctaaaagaagcgatcgcctgcttccagcttatcatttttcagggatcttaaaaaaccagccactgtgaaattgacttctaactgatcttaattgagatggggcccaaatgcaaggatcagaaatgaaattcgggctggttgccttatggctgggctgccaaagagactctgcacaatcccaggtcacagaggagctaactggagttacttctctgttccggattccacctgccaccttccatataagactccagggtcctgccgcccccttgctagttttttaccagctcagggatgagtgggggttgatttgagactatctgggcttgaggggattcttaaggctggtggctgagcattcactccttaaccctaccaacctccgccccccaccatacacatgcacacacacacacacgctcacatgtgaacacatcatcattgattctgtccctctgcacaaatgcatgctgcgtgtagtgacaggctacaatgagtgggcaccatgctaagtctctaaagtgctttaccttgtttaattcccatgacgactctgtgatttaagtactatcaagcctcactttagagtgtggcagactcaaacattcttccttctgctggcatgtgcagctcctatgattttgggagtgagcctgatggtctcatcggggtcccctccaacttcagagtgacgaattctcttaatgttaaaagccagccatgcaggccccaacacacaggctacaggatgctgaggccctcccactctctccaagtcacactgccagcccgtccctgcttgccaccttgctgcctggccctccttccctgtcttcctccttttaggtttctccctcccacacacaaaacccctcttccagcagtctactgtcagattcattcattgctttcttagatagaacaacataactcttctttgtctaaacccaggaggccttccctttcatatccaaacaaactcatcatggtatttttccttgaaaaaaaaaagagtgctttatcaaagatacattctgccttcttttcaagccactcagcatcactggggccagcattttaaaactactttgtgtgtgtgcttcttattgctctgtatgctgcaaaataaatacagcgctggaagacttctaatattaaaatgaagagaatatatgaaaaaagaaataaagcaactgatgtgatttaaaattgcaccaatacaaggtgctgtggtactctaatacatctgaaaatctctgcaagataggtgattttccgggaaaatgaaaattagtcaaactgactcccaaaaaagtagaaaaacttgaaagaaaaaaaattatatgcaaagggcccgttgagaaaggttttaatggaatcatttatttttaaaagaccccaggctaagatgattcaatgctgaaactttccaggtagcaaaaaacataagattcccatgcttgcatagcagacaagcgttggggtcagatggccggactgaaatcctgctttaccatttaccagtaaatggttactagtaacctggttactaaatggtaaaccagtttaccatttattagttgtgtgaccttggatgagttacttaatttctctgaatttcaaatcccatagaaattcagccaaggaagtagtcacaataagacagcatagtccaggtgggctttctggaggaggtggcctatgatggatttgatttattggcagtggctaccagtagcctttccacattattgctcagacctgttaaaatcaagggatggacttataaacttataagtttataagttataacattgcccagccaatgttagggtagagtccatgtcatggaagtgctgagaatccacaagtcccattgttgcttcttgacttaggcacagcagcattaaattctatgggcagcagtcattcagtcctcataatgaccctgtgaggtaggtgctgttatcaccctcctgagggacaaggaaactaagctaaagccagtcacagagagtgcctcacccagggtcacacagctattaaatagcaaagccaggatcgaaactcaggcagcctggctctagagcactttaccaccatagttttctgtgacgagtaccttgcgtttggaaa

SEQ ID NO: 66626 - DNA, 1033 bp, Homo sapiens
gctaatttttgtatttgtattagagacagggtttcaccatgttggccaggctggtctcgaactcctgacctcaggtgatctgcccacctcagcctcccaaagtgctgggattacgagcgtgagccactgcacccggccaattgttttctttttctatcttcctttctttttctataaagtgttatatgctaggtacttttcacgtgacatctcatttaaccttttcaaaatgccacaatgttggttccattattatccctgcttttcaggtgaagaaactaaggcacagagaaggaaagtgacagtctgaggtcccccagttaagtaggtagtggagccagggatgatatgctcacttttccctctagggagggcacccagccaggactctacatgaaaaaatgtattttgatgctggctaatgccctattgacaactgcacactgatccacgtcctagttcaagttttgttactgtaatctgggctctgacaacatatgaagtttcttccttcagtatgagaagaaagatagggagactgagaaactttgtcaagtcagtcagtcaatcaaacatgcaatggctgcagggcttctgctacctctcagaggcttccacgtgcaggatggcaacttgggagataaggtgtgcctgcattcagtcagctcagaagattcagtccagtaggagagcaccatggccataaacagttggcatgtacagagctgggtttctgtgctcagtgacaaagataaagggctgtgaagtttagagccattcttcctggagaaatcaaggaaggctttctgaaggaggtaacctctaaatccttacttccttagctaccttctgctgttagagggtgagcccaccattaaagaagcattttcccccacacacagcctctttgggctctgtcttccttcagcctgaaggtctctggttgtttaagaaaactccgggcaaaaatttcaccccttgccctgagtcttttccccaccttccctttctcccacctctacagctagtctgc

SEQ ID NO: 66627 - DNA, 1258 bp, Homo sapiens
gtgccggccaggcgtggtggctcacgcctgtaatcccagcactttgggagactgaggcaggcagatcacttgagaccagaagtttgagaccagcctggccaacatggtgaaaacctgtctctactaaaaatacaaaaaatcagccgggcatggtggtgctcacctgtaatcccagctactcaagaggctgaggcaggagagttgcttgaacaggggagacagaggttgaagtgagctgagatcacgccattgcactccagcctgggcaacagagcaagactccatctaaaaaaagaaaagaaaattagtgcagggcacaaataggcagtgtgctgggaatcactgatgcacaataaaagtttacgtaataaatgagtaatgccgccactactgctcatagaaattgcctgttcagctcctatttggtgccagttactggaatagtcacctgacatacatcttctgacttaatcttcaaaacttcctgagattgctcctattttaaatatggggaaaccagcagagagttgttagataaatcccaaggccacatagctagggagtgacagatctggaattcaaatccaagtgtctggttttaaatgaccagcttattaacattgtgtatagagaaagtaaaggagttggtgtagtatttctcacataaatactgcgtgtgaatattgcgatacctttgggttgctgagaggctttttggcataattcctgtttctcagaaaagtttcagatggctgagtttggtgggtaaatgaatttgaaatagaacccagcactgtccctgacacatagcagaggcctaataaatatttatgattcaatctattcattaatgatttacttgctggtgaggggttatgctgtcataccttttaaaaggtagactagaagcatgatggaaaatgcatgggctagatttggaattacagggacctatgttcaaatctcggcttttgtgcttactagctctgtgcccatgggtaggtaggttaaatatttctgtgcctcagtttcctcacctgcagaatgggaatgatgaatatctctatagtttatgtgaggatttaataagttaacacatacagtgcacttagaatagtccctgtaggtagtaagtactagataaaagctattattttttattgtaagcactcaaacaaataagaattattagtaattgttactgcatgctactagggttgtgtcaatgatgctaaataaaaattgaagaccaaattat

SEQ ID NO: 66628 - DNA, 1092 bp, Homo sapiens
agcctctttgggaacattgatgagtttgctcaggccttacggtggtcaggccctgagtgtgagtttgagtgagtgcagtttatgtttttggccccagtggatgggctgttattcctttgtctgttcatccattaatccaacaagcatttgctgagaagcaatttggtacagaagttaaaagttggggcttcacagacagaataagccttagttgttgagtttactttcgtgtgacactgggtaagttgcattccttcttggagcctttgtcttttcttcaccgtaaaatggaggtaacaatgtctatctcagaattctaaaatctgttgatataatatatgtattaagcaactgtactgtcacaatcatgctgcattaacaagccacttgaaaattcagtagcttaaaacaatcattgactcttactcgtctgtctgggagtgagctggggtcagctgatctaaactgggctctggggggtttaactccaatcagcaggtggatccgggtctgctccatgagtctctcatcctccttggacccacaggagagctggggcacattcttttcatggcagcagaagggagaggtcaagctccctagtgggtagggaaatgcactccacctgtagtaggaagtactgaaaagtccagggcaaagggcacgaggagaagggtgaagaattaggagcaatgattcaatcttccactatagatagttcacagcacccagtagttgccctagttttctggccgacaaactagagagtagaactgcttcagccaggcgcagtggctcacgcctgtaatcccagcactttgggaggccgaggcgggcggatcacgaggtcaggagttcgaggccagcctgatcaacatagtgaaaccccatctctacttaacaaaaaaagaaaaattagccgggtgtggtggtgagcgcctgtaatcccagctactcggaaggctgaagcaggagaatggcgtgaacgcgggaggcagagcttgcagtgagccaagatcgcgccactgcactccagcctgggcgacagagcaagactcagtctcaaaaaagaaaaagagagaacttcttcgc

SEQ ID NO: 66629 - DNA, 1047 bp, Homo sapiens
tccttgaccaagctgtgcaaagtagtctgcgtaggtacataactgatgaaaccctccttttggccaagcaatattctcattatggcacacctacttctgtcctaggaacaccctccaactcctttgagaaatacgagctaattcaacactgagcacgtgacctagtgcactgtaattctctgcattgtgaaccaaatatgtgtgatcttcactattttggaatgaaccagaagaatgaagaaactatccctggccatacagctagtaggtggggggggccaggactggaactcagcttcagattgctcatctcgggcatgtttttcttcagatgagcataaagatgatttgcctgcctagagaggtgggcggcttgcatgaataaatgacagacacatcattctagtgagccagggagccggtgggggagcacttgcttaaaaagagacaaacagctttgcctgagcctccctggttgaaataactgcatccgcttaagcccctggctctgttagcagacaaggattatgtgatgtgctcagaagcccagccatctattggtatttaatgcattcactgtcagtaaagattccctggtgcaggaggctgataggatttagagatgcaggcaggaaacttctcacatttggaaactggtgtattacaagtcaaggccactttcacttactgcacacttgaccttgtgaaataaagccctgtcctggcccttaccaaggaaggatgagaagttgtatagagttattgaagggggccagccttagaattcacaaagacttgagtttgaatggaggccccactgcctactagcttggggaggctggaaaatggaagaaagtaatgctttctgaccatccattgtataatagtcacctgtaccagtgtggagatgcattaattcacttaaacctttggttagccctgcagaatgtagatgtagttgtctccattttacacatgaaatcaaggctcagaaaggttatgcatcttgtccaaggtctcatcatcgtaactaatagagaggcctat

SEQ ID NO: 66630 - DNA, 1144 bp, Homo sapiens
gtaggccatgcatagggaggtctaggcccacttttctcatatgtggttaagtttgcacagatttcaataaactggagggtgtgttggaatcagtttcccatatataccaagggagagctgtattcgtccctggttttagtagcattaacagtggtgctggtcctgggttactagggttactgttagacattggaaattgtgatactgattaaaactaatcatgtttactactttccattggctacctggacatttaggggcaaacctgcataccacctgcaacaagtgtgaaggagttctcagcagacattttctgtagtaacaacagctcacattttactgagcatttattgtctacatggactctttgcacctttctttctgcaaactccatgtttctggaaaaactagagtgcacgtctcacttttgtaaaacaagcaatgttctcaatgcccttgggaaataaagaaactcatttgaattgtagatttttgtgctgtacataatgacctcgttacttcaccatgtttgcggtgccatttgctggtttttcagactcccccttgacttacagacaaggccaggtgggcccagctgctgcctctgagttggctgtgaactcagcttccttcttctcagcccagcaaagtctctgctcttgctaggagtcagacggccagagcagagccctgacggggcccacagttgtggacagctttgcactgtcatgcactggcccagagacaaagggaaacgggagggcttttattggtcacctgcctccatgcattgggttcctgatagatagcagatggagagacacgggagttaatgaggtctgcgttctggccaaatgctttccatcttcctctcgccactgagcccattggaaaagaatgttgtgctgggcaggtggtcagggagagctacaaaagctgagctttcagcaaaggtgttagggaagggagagagatagcatgcactgattcaattcgactcaattcagggaatatttattaagcactgcctctattagtcacctatatgtatcatctcatttttttcctcgaagatatcctcccatgtaattgtcattatcctcactttacaggtaagatacttaaaagactcagagatattaag

SEQ ID NO: 66631 - DNA, 1012 bp, Homo sapiens
tctctcatgctgttttattataatcctactggaagatgagaagcgagaaagatagagtttattgataggagagaaatgttaaaaaaaaatcacacacaaggctgacatggatatatatgtgaaaagtagatgaaagcaaaatggctcagagccgcacactccaatggaaatataatatttttaattttctagtagttgcatttaaaaaaatgaacagaaacaggggaaattaattttaatcatacatgtaacacaatctattcaaaatatcatttcgacatgtaatttgtttaaaaatttaagaaaaatgtaaattcttgttttcactctaagtctttgaaatgtgatatgtattttacactttggatgagccgcgtttcaagggctccatagccacatgtggccaatggctgcagtattgaacagtgcaggcctagactcctaaagtctttatcacgcaatgtgaaactgaagaaccaaggaatgtccgagacccacccactcaccccttcattcatgtgcctagggcttctgatataaagtcaaacaagaaatggcctgtgtcaccagggagcatgcagtttcatgcattacaaggcagtgagctagccatctaaaaggaactgagatctgtcagtttgtccggggtctcaaactgagggctgtaggctgtgtgtgccatttgatttttcctgtactgtatctcaaaaaacattctacccaggcaggtgttatgcttcgtctacaggcagctgaacacctttggccccacacctggctgcctccactcattaggttgcctgcagaccctctgcagacatttgcctttgataacccaggaacaggtgtctctgagaaatcctaagtgttgacaagaccagaggtataaacagaatggacttagagggcatccaagtcgtggtttgcagcccctgcttatgttctagaatcacctagaacagtttttgaacatactattttgggaccccaccgtcggagattctgattccat

SEQ ID NO: 66632 - DNA, 1042 bp, Homo sapiens
cgagggccctgaggagccctgaggagccctgaggagccctgctctctcccaggtaggggtgcagcctcgagtccccacccacgcagctccctattcccctcctggaagatgctgctctcatctttgcctaaaattgtggctctagagagtgctttatttctgctttctgtctgtagaagcccctgggagacagtctgtaggaaggctttatttttgtttttattctcttcaggaagccatgggaaaaagaaaaagtagacacattctctggctaactttggatacaaccacttaatagcagtaacacagcactcttgttaaataatacaaacagaataaaacgaaaatggtgaattagttatagctttattgcagcattaggagataagactatcacagcatagtttttaactaagaattttgtaacagtaattttagctactactttgaacagcatgttcatgtacaggtgattctcattttttacagtagttatgttatataaagtaggtgggaatcctgaattagtgagtgtggaacctttgctcctaagggaaatacagggttaggttcctgtaagcctctgatcaaaacatttttgtcagctcattaatacatcatctggtttcgtgtgtgttctatttaaagacatcttatctaatatatgtttttgattccttgacattgaactctcagccagcaatcctataactcatgcctgaatgaagcttatctagcacatacattttgcatataacacatattacagccttcttgcacttaggaacaccagctagcacttcagcactatgcttggtggacatttcaagcaatgaaatcaccaacaaaaagcacagcacaaaaatgtgaaaagtgtagtactaaatagattgcaaaaaggaaactttttacattatgagagttgggacaagaaggcagagtgttgttttgtttaacctcagctgggaactttgcacctgatgagtcaaatttttcacctctttatgcatggtccacaaatgaccatgatagtgttgggttt

SEQ ID NO: 66633 - DNA, 2867 bp, Homo sapiens
ctagccatcaaaataaagaagaccctcagaaaactatgcagactccaagagtcagggccaaaagcacctttggggtttctctgtctgcacccctattttctaggtggaaaaaccaaggctcagacaggcctaataagttactccaagtctgcctgacagcagcaggcccccagttcacatcccctcactccaaaatcagcactttgcttccctgcccctaactatggaccgtgcagaagtagcacactcacaccattttcaaaagattttctgccagtgttgaaacaaacaggcctgatgacatggtgaaaagccagggctttggagtcacaaagacctgggttcaaatcccatctttgcgttgattagacattgtcagggggcaagttactttcacttctttgagcctcaatgcctcatctgtaaaatagggataattctacccctctcatagagttattgtaaagatacaatgaaatcatgtacacaaaatccttagcagtgttcctggctcagagtaaatcgtcaacaactgttagtgccccctctatctggaagctgacaaattcaattaaccagaaccacccatcctcatcccaatgccctgcccatttcccaaaactccctgtttgcagaatcataaatctcgtgtctgaaaaggagctccataaatcacctggcacagcccctggtagcagagctctctctgtatctggctcagtgtgttctgcagtcttttgctggctcagcctgcctcactccttactgtaagcagaagaattcccaccagcacagccaaaaaaacagaataatgctgtcagtggattctacaaaagggctaatattagctgggcaggaggattgggggtgggggtgtacctatatttggaatctatgtcttcagccctttcctgaggcagcagaagttggggggatgggggaaggggttattgccaggattgggcagagcagctgggctaggtctccccttctctctgttgggtgatttccttctccccaggatgtgggtggcagaggaaaaaggctgctgggagggagaggggaggctgcaaatggtacccccaaagcagcaaggagtatggcagtggtagaggcccccaaagtctcctgtaaggatgacagggccattggaacctagctgtagagagtcctggaggggtgggttctgtaaccttctactccaagatgggatccaaagagcatgtttctggctgtgtcttcctggagaggccttggataaaggcccaggcatcagggggcgctgggcctgcgctaggagaaagatgcatgccggatgtatccctagcagcagctctttgcacattctcccacccccctccaaacatctacactttctttctctgctcttaaactcatcttggggctccagtgtccccctctgtgaacacttcctgcctcctggagaccctgctagcccttctgtgcaggttagaagacaatgcccttcctccaggcagacatagcccggcaccggggcacaaggctgggtgagcagagtgtgagctggctctgaggtccctcctgtcctcatgtcttatacagtatgccattagcaagtgaaggccacagcatactgtataagtatacttggcaacagctttggggctgaatgaaatggccagtggcctgaggtccagtctcctaggtagtatagcaggatgattctcagtaaggatccttcccataccaggtcttgattttcctgcccttaaaatgaggagggtgggtgagatgccctccagggtctctttcagctttacagtctatttatctgctcgtttttaggcggcataatgaagatataatcagaaaagcatgtgtgctctaccttccccccacataaaacccatatgatccaaagagaaatggaaattacttttgatttattcatggtctgatgttgctgttatctgctcccttctgctagggtcttaggctggaccaggaggcctgtctatacaggatgctaaggattacctgtcacccagggagaaccaacttctatttgccctcaagctgcatctgcagctgtggcactatgatggccctgggtctggaagtttaacccaacaagacttgggaaacttgaacaagtctgcagtggacttaatgactgttttctagcatcatgtcactgttttgaaacggttactgggctgcattttctgtcttcctttttctatcttggagagatgggcaggaatcagggaaggcctggggagtggagacaaggctagcaggaaaatgaggaaaccaagggtgtgagtacctgcctggtggagttgtgttgctctcaattggtttgcttgtttgcaggccgcagggcagcagtgtcttctcacctgcagagtgcaaagcgcatttctgggctggcacagaaacatgcttgccctgctttgcctacaggcatcttttgcacataaataacttaaaagcaccaaactttgcaggggaaatgtttgcatgtggcttgcgtctgagaagcacaggcatacacacataaatgttgaaggattaaacacacacaaacacatgcccgcatgcgcgcgcacacacagacacacacacacacaccccgctcacacatacccagcaccttctaacttctttgaggattgtttattcccatgaatagattttaacttggtgatttttagagtcagggaatgttagggctggaaggaatgtaggagattattcagtctgtcagagttccaacttttactgaccacaaagacatcttcaaaggaagttttacagggatccaaagtgtataaaatacagaaaagcagagatgttctggataaagtggtgaagtgagggag

SEQ ID NO: 66634 - DNA, 1012 bp, Homo sapiens
gttaattgggacaggtgactacaggagccacaggcttggaggcagggacacggagagatgggaatcacagcctcctatgtgtcccggggccaggcgtgggtgattacagcagccctaaagcaggtgtagtatagtctgtgctccggctcgcttcttccctgtgtggttcccatgtgtggcatccactgcttctcctgttcccactcaaatgggagggggccagctaagggacttacaaagcccagagccaggccctggagctgtggtggcaccttgctaggtctccagcaacttcacttagtgggtggcaggctctggaatgagtaggatatgcctgcccactggagccacttgctgtggggagatggccacaaaaggaggaaggtaggccttttggagctctttggaggctgcagtgaactctgacttgagaagagagggaaggagaaggaaaagctgtggaaactacagaagactggtatcttcagctattaataatgctgtaacaaaatacttgaggttgggtaatttataaagaacaaatttatttctcacagttctagagactggaagtctaagatcaagatgaaacaggtttgatttttggtgagggcttggtctctgctttcaaaatggcactttttgctgccacatcctccagaggggaggagcactgtgtcctcaaatggcagagggaacagaagaggcaacaaaagggggccgagctagttccctccaccccttttataaggcactaatctattcacaggggtagagctctcataacctaaccacctcccaaaggtcacacctcttaatactgttgcattggggatcaagtttcaaagtgaattttggagaggacacattcaaaccatagcaagaggatatttgatatgcatctgaaagggtgaaaaagagctcaccagacagaaaagtacgcagagggaaagttttcataaaggccctgagacctggaaggccctggagtcctagagaaatggggagaggc

SEQ ID NO: 66635 - DNA, 1112 bp, Homo sapiens
ggatttccctaatgatgaatgatattcagcatctttacatgttcagaggaatgtcagaggaaatgtgatccacatggaatcatgaaagatgcataggaatctgcctagtgggcctgtgggacagggccttccaggcccaagcagaaccagcagttcagtgagaagagtctaactgcacattcagagacattcacaagggctcaaaggtacagcgctgaattggagagaccccagaaggcggaccttaaaggacctgctttgtgaaggagtctgaactttatcctgggacattaaaggttttaatggtttgggacctttttctagaacccagttatgccagagaggcagaattgatatgagatttggtgacaaaggccattgtagcccttgcagaattgtccttagatgggatgcaggcctcctggggacttgtcatcaagcatacccccgctaggagccttattttccctccatggccctacagagagccatcccacatcaccaagaggtcaaactaaaagtttttaattctgatcttgactatgatttccaagctggggcagataactctgaatttcactttctcagtgataaaataaggaccttgatgcctacttcctagggttgtcgtgataaattaaaactaaaaaagcattctccaaaaactttcaacaatctccactggactaaagatggacccatctcttatgaaaataagactatcaatgttgggagctacacagacctgggttcaaagcccaactctcccaatggctgcttgaccgtagacaaatcagtgaactttctgagtctccatctcctcctctgtgaaataaaaatgatcataatacctccctatggggattgctgagaggagtaagtataataatcactgtgctgttcctgggcatatcaaaggtgctaaggagttgcctttgagtctgaatgtgaacaaggaagctcccggaaggctgaggtgcatctccttcatctctatatgcagagcgtaacgccatcatttgacgcctaaagacagcccagtgtttttgtagttgaattcatttgcagctctcaaccctttactcattccaggtttctgtccagtggaaaaa

SEQ ID NO: 66636 - DNA, 3691 bp, Homo sapiens
cttgcctgttctgaacattttatataaatggaatcatacaagatgttgcctttgtgtctgttttttttttggtttttttcacttagcataatgtcttcaaggtttatccatgttaggcatgaatcaatactttattcttgatacaccaacacccatacccacccacacacacacacacacataccacattttgtttatccatttatcagttgatgggcattagggttatttccatttttaactattatgaataatgatgctatgaacattcatggacaagtttttatgtggacataaatttcagttctttggggtatatatctagcagtgatattgctaggtcatatggcaacactatgattaacatttttagcaactgccaacctattttcaaatatagctacgccatttcacaataccaccagcaatgtatgacatttccaatttttttacatccttttcaatactttttatgtcttttttatttccttgtgggtttgaagtggtatgttattgtggctttgatttggatttccctaatgatgaatgatactcagcatctctctttttttttatttatttatttttttgaaactgagtctttctctgttgccaggctagagtgcagtgacaagatcttggctcactgcaacctctgcctcccaggttaaagcaattctcctgcctcatcctcccaagtagctgggactacagatgcccaccaccatgcccagctaatttttgtatttttagtagagacggggtttcaccatgttggccaggatggtcttgatctcttgacctcgtgatctgcccacctctgcctcccaaagtatgctgggattacaggcgtgagccaccgtgcctggccaatattcaccatctttacatgttcttatggcaattttttcttgtcttctttggagaaatatttattcaagtcctttgcctattttttaatttgggttttatgttgtttattgttgagttataagagttctttatatattctggatacaattgtctgatatatgatttgcaatttttttcccattctgtgagttatctttttactctcttgataatgttctttgaagaacaaaactttttcattttgaaagagtccaatgtatctacattttttcttttgtcacttgtgcttttggtgtcacatctaagaaaccatagcttaatctaaagtaatgagaatttattcctgttttctcttaagagttttatatttttagatttacacatggatctatgatccactttgagttaatccttgtattttgtgtgaggtctggagcaaacttcattctttcgcatgtggatattcagttatcttggcatcatttcctgacaagactttcttattgaattgtcttggtactcttgtcaaaaatcaaatgactataaatgtgagggtttatttcaagactctaaatttgattccattgatctatatatctactcatatgccagtaccacattatcttgaatactgtagcttcgtagtaaattttgacattgagatgtggggttcctccaacgttgttcttctttttaaggattatgtgaatattctgtgttccttgcatttccatataaagttcaggatacactagtaaatttctacaaaagagaatccagctgagattttggtagggaatacattaaatctataaataaatttggggaatatttttatccaaacaatattaaatctcccaatccacaaacatgagatatcttcccatttattcaaggcggctttaatttctttttaatctgttttataatatttagtatacaagtctttcacttctttttttaaatttattcttaaatactttatcctttttgatgctattataaatggaattattttcttgattgcatttttggattgttcattgctagtgtatagaaatacaactgattgtacattgatctggtatccttcaaacttgctgaacttgtttattctaatagctcttttgtggattccttaggattttctatatataagaccttgttattgatgagtagagatagttttatttcttcgtttctccaatctgaatgtctttatttctttttgttaactaattttcctggttagaacctccagtacagtattcaaagaagtgatgagagcagtcaccttgccttgtttctaatcttagggggaaagcttttagtctttcaccattaagtagaatgttagatgtgagttttttgtagatgacctctatcaagttaagtatttcttctatttatagtttgttgggtttttttgtcacaaaaggatgttagattttgtgaagtgctttttccatgtctaatgacataatcgtgtggtttttgtcttttatggtcttaatgtggtctattacattgattggtttttgtatgttaaaccgaccttgaattccttaataaatcccacttggtcatggtgtatagttctttttacgtgttgttggattcaatttaatgttatcttattgaagatttttatatttttataaaaatttgtatttttctatttttgggagatattcatctgtacttgtgtgtgtgtgtgtgtgtgtgtgtgtgtgtgtgtgtttgtgtgtgtgtgatgtctttgtctgattttactatcagaataatgctggtctcatagaatgagttggaaggattccctccttttgtatttcttgtaagagttttataaagaatttgtgttaatcttgactgtattttggaaaactttaaaaggtggtgataagaacaaggcttactacagctaatagtcatgccttatcatgtgcttgtgtcagaaaaacaacaacaacaacatcctacaaatgccagaaacaacactgcagtgaagcctgaaaatttccttacgggcagggcagtgagtctctggccattatgccaggcaaggtgcttaatactggggacccagcctgggacagaatgctataattcctgcctttttcctgcagtttttttttttccaattttaaatatttccacacaaatgcctgaataaatactccattgaagcaaaactttctccttcataacagataagagattggcctctggaccacatgctgaacaagaccaatgcttacaccattatctcccctggaatccatcctgtcctcctagaaaatcaaaatatccacaagtattaatagcttgccattcaggttaacaaaagaatcaagtgtttgtttttgttgttttttaacacgtaaaaatgaggaaagaatgttactggctgaaattggttagaacagagaagcaagagtatgagattgcaccctggaagccagcagtttctctgcagtaaagataatgatgtgagtccctgaacatgtctaaaagagagttttgaattgtggccattcatttattcagcagtcacttcattaattcattcagcaacgatttatgaagctcctttcctgtgccaggccctggagtatcgggtcacacagaaagaaatccatctgggtctctgctcctaagggccacccaatctgatgagggatattggactctatacaaacaattgctaccaaacatgatcaagactataatgtaggcataaagggggccacagaaatgtagagaaaggagagatcattttacatccttttcagtactttttaatgtcttttttgtttcc

SEQ ID NO: 66637 - DNA, 1161 bp, Homo sapiens
gggtctaagggttggggagacactgaagccaagtaaagggctggttatggcttttgataaatgagaactgtggccagtccagctggccaggtgccaaaagcctagcagtttcacaaggggaccaacctgggtttctgtgctgaatgcctgtgcctatatctaccatccttctccttcaaggaagaggtatttggtagagaggtcttttgcttttagctgagggccagttccattgaaaccaaagatcaattaggctgttggggttcccactgaggcccctattctgtaccagatattcagctaagcatcccactccttcacccttaaggtgtgggctgatgtgtttttggtgttgcttaaatagcagacatgggccccacagcttcctgatgcagtgtgacttctgagctctgacagtttgttgataataccctctgcccttgagacaattacttttttgcctagggaagaatctagaatcctcatgatgagtgaaaagatgggctgatttgagtcctcactctcttttttgctacagatttgctatgtgatcttagacagtcacttgacctttctggtcctcagtgttacctcagtgtcagtgttgaaaatggccattataatgcatcaagcaccctacttgttggggaaccaggagtataatataggtgctctataaatgatggatgtttcccttcctcacccccaactcattacttagtgaggtctctggagaagtgtttactagacattcatgatctacagaacatggatattttctcaaggactacattaaatctttgttggatgacccagggctggatgggtctgggggtcatcatctggcacgctttctcactggaccctgaggagactaggttccgtacccaatactttctaccagccatgatgtggagaagattcctcttcattttctggtacttcacctattccatcttcctttctaatggcatgtaaccaagaatgttcagaagaggccaccagggcagagtgaaagtcatcctgccccatgtgctggttttataaaacgagaacactctcatgatccctccaagacttagtcttctcgtttataaagtagggcaatactactttccttagtagcattctctgagaattgcatgtgataatacacatgaa

SEQ ID NO: 66638 - DNA, 2297 bp, Homo sapiens
acaaacagctctaaatgagcaggatgtgccagcttttctgggaggattccttatgagtacctactatgtactttgcattcattctcccatttaaatgtcacatctttccctgtttggtgtcattccagttgcacagatgagggaacacagaataagccactttctcaataatgagtttcccatcaataaaatggtccaaagaggaagaagacagtcatttgttgtggtggtatcagggattctagcactggatggttagatcatcttctggattacaggatgctcatcagtgcttgttccaggatctgatcaccaccgagatccctggatactgcagtggtacaaagggagcgatggtgaggggagttcccaagccacttccattgttttctagaaatcacacactgatttctaagaaagcagcagaggtagacactttctgcctgtgactggattgatcggatgccaaaaaacccagattctagtctaggttctgcaataagtcttctaggtgacttgggaaatcatttagcctttctcttccttttgctcaaaagaaataacaataaccttaaagagttgctatgtttataaaatattacatacatataaattgaaagcattatgccaatgagagttattagcacatattcttcatcctcctactgacacctttgatctaaaatgattttaaaaagtgagtcacggataaatgctatctcttctagagttggaggctgggaggagaactgactgagaatgagaggaatagagccaacccatcatttatagattagagagcctccaagcctaactaaagtagaaactgctgggagcagtggctcatgcctgtaatcccaaccctttgggaggctgaggtgggcggatcacctgaggtcaggagttcaagacccgcctggctaacatggcaaaaccccatctctacttaaaaaaaaagaaaaagaaaaagaaagaaaaaaggtagaaacttacctctaacctaggcaaaagagaagaaagaattgataacttatctttgaattaccttgccaccaagggaaaaagagaaagctaatggattacaaattattccccttggttaacgttgagtcttcctttgttgaggagtaagtaaacatagatgacaagctattagctaagcagagagaggtatagtttgtgcaggaatggcaaatacttgatgtagtaggttgaattcgccagaaccagactctaggacagagatttgcatgcagaaagtttattggagcatgctcttaggatcagcacctgtaagggagtaagggaagaaagggaggagttgagctgcaaagcaatcacagcaaaaatgtcagctgattccacagggaactctggagctgggatggtcttcagatgtctcacattgagccaaagggagttggccttgttgcccactgcagtgacagctgtggactgcccacaggtgacagctctcttgggctgaaggccattcctggagactcaactgatacctgtcagcagccaacagcaacagtccctgcagctggaggaatgagtgtctcagtcccaaagaaggtagtcagggtggcacatcacagcattaactacatttggcctgtgggctgccattcttttctcccactcccctgcaaacaccactgttgaaacaactctttaccactgcattcagatgagggctcagaattttttcaaacacaatactttggataaacattatcaatcatctggaatttgctcatgaaaaaggatcctatttgctacctttgccctctacacgtgtaggaaacatttattgatggtgtcataataagtcttgagtgttatgattgctctttcaagatcaaacagttggcaaaccttagacaattccctgtacgtctcctgggagacaagattttctcttatttttccttatgatggcctctcaccacacttcatccaagctctgacttattttccccttaccctagtaaatgcagttttccctatggttcattttttttttctcttttttaatttaccacacactatcttgtcatctcacccattcttatttcaaccagcagcccaccttagacatccctccttccccctagttttatatttccaatcatccactaaatctgtccacctgcttagcctctctagcctccatacaaacagcaaattacattcacattagccaggaaagaagctgacacttagctctctcaagatgctttcagaagatgtaacgtcttgcaagagacggagccgggtgttatcatggatct

SEQ ID NO: 66639 - DNA, 3519 bp, Homo sapiens
cctgcctcagcctcccaagcagctgggattacatgcaaccgccaccacccccagctaatttttgtatttttagtagagacagggtttcaccatgttggccaggcttgtctcaaactcctgatctcagatgatttgcccacctcatcctcccaaagtgctgggattacaggcacaagccaccgcgcctggcccccaacttagcttcttactgaacgagcctactcacattctctgtgagattgcagaaaactgatgttgagggtgtgtcctgcacaagcctgcttattcaagggctagtggaggctaaaaaccagcctgcattccacctgccaagccatgtgtcccagaggggctacatctgcccagaagaagagacatctttttcaaattcaggtaaagtcaataacggggctggtagtagccttgtttctttcagcctcaatttcttcatcatttacctaaataggctttagggatgatttgtgattatccataaagtataagtgacacatagagactgacaaatcatagtggtcattagtagctgtaattgtagcagcagtagtagtagtaatgatgtcagtaatgataatgccttatttttgtagtactttatattttgcaaggttcttttgtatttgattatttcattagccatgcattaaagacaggactaggattgctctctctgggacaaagagaaatatgatgtgacttgcctactgtgagcccctgaaggcctgacctggagacagcataagccatcctggcaatgatgtgaggtcaaggtatgcaaaactggggatgcctgggagagctcagaacctctttctgcctacaggtccatgcccattatctaccttggtcctagagggcctgccctatttagaacattctgcctggttcttgccagaaaccccattggtgtgctagcctctggtccctgtggctgcagtcattggctcagaacggggtccaaaccgggtaagccattgagcatcagagtcctgcctcacagcctaggtggacatgttgcctgggccttcaaagccacccagacagactctctaggggtgaggaacaatagccatctcgcatgcattttccaaacaccccttagtcgctgcacttcaactctagccaacagacatttatgaagcacctaccatatacaagacactctggtgacatcttacatacaatttttccctaacacttttttttctttttttttttcttttttttttttaagggacagtgttttgctctgtcacccaggctggagcacaataatgtgatcacagctcactgcagcctcaaacgtctgggctcaagtgatcttcctgcctcagcctcccaagtagctaggaccacaggcatataccaccatgcctggctaattgttttatttttagtagagatggggtttcactatgttgccaagtgtgacccaccgtgcccatcctactttttctgacttctgtacctatttacaagatgaataaccaagtgtcaaagagttaataaatatgccaaagatttcataattattcagtggtaatgctgggatttgaactcacatatttagactagaaagattatgtacttgacttacataaagcatgtagcacacagtggctagcaaaaaatggttgtcacccattagtgatagtgttttaaaaagtgattattaataaagtacttaccatcctgcatcctaactgctggttctcctgtggtcctttcccattggactgtgaggtttctgagggcagaaactgggagtctcagcctttaacagggtacagggtttatagcaactgattgataagtgaatgactaacaatattgaaaatggctacatggctatttgctaagcatagtgctaagtgccttatatatattattttaattctcaaagcaaccctataagatagatactattattaaagccattttacactaaagaaaagaccttaaagagttttgaataactttcccaggttgcatagctggtaagtggctgagctgggaatgggacccagcttgactgacatgaaagcttggtgcttaatgtctcacccagatatactggcctcctgcaggtgttcctgcatgtgccctagccacagccgatgcccatggccccttcagagaattactgggaagctaccattcaaatccattgccttctaatgcagggctatgagaggtttccatttagaagagacaaagctggtgaaggctaggaagctgtagttatgtatgaaagacagcatgaaaagccactgatagaattagcaagaaaagggtgacttcctggggaacaaacccaatttgtaagacacaagtaggggcaaaatcagcctcaagaggtacagtcgtttgagctccatggaaaacagtggggaaatgtttcagtggcatttactgtgagtatttcttgagtttggcaagtccactacagcatgctcattggtggtcgagggcaggagaaaggggaggtcttggtgcattgctctcaagggagggcttttgcttctagtgccttccccaagacctcatggaccgttgacttgtttcatcatgtggagcttcatcttatgcaagctgaagaaacagtatgccggtttcattgctgcaagataattgaccccttgtgacttcatccagaaggtagcagcaacatgtgctcttagtgaaagatcagcagctgggagacacatatgagctgggaaagagaggggcttggagtggctctggacgacctgggcaggactaggattctgatccctgactcctgccagcaccagggctcaatttgcatgaatcaaggctgtgttctaagtcctgggactgcagtgaggggtgctagtgccctcatctataaaagctagaacaggaacaagtgcttggggagactacatatgaatactcattggcagagggagaagtatgctgattaacagcatgatgacctgtcagagccttcatggacttgtctttgggtggaaccagggctttgcccttttggaggctggccctgtacactggagtaataatactgcgcctggaagctggacactgaaggcacttacttccccacttccaccccctcggcccagcaatggcttttaaatcatgctctgcagagccctgagaggttaatgaaatcctctctgggatttccataggagataggcagattttctgctgacttctaggcccccaccctgcagatcctcttctccctgtttgcagggtgggcttccttgttgctagggtggatgtttggctggcacacccccccatgaccatgctgtttggttgtagctgatctccattctcattggcagtgtgcctgtaccacagcaattattaaatgttttgaattttactcttgtttgcaaaccttctttggacagaggaaaaccgtgctgttccatgccagctgcatcctaacttaggcacatcataccagtgatcaaccttcaagccactgctacacagaactaaagc

SEQ ID NO: 66640 - DNA, 3014 bp, Homo sapiens
acaggtggcaagagaggaaaatcatgactggcgtggtgctttttaatatgggatatcttgatagcctctgctctgaaaaatggtaaactctatgtatagaaggaaaaaaaaaagaaaaaaaaaagcccaaattgttggacatgaatgtgttgagattgtggcccttttctttgctttatttctcctggtatttttaatggtcttttatattttgacatctatgaaaaataaaaagtgcccaaatgattggaaggctgaattttctgtgctgagagttgggcaccatcagcgagcgtcctgcttgacacataactattaattatcatgcgtaatttattattgcacttcattttttagttattttgcagcccctgaccactcacagttttcccagttacctggaatcataagtagttggtaaccaattccaggcataaaaccgatgatgcgttttagtccagcgatctcaaggcattaattgtgtttgtcttcttgttttgcagatggaaaaactgagaatcagagagggctagtgatctctcagacacttggtcggtaggtaagtaatgatgctgaaagtgaacccaaaacaagatatgcttctagtctgcacaacctaacccctgccaggcccattgtcccaggcttgtgacttttctgttttgtgcaattcaagtcagtattgcacgagtcagtaaataagatgagccagtttgaggcatttgagtattacttgcacttgtggcttctgtttgctcccagtgtggagttgacatgtttaacaggtgagtctgtgaagtccttttaggccatacatggccaacattgggtctttctctgggaatagtggggcttattgaaaactggtccatgctgcagttgttgtgacactcactctcccttcaatagacccaactgtttggtacgtcaagaacagagagctctggactagtgtggtcaagcgttctgggctcaagtcctgcaatgacctgctctgtgaccttaggcaagccacttaactcacagattcactctttctgctttctttctttcacactgtttttcccagggtatttagtcccagtctcggcgctgggcactgagaacaagataaataccacataggcctttgaggagttcacaacccaatcagtgagttcctccattttcccattattgtctcattatgagactttctagcatctgctttggggtatacagtttgaagggtactttgtgatctttcccacaactctataacgtagaaggaagttgttcctgccattttgcaaaggagaaaacgatggctgaaagagtgggccaaagccataccttgagtaagggttagagctaggcttgaaacccagatttactaaatctaaaacatttgtttctaataacagcagactgttccacctggtagttgtagcatctgaatggtcattgttgcattctaccacttggcagtgagtatcatgttggggagattagcagcactctggtggtgggataattttctgcaagggattcttttctgcatctagctgattcttccagaaagcaatgttttctccgcctgagagtgaaggcagctgtgagctcgcagtaagctgagaaccaagggaaacctgctccaggcccagggctggctctaccaagtggctgggatttagcatatcagagagaattcaccatgggtggaaggagtgacacagccccccggcccccttcttgtgcagtgaccttgctgtaaaactgctgcttttttaccaaagcttaatgatcctggactccaagcatggtagcttctgcttttgctgagttgtcttgcctcaggcaagacacagagaatgctgtggattagaggctatgctctttgtttatatggatcacaacttcttgaggatgaagctctagggttccctcaatgtctggaatttcaaaaggtgcacgaatgacctcagtgatctggcttttctgtcttacaatatatgtgtatgttgcgaattatgaccatggttgatgtagatgcacctagaatgctgtaatgtacatgatacgcagcttttgtgggaatgtgactgtgaatgtgtggggtatgggattttgggggagtgtgtgtgtgtgtgtgtgtgtgtgtgtgtgtgtgtttaatccctgggaggcaattcttattaaaaaaaaaaaacacttacgggtgtaatttttcaacaagacctagaaatgggcttttaataagcctcattaaactctttgattactaggggaggccaatcactctttcatcttggctcagatcacagctctcccttgccctcttctttggggtcagacaaaaatgcctgctattcatattggtctctccaaagccttttccccttcacctgccctctgcagcccccactcccaccccagtgcttgtctgatctctttgcttcaacctcagcacagacagtgctggtgtcaggactgacagatgatagctgcaggtgctcctggaacctgagtgtcccatgtcttgagttgttgcggcaggacacttagggtctttgtttaggaagcactttgagctgggagagctggggctccttcctttcccggggcgggggtcacttactactgcaggctctcagcagaattgtgtgtgtgcaaaccctttcctttacaggttgagtttccccttgtctgacatgggaggaggcgaagctctgttgaaaggcaggttttgctctggactgccagcattctgccaggtctcctgaggagagctggttcccagagtgattatctttcctgagccaagagccaggtgctcagtgacaggaagaaaggtaggcttagcaacaggcttatcaagccctgctacaagaatgttcattcgcctaaacaggactgggtttgtgcgtttttgttcctctctgggcaccgtctcagttctggggctggtgtgttctgagcaggagtacctctgctgcttctcagaggcaatgcactccctggggtatgggctcctg

SEQ ID NO: 66641 - DNA, 1012 bp, Homo sapiens
tacagtgtcatacaaccctcaaagatgagcacaggatccacacaaaaacatcatttaactgcatggaattgaattaattggactggtacaggctagggcagcagcccagtcaccctgtccgtggctccagacttgagtggtgcagggatcagagggcctgaagcagaggagcccctgcgccagcagagtcagagaggaacagcttgggtggatggttttgcagttggttcctgaaaggaccctccacaggtcggctctgaggcagccaggcccacagccttcaggatttgggctgctgtggccaggctgctagaagttgctggcaagggtgaccagtggcttcacaaatgaagttagggacactttccttgggcctagatcagcctcggctctgcagctctgtcccagcttccctcctagcctcatccctctagtctgtctcgaatgcagccagactgattatctcaaggacaaatctggccttctctttacccagcttaaaagcctttggtggatgaccgcattgctagaagctggcccctgagccctttgtagtccctgtgctcggtcagaggttccgcatctccttctaaagcttgtacttctcaggatgtatctacgttttaagcctcttgccacagaccttttgttttgaaaagattgtgctcatgagtctcccttgaagtctgtcttgcccattccatcccggtagagttgacctcttcctcactggatcccactatagataacaggcttcccatccaccagtaacactttggacctttttagtgcagtgagcatgtcttattaaccatgattagtagtagaaatggtaaaagcagtgagtattcttaaggactgacttgaaggcctcagctagatgtttgagaaatgctaattctcacatcagctctgaaaggctggcataaagatcttcactttgcagataaagaagctgatgctcagaggagttaagtaactttctcagtgtcacacaacttacataagccag

SEQ ID NO: 66642 - DNA, 1035 bp, Homo sapiens
tcaggtgaggaaaccgatgctataagaaatcagaagtatctaatgaatcttgggaagtcttgtcttttctctgggcctgtttctctatcctccaaatgagggccccttccagccccagtgagccacgattctctaagtctatggctcacagcctgcaactcagtatgaagccgacttggatctctgcctgcttatcttatcttcgtatttatatttggaaacctgcttcttcttcatctgttagaattgcctacagtacacaccctgggaatgtctctgtttaccttgatgtgctatgagcacgatccagggttattaataaaaccaggcggtcccccagaagccaagggctggagcacaaatgtgtagctaactttcttgtctgggaggccttggtggctatcacaagaatgcccaccctgtatgggccccatctgacctccagggccaggatgggatgaggaccctcttggcctgtatgggaaaaacactgacctgcttcatcttttccttcccaaggcaatgaaattcgcctacctgtaaacccaaggggctgcaaactgacagcatatagatatgttttggggctcacattctgtttttaataccaaagaatttaatatagaaacaaggacattttaccaaacatgtggacttccaccatctcttagaaagtcagatttgttaacactaggctcgccatcctccactggtggtgagtggatgctccttttttcagaagggcatgagttctagagtttaccatagtccccacccctccttattatcttatctctataggcattctgctttgccactctgagcttcatatcctttggtttctcatcagatagtgcataataattacttgcctgttactgatatacccaagtacagagcactgtccaggtaacaaggccctttcctgctccttttctcattccgtcctcacagcagcttgcaaaagtgggtgtggttattcccattttacgggtgaggaaactaaggcccagagaagtgaaatgattgttctgt

SEQ ID NO: 66643 - DNA, 1059 bp, Homo sapiens
cttcctggaggagggagctcttcctgtgggttttgaaggctaggaggaactcctcacatgaagatagcagggtgagggtccgcaccagccctgccttggaggctctcctccttgtgagtatgtggaggccttgaacagttcagagactcattcaggaccctgaagcaaataaaaccatcccagggaaaaagaaaatcaaaattatggccatttatctgaacatcacggaattccaagaaggctgcaagggcttaagttgcagggcaatgtttcacacaggtgggcaggggtagaacctggaagggtttggattgctccaaaagaggaagagcatgagcaaaggtgtagaggcagggatgggcagaacctgtctagagaagggtgagcagacgtgtgtggtggccaccatgtacacactaggagggaggttcatgggagagtcatgaaggttaagctcaagggctgggctttagtctgtaaaccagaaagaggcacataaatttgatttcactttgaagatttttatggactcataaaaaactgtatattgtgggcttgtaaaatatcagcccaatctgcaaactaggattcacaaagtacgatggaggcaaagcctgaggaaacaagtagcacatccgctgtgtctgttcccctcaatgccccagctgcccccagcacttagcctccaatggctctgaggtgagtgccatagggaaccagggagaccagcacttaatgggcagacactgtgctagctacctgacctgtgtcactgtcatcgcagaagtcctgtgaggcataggcacagaaaccaaggatcagagaggttaggtgggtttgagatttcattgtctctgactccaagcctctgcctcatccatttaggatacgggggaattcagtgtactaattattgttggatgcaggattttgtccggtcagaagctagaaatgccctatgtacactctgagcaatcagaatggtttccattgtgttagctacgacattcgccaagacccgtcttgtcccatcttgctgctatttgaatcgttagtatt

SEQ ID NO: 66644 - DNA, 1888 bp, Homo sapiens
tttgcctgaaagtgtagcagccggggtggtgggggatgcatgtgttgagtctgaaggcagcacttttctcctcctgttagtgtaggaaacatctcattagttgttttggtatccaggagtcctggtgtgtccaggctggatgagataagaaggatgtcctgattaaagcccctcactgtcctcatgagtaaactgaggcacagagaggccaagggacttgtctaatgttgtacagccagcaagtggtacactaaccctgaagctaggcctccttctacttctgagatagaataattgctaggataaatgcacatctcttaccttctccaaacctcggtttcctcagctgtgaatcagggatgcttccacctttttgtcaagattgagaagaggatgctaagagaagcatttatgcagagacacctagctcagtttttagccctgtggccttggcaggttgtatagcctctctgagcctcaatttcctcatccctaaaatgaaagctatagggagaatttgaaaacctgaatttcagcagtgcctggagcactgtaatcactatgtaagtgttagctattttcattattatcattatcattatcttcattcttatcatcattatcggcacagaataagcccttagtaattattttttccccttttatgtagacagagttgcaatgtggctaaaatgcgggttctggatataagcaaacatgagtttaaaacctggctctgccatttactggcagtgtaacattggacaagcttctcaactttcctgagacttagtttaccacatccaagaagtggaatagcaatagttaccctgaggagctgctcgtgaggactagaaataactcacctgtcacatcatttatgtaaaaaatttacaacgtcattatttctttctcaactgctattttgattgattttaaagtaagattcctccaaccaaagccgggcagccctcctcacaccctgtgtttgtcgcaacaggagccattgcccacaatttagatagtttgcatcatgcagctgtacctcagtaattccatgctatggagacatgatgaaaaagcaactaacatgcacagctcagggatcttggttaagtgggtgaccgaaacttccacaggtaaacactgagtgcaaacgcttgcatccagtttcactcctggggatgttttcaggagtcagagggtgcagaagggaagaggaaggggaacccatgaactgtgccttgcgtatgcgctctgggctctccatgctctacgatgagctatgttctcctgccctgccaggaacctccactgcagtagaaggtaggtgagaaacacatggagggagggaggtacactgcagccaaattaatcactggtagagcctctacctaataagaaaatcttgtcaaccaactacaagcccagttgtggtggtcacctagtgtggactaaggggactagggatggagcttcaggaccggacaggttggagggctgctggcttagcatgggatcctcctcttcactgcacagtagagaaggtggtggcaggtactgggacaaaacttcagtacccacttgcatctttcaacacagagataatgttgtcctgctcacgttaggtatctagtttgctcatatttctcatccctttgctatcgtctggataaaggaaaagcatttgttatctgttagcatcgatactcaaggcttcagatcaggctgcgcgttgctggcagtccttccagcatgcccaggatcatccatttggtggaacaacattaagttgcacatacttgactttatattttttcttacaaagatggtgattttatatgaatctatttaagattttagggttttttctgtttattattaaaca

SEQ ID NO: 66645 - DNA, 2451 bp, Homo sapiens
cagctaaaagatgccattgccagcctttccctaaaacatccttcctctctctctctcttccacgtgccaacgttggaatattccaacaatttatttgaatcctggtagatgggggagggccactagagcctttcagtatcctccttctcagaaaaacctgtccctggctgagtggccattggcatttccctgaaagggactgaaggcacagagaggtggggcctgcctcttgggagtggtcccttctgacttccatttcacctgactcctaaggcagagcagctgatttataatactcattttggttctggaaactcccttttagatattctctgtgtcctctgctatgaacccttgatggagatggcctccgggggacagcagcagtgtcatctacccagaataatcaagagttcttagcccctgtagagggttctccagggaaacagaaccaatagaatgtgtctttctctatatatctatatatacatctacatatatatacacatatatatgtgtatttgtgattatatctatatctatatccgtatccatacagttggccatctgtatccatggattccatgcatccatgggttcctcagccaactgtggatcaaaaaatatttgaaaaaagaaacaagccaggcacagtggctcatgtctgtaatctcagcattttgtgcagccaaggcaggaggatcacttgaggcaaggaatttgagaccaaccagcctggtcaacatagcgagacctgatctctacattttttttttaattagctgggcatagtggtatgtacttatagtcctggctacttgggatacaaaggcaggaggattgcttgagcctaagagtttgaggctgcactgagctatgatctcaccactgcactccagcctgggtgacagagtgagaccctgtctctaaaaacaataacaataaattttaaataaaggaaaaggaataagaaataacacaacaataaaaataatgagtaaaaaatacagtataaaaactatatagtatttacattatattaggcattataaataatctataggtgatttgaagtatacaggaagatgtgtgtaggttatatgcaaaaactatgccattttatataacggacttgagcatccacagctcttggtatctgtgaagtgttcctgcaaccaatcccccaaggatactgaaggacaatggctgtgtatatgtagctttatgtatgtatgtgtatctgcatgtatgtcagtgtatatatgtgtgtgtgtgtgtgtgtgtatagggatggagaaaaatagattgattgattttatggaattgactcacacgattgtaggaactggcaagtccaaaatctgcagtgcagggcaagcaagctagaaacccaggaaggatttctaagttgaagtttgaggcagaattgcatcttccttgggaaatctcagtcttttaagtcctagttggatgaaatctacccacattatggaagataatctgctttacttaaagtcaggtgattgtgaatgttaatcacatccacaaataccttcacagcaacatctaggctagtgtttgaccaagcgattgggtaccatagtttaatcaagttgactcacaaaattaaccaccacagtccttgagaagtcttgacctagagggtgcatcaccttttttaggaagctcaggggtctgggaaaggcccagtttgctgctgagtcccccaacccagggaattatcaccagatatgtagctagagagtgggtcaacgtttctgagcaagtgttcagtcctcatcatgctgtagtagaaagaagagcaggtagattattagaagtttggttcacttattcacctgtcctttcatccagctgcctagccaattttactatatgctgattatatgttgagtgttgggttaggccttctgggatcaggatttagaagaaaaaggtgtctgcctcaagaggggcccatacacaaataatttcattatagcaaatttccagtaccaaatcaataagacttgttgtgtggaactgtgctttgtggaaacattaacctggattaaaggtcattatgacaaagtatctactgtgagtgcccatgattacagcacagtgaatcttaattctttttgagtcttaggcccatttgagaatccagcaccagccatggagctttctccagaactgtgttcaccccaagagacactgaatgttgtagactatttcaggaggtgaaggtactgggttaaaaccctctggtttacaaggtcctttttatgaggattctcaagagaaattgtatctcttctcaattttaagaataaatatgcctctccagagaagttgatttatttttatgcagtaaacatggaattgtgtgaacaataacatttcattgtccttgtagacttctagggaatatacagtagaaaccaaggt

SEQ ID NO: 66646 - DNA, 5739 bp, Homo sapiens
caactcttgcctgagtttcactttattcatgttgtttcatctgcagatcttggtgaggcagggatggccgacatatcctcatgaccccacgtgtctctgttgctcctggtaagaaagcagaaactggccagcccttggccttgtctgcggtggccccaggcgctgagaatgtcatctgacactggggctgtttgaatcccagctctgctgcacattagctggatgggtttgggcacattgcttaatggctccgaacctcctttcctcatctgccaggagggatagtaaaatttcacagggttaatttgcggatcctgatgtcatgcctgtggaccacatagctctcgactctgctggctgttatattatttcccatttgattctcacagttacccttggagggtgttaatgtggccattccgttttacagatgaggaagctgaggtcactcatttgttcttgcatttgccctttattaagttctgtctgtgcaccaggctgaatgctgggtgagaaagagggaggattaaggcctgtgatcaactctcagagagcccagggcctagtgggtgtgcttttccccctagccccctgcctttcaggattctagaaggcagggactgagcagaggccagcgattcaggaagtggcttctctgtgcttcgcatcactcaagtcccagtcctaggagtccccatcaattcttccattttcctcactcccatggccagtccattagcaaggcttatcaagtctacccctgaacctggttgtgtgctggaattggcagctcacaccagcttcaagagttgcttgtataccattcttcccagttctgctttcagtgatgccatgttgctagcttaaagtctgccacagtaagagtgtttataccatggaaataggcaaacagggcttttcccctagagagccagtcattaagcacttaacaacacaccattgcccggatctctctccactgctctttatttccacttctaccattttagtcaatgccactttcccctcttctcagcaggttctgctcagccttgccgctcacccttctgtgatccattccttaccaggcagctggagagatattttacaaatgtaaatcagctgctgtcattcccttctttaaaaccttcccgtggcttcccagaacactcagaatgagaaccaaactccttgctgagacctgcacagcctactctacctgccctgccaacttctgatctcatcttcccttccctgctaacccagcctctgatgcactggccttcttcgtattcctggaaaaagctgacaccttcctgcctcggggctttgtgcttctcctgctgggactgctctgccccaggtctttgcatggctggcttcttctagttatctcgatcctcgaccaagtaccaccttctcagagaagtcttccttgactaccacccccagcatagacaagtcctcctgtctacttacctctgctcctgctcaaagccactttctatcatagctcctcatgtcttttatgtttgctgcttaatttgccatctctccaccaaaacaaaagctctatattgccagtaactgaggttgggatgttggaggtgcctagcaaatatttgatgaatgaatgaaagtctgtctccaagagaagatgttcccagcaaaggcctctcccgtcactgctgagcctcagtctctttgaatccttaaagaacccagctctgctctgaagaacttcttctattcctacccttgtgccaactgtggaggtagcaccagatctggagacgacggaacagaaatctacatgccatgagggaaaaggaaaaatatattgaggagaaaacaaaaatgctcatctagtgaaggctgccacttgcccagaattctccatggcttttgaacagcttagctgcttctgaatggtgtctaagaggtcagtgcctagtcacatggttcactgggacaggtcagttgggatggttctctgccagctagaaggacagttttgtagagacggtagcttttcctatgggaaacttttatgttatttccaaagaatctctggagtcagcccagccttgggctacatcagctctggaatgctgggtaagtccctgagcccctaggaacctcagtttcttcttctgggaagaagaagaaactgtgaggtgctatgttacctacctgtgcttacatatatatatgcatgcttaacatcaggcatggtacatagtgggtgttcagtaaatgttatatttctccctcagttctccaactcagaacagaagcgggcacgttgtagaagatgatcccctcgtccaccacatcgttgcttacaggcttcttcccacactcttcctgtgtccccgcctccctcggtccccacaccgccaccaccaccgccaccgcctcttaccaggcatacagaactggaccctgtggcagctgcagggtcacagttgtggggtttgctgtcacaggaacaagaagccacttagcatgaggatagaggggctttcttgcagtcagctgggcagtctgcaatacctgagagacagactctgtctttccagctgctgtgattttctgaggcttctgagggttacaaagacaaagcactctcttcccagcttggggaaggaagaagaacaatgttagagacccaaaaacatgggttggagtttaagacctgccactttcttcttggttcctgggtaagtcacttgatctttctgagccatagcatcctcattagttgaatgagaaccatcacatccaagtaggaccatagaaagagaaggtgattgtctatgcaaaatactgagcctaaatgttcattctcttccttcacctttttcttaacttcaatagagctgatggctaaatgttaggatgggtctgaaagagaaatgttttgacttccagaaaacaaaagaaagagatgcctttcaaaggaagcttttcaaataatctccccatgcttatgtacccttgggtcccttaaggtggcagaagggacttgatcaggttgtggggctgtcattaagtgcactgacgcatctattccctaaattgtgccctggaaacattccttttcatagttcatggtcagggcttgaaaatttttagttctcaggcactgtcccattttactggcatttaaaagacaatggtggagttgcctctttcaggacacccacagaggactctgaggtaccaggattcagatcactggacttagatttcttttcgccactatgtttttccattggtttccttagtaggtctggtttggggcaaagggtacaggacttggaggttaaaaaaaaaaaaaaaaaaaaagctttccaattctgactctgctttatctcgctataagtgatttggggcaacatgcacaagtcactaagactcagttttcttatctgtaaaatgggaatgttaatgaaacttaagtcactgtgttgcataactcactatgaactttaagattgacttaaattcaatgagctaataaatatggatgtcttttagagagaacatctgttgtggtagtgatgtatgaattgagaaactgtaaaatggtcctttccaatgtacttttgctattggccctaaaccttcatttcttgcaaaggagtgaaatgaaaggtaattgacttgtagaccttcctcattgattcaaatttaaaattcactatcatctagtgatgaaacccggggccactgtctcaattatagtgttttatttttgtagaaatactgtatccattaaaattatctatttctatggcacttaaaattgtcaacacagtctttttgcttcaccttctggctgacttatataacctcactttactaaggctgggggaaaaatgtctgagcatttctggagattaatgttctgttttaagaatcaagtcctgagtatcactcagttcagggcaaaccatatatttaattgagctctttctgcagccagagcattaaagggagagagaaaaataagtgagatgaggctctgcccgtaaggagcttctgatcaagttttttctttcttttttactcatttgttagtctgtttcctaatttatataatggtgaatagatatttaccaaaatgctccatatgcctggcactggagtgtggagacagagataaatagacctggttccttcccaaaagaaggtgtctgcctagcttaggagacagccatgaacatgaaaaagctctagggaacgggacaaagagactcagttaaatgggaactgagtgtggaacaccaagcttcatggttctgtgtcagaatatggcgattctcaggggagagaggttgcttattaatcccaacctagttcctggttgctattggagaatccaacctgaatctggtggtgagcaggacaggaagaggatattggaaggatacaagaaagtgacagttttccatgcaatacaacaggtgttgcaagagacaaatgagtgaggagctgtgggtctttaggcgagggggaggttagtttggaatggggagtccatgcttgctttgcagaaaaggaagcctttgagaagtgtcttgagcacttgaggagcaaagatacaggcaaggaaggcatttaggcagtgttcactgtgagcaaaggttcaatgtaggaaaggtcattgagttgaccttgggtggcctggcagggctgggttgatgtgtataggagaaatggaagccaaggggaaagggggttagggacttatgataaaggccttccacgactgtctagaagcttgtacttcattctgcaggccgcggggggcccaagagggtttttgagtcaggttctacttcagagaggtgggactttttaaacaacttgttgatcacactatattaggaaatctcttaccccacaatatgttcctgggataaggcgcacgtttgctctctgggggtggtggttaataataggcatgcaacccaaagcgggaacaggagacgcacgcagagatgcgagcaggctcatgtttaatgagttcacaaagtgattttggttcctaattttcacatttccctgctctcccaccctggtgcgaaatttcctgatggagctggtgtttcatgctctcttaaggatggtaggagcagcagagtgtggtggtgtaacttctactgctggggttaaggagccatttgggtgtgttctcgtggagacatgatagagatctggtgaatcatctgtatctttgacccagtgaattataaaatgatcacaataacctctgttcactgagcgcctgggtagagtactgggtactgggtactttcctacagtgagcctttgctcataataaacactgcctaaatgccttcctgagcgagtactgggtagcctgatctcagttaacagttaatctcgacagagaggcatttgacaggggaggatgcagctgtttggagacattgtgttacctgcccatgctcacatgctcacacagctagtaactggtgaagccaaggttataccagtggggcattcctttcagagcacaacacaaacagcagacaaggcagaggggaaattttggggtcttttcattcaaacagctgtgagttctaattccatattggccacttcacttctccaagttccctcaaaatggatgtggtcattcctcctttatagtgcacttgacaggatgaaggtagcctatgtatggcccgtgttgggcctctagat

SEQ ID NO: 66647 - DNA, 1350 bp, Homo sapiens
actaatccaaacctctttcccttaggtgttattcagattaggagttctgttatagaataagaaattcaggcttaaaatgaaacagatctctttatgacaggatttctcagtcatatgcaacatgctaacgttcattgtgattgttcaagatcataagattgttggcagcatttcctagacttactgatgtctcaggacacttagactatcttttaggagtaggatttctttgaacctatcttgcaaaatgctaagctacagatagggttttttcctgaggatggttggagacaggcaagggatgcccctgtcagctgtgaggagcctctagcagcatgaagtgagaatgggattttaccctgacagtgctgggcagccatggaaaggtttttgcaggaccctgtgttagaaagtgctcagggaatagagaaatggtgggtcagggaggggagcctgcagactgaaattctaggttgaaggctgcggtgaaagttgctctttggtatctcttgctgtggatgtacaggcatctcctggcacctggcctaggtcagggcactcagcctcaatccagggtgatcacattcagagacatcattgaggatctccagatgggcccactctgaggtccagctgagtcctgccagactatatgcgacactgtaaggcattcacctgctcagcagcagttctttacctggaaagcagctgggacctgctctttgattctgttgcttgtttttgttggggctctcattccatttactttgtcccacaagcccagttaggtagtcaatgatgtttgccatgctcggtgttgctgttctcatgaactacagatgacttagacgatcattctgtgtgctagaaaaggcagaatgtgttgtcagcttattagatcaaagacaatagtccacagcaatagcccttttcaagggagaggaaattgaacaggtacaagtgtgaaacccattagggaaaaaacaggctctagagccagacagccttgagctcacatctcagctccatgacttactggctagatgatcgtagacaagtcacttcacctctttgagtcttactttttaattgctggaaaatgcaaatagtaatacaaaatgtaagatgttgataaaatctttactacgtacaattggcttcatagatattaggtgtagtttcatttttcttaggccttcaaacccaatatctgaagaccagacatggtttagtagcagcagctgtgaaaacaattgttatggttttggttgaaaagttgcttgtgggaaggccgccagaaactactatgtgcataggctctgtcagtaaaaggagagagccctaagttag

SEQ ID NO: 66648 - DNA, 1027 bp, Homo sapiens
catctgttctggggcaagccctgctctagcctgtgggggtgcagcagtcaccaagctggcatgatcctgtcttcacagcactcacattctaggggaagagacagttgagaagcagtcatcccaaatacgtgcttgcgcaggaccctctcttcctctgagacttggtggatagtcatacaacttctcacagtctcaaaagcagtgaggggccatggaggaaggaccctgatctggctgtgagatgccagcaagtctaggtaccaccccagctgcaggttccttgtctgcagagtgtggatagcgatacccactttgcccctgtccttggcaaggccttcgatggcatggggcagaaacccactctggcaaggatggctgtgataaggtctcagagatctttttgagagtccaaaggtgagaactccaatgtagcatggccccaccaaaacaaaaaaatggaagttgctagaaaccagggagtccatgtggctctgtttccccagtttccccatttcctttgctttttcataggttatggtccacagagctttaccttgcgaaggtccgtcctgcctaccctggccttctcaataacctacaactcttagcaaccctttctggctattctcccctctggtaactaccccagtctctgctcctcaattccaatttcaaatcctcaaaggaagaacctaattgagacaaatcacaggtcactggacagccaaaggttggaccttccaagggacaagtacccccttctgacctaatcagctgtgatcacggtgaggcacgatcacatggtatacacatggctgggctgtggatggaacagtttctcttacaagaaaatgttgttatgcagctgccatcaaacatctgctcctcccagtctgccctgaccaatgtaatgtggggttttctaaaaagcctctggcaggccgattccttgtatattgaaaggatttattgagtgattgctgtttacagaaggctttggtaaattgtaagttgctacgtggatgca

SEQ ID NO: 66649 - DNA, 1027 bp, Homo sapiens
agaaagacctgagaatctatttcaataagttcccaaataatgatgctgatggtttgtgaaccacactttgagtagtaagggtctcatctccaagctcctcatagctcaaaaactgttcacttggaagtcctattaaaatacattcccacctgtgtgtgctgggtcctcagatgtggccagataattgaaattatcggtaaggtataataacagataatttattaagcacctgtgatttgcaaggaacttctcaataatgtatgaagtaggttatagttttgtctgtttacagataaggaaactgaagttcagagagataagcttacctgaactcctacagctaaatggtgaaactagaatatgaaccctagtctttgcccctctgaagagtgtgctttttccgtagattcaaattatgaatataaactaccccataagtgagagattaagcctcttgatacacttggccattatttcgcttgttatagagattacataggtgaaacgtgtcttgcaaattgtcaggactttgttgatgttaatttttgttattagtaatcaaataacatggaatttaatgacactagtagcatggaaaaatgagagagggaagtgtgtaaatcagtatttaagcaaagcataacatttgtaataatgtcacgtaaattcaggaataggaaaacccaagaacaatgaatatccattgagaaaaagcccatgacattagagaagaataaaacagaaagaaatccacccgtgtttcttggctttgctccctcccctttgggttcagagaatagaattgagacaacaccaaagggggtgggtaaagagtttgaacaatgaatacacattaccagcatccgctgagtatcttgttaacattaacctgatgcattgcaagtgagctgcagttagaacagtaattacagtaaatagaatccatttggaattctcaagcaaatatgagtggggaagaaagatgggctgaaaaaaaatccattacccttaggaagttatggaagct

SEQ ID NO: 66650 - DNA, 3753 bp, Homo sapiens
acactaaataaatcagacaaaagtctgtgtccttgtggagcttgcattctagtaagggaaggcagacagcaacacaatcagtgagtagatgataccatatatgagaaggcaagagtgataggaagaaaaaccaggaaataaggaaggttgtgatgaggaaggcatgtctattgcaaattaaaagagggtaagatttgaacaaagccttaaaggatatctcctttcagggggaaaaccttaaaaatacctgcgggaaaagcattcctggcagacaacagcaagtatacagccttgaggtaggcccatgactggtgcacaggaagaaagcgaaaaggaaggagagtatggccggggaggtcaagcaaggaggcgagtaggaaggcagtgaggtctgagggaggtaggggaggggtcaggccacatagaatcttggaggccagtgtgaggatttagcttttactcagagagcatagagggtaattggagggttctgagcagaagaatgacatgattgatacactttttaaaaaatcactctgactgctgggttgagaacaccctgaagggcgtggtagttgggagcaggagcagcattagaaattagaagttagaagactgtgacagggccaggagtggtgacttatgcgtgtaattccagcactttgggaagctgaggtgagaggaccactcgaggccaggagttcgagaccagcctgggtgacacagtgagacccccatctctaccaaggaaaaaaaaaaagaaaaaattagccaggtatggtggtgcacacctgtagtcttagctactcaagaggctgagatgggaggatcactgaagtccagatgttcgaggctgcagtgagctgtgattgtgccactgcactgtagcctaggtgacagggtaagaccctgtctcaggaaaaaaaaaaaaaaaagccaagaaaggaaaataaagagggctgtgacagtattctgggcaagagatgatgacagcacggactaaggtgttagcagtagaggttgctggaatttgcgtatgaggtgcctgggtgggaaagacaaaggtgatccctagcagtggtcagtatggagttggcagctaattcgtgattgttgattaaaaagaagaaaatctgggaggttggagacctttttcttagtgtgtactggagaagcagccccgttctgaagccccattctgaagacttgggatttctaacaggaggcacagttatgtgtgaacttgtctgatattcctcactcgtctggaagtttcctgagggcagggactatgtctgctttatcccattagtcccagtgcccagcccatgggccagcacacagtaagcgatagtaggtgggcaatgtgatagaatgggacacgagaacttgatctccacgcactctcctcgtcctccggtctggcttcctggatccagacatgagacttggcattatcacaggctgggatagagagagtatgaattctcctctaggccctactatctaactgctttgtgagtctggactgtgtttctgtatctataaattgaggtttcagatatttattcagcaatattaataatctctgcctggattgcattccagagagagctttcctggccactcaaaacaagtcccctaactctctctcccctttccctgccttattttttccacaatacctgccaatatctgaaaacattgtctgtaggtgtacatgtgtgtgttgcatttattgcctgctagagcataaaccccataaaagcagaggtttttttctgtcttattcactgcaaaacctctggcacctggaatggtgtgtgctacatagaaagtgctaaatatgtatttatgaacgaaggaatgattgattgattgattctggggactcaacaatatgtagaaatgtgctttgcaaaccacaaagggcaaagcaaatgaaaggtgttcagctattattataaatctgctgcacactttagcatagttttaactcctcccacagcattttccaaggaaacgtcggtgaaatcttttttttctatttgggttttcttcaaaaagaagaattctgacaacctaatttaagagacttcctaggtgtggaactcagtgatggatcctcatctcttagcaacctcacataggagctgctcaccaggtaaatggggtgacaatttcaagtgggtgtgctcagtgtcagggatgagacatgtgataggaggaaggatgagaccttccccagccggtggaggggaacaaacctaaagcaggagtcgggaccctggtattgtagtcctgggcaagccattcccctttgagcctcctttcctccatacagtgaaggggcttggcaagatcccttccagctctagcattctatgattggcatttccagttaggcacttcgataaaaacgatcatttattgggcaagtccctgtgtgaagcactttatttgtaatattccatctaatcctaattttaaatctgtaagataggattataattatccccattttctggatgaggaaactgaggcatagagaagataaggtcactgttcacatgggctgccataacaaaataccataaattgggtggcttaaacaacagacatttatttttcacagttttggaggttggaagtccaagatcaaggtgccagccaattgggttcccactgaagaccttctccccagcttgcagatggcctttctctcttcctcttcttatgaaaccactaataccatcatgagtgtctcaccctcatgacctaatctaaccctaattactttccaataggctagtgtccaaataccatcacagtgggggttaattcaacaatgaattttgtgaagatgcaatcattctgtctgtaactattgcatagctagcaagtgatagaaccaaaacttaactgtgatcagtagctggaattttgactctgaggcatcttgtatgatccctgtgttttggtatgggataccaatgaaggagattctgctgtgttggaaaagttctttgggaggcaaccggtgtttgctatgagtgccacctccatacagttgggcaccatggcagtactgcacaccactatatcctcggtgtagccttataccagaacgtgaaagatattcaatcagtgtctattacataaatgaacagatggctctgttaaaagactaatgactatggttgggcacaaaaggctcaaaaaatggttttgtccaggtatcctgggaaatggggccccttgagtcttatcaaaagaagtgagaggggccgggcgcggtggctcacgcctgtaatcccagcactttgggaggccgaggcgggtggatcatgaggtccggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggtctgggcgacagagcgagactccgtctcaaaaaaaaaaaaaaaaaaaaaaaaaaaaggagaggatagatataattaaacatctgatttatactacattactccagctgcatgttcctgtttttatagacagggaaatggaggctgaaggaagcataggtccctatgctaagcagcagagaagcggcttgccaaagttcacacagatgt

SEQ ID NO: 66651 - DNA, 1549 bp, Homo sapiens
aacaatctcaattcaactaagacataaggtcatggaatgtcaatgacgatctggtccaggaggcagatggccatcttcctccagccctcagcaagtatttctcattggtgcctcgtgctggttaagctttgttttcctgccccataaggtaaaagtatttagggcccaaagagccctacatcctttccccctgcctgtccccctacctgggagacagctttatcccaacatttaagaagtgatcttgttcataaattgccagccttgccaatgagggtatccgtctgcctgtgtctctctgtcatttttctgtccctgtctctgtcatttttctgcccctgcctctttctccggctcacctctctttccctcacactgcctttttattttctacttcttaagaaagaacttgggcctggtgcacagaaagccctcaaaaaccataatttgttgcgtctctttttgtgtctcccatctgtctgcccttttgtctcccgctctcttcctcccttcttctctgtctcctttttcttccctttggaataaatgcacagaggccagagaggaggctgctatgggactccacagctggccggcaaagagagcaaggggcagaattttccccttgcctctctcgcctgcccaggcctgtctgttgggaatgtcccactcctaatcttccatgggggtcatgcacatccttctgtcagcaactggcacaaatcaatttgctgcaggcagtcatgctccgtggctctctctgttcccacgatgtcacccaggcagtggtgtgaggagcccatttggaaggagcaggtctattgggtgggggctgggcatgattggggcagcagaggggaggtcactcttggctccatgggaacccaaagcctctgtggctctagacggttgtggtcttacccttgcctatgtgactggtgattgtgtttgggtcaggcattcagctgaaaccaagagctggctggcagtcagggtcacccctaaccatatgcctctccttcctagccctcagtgctctctgctccttccagccttctaattcattctggcagcagcaggacagggaaagggtgagacattggcatgttttggagatattcaggaacaagactccagaattcagtgccagccgaattattttttcttaggtatttactatgcagcacatatgtttcctgaatcttttatacatgttatctcttttcattttatgaaataggtattattatcttgattttacaaatcagaaaactgatgtttagtttggatttgagggggctgaggaaatcaggaactagaagtgactcccagtttcatttgtttccatggcacccagcacggggctcttcacctccttggctccaatctaggcttgttgaactgttgcactgagtcacaagtgattaggtagatgatcatgccctcaacagaaaaaagggatgtcagaggagaaacaagtttgggatggagaagatgattggtctggatgtttattccacagagatagatttatttatttatttattta

SEQ ID NO: 66652 - DNA, 2290 bp, Homo sapiens
aaataaattgtcatcaattatatttgtctcccccatctttattttggaaggttggaagaagttggtgaatggtggttgtttttgaaaagatttagtacctgctgtactatgggcaatactgtcttccaatatgacttgcctgtttaaaatttggcctttaaacatgctttgagaactgcaaagtcaatgggttatgatcaggttggggtaccaccatgttcaagagcaggaattttgacaaagtcacatttgcaaaaccccacatcatcatagttggattaaggcagaatgctaggtgggagtggacaacacccccaggtgaattcagaatggttcaagcgattccctagaaaactggatagggattgtccccaggttaggttttacaaacagaatgctctcacagcaagtcaggctgatgtaagagttggctatgaaagtggcctcaggacagaaggagaaatattctgaaccaaatctgcaacacaggcatctttggggacaacctaaaagaatgtgtagcattggagatcatgccattgctttgggaacttccaggtaagtctccagtcctcagacaaggcatgtgccagttactgccctgtttagtggaccatttaaaaggacgctgcccacagtcactcaatgaagcatctcgcaccatgtggaatgtggcaccagcacctcatttgctctgtctcctagccttttgttgggggcagagtgaaagaagagaagagggtctctggcctgggacagatttttcttgttggtaaaattaagataacaccttcccacccaattccctccagcagcatactgaggtctgagaagtagattctcttactagaatatggtagacatcaaaaaaaggaaatctctcatattataatattcattatggatatatagtgtggaaacgattgctgagagcaagcaccagatcaaagacaaaggaccaaaaaatggcattattctattagatataaaaatgaataggaatcattctgcagatttttttttttacccaatacaataacacttccatcatttaggactaataatagtgatgatgatgatgataatgaccttgactcatttgtgaacaccattttttacaaagccctttcgttatctattatctttcttgatcctctgaatgaccccactagatagatattacagggctaattatttccatgtgataaaggagaaactgtaagcccagagggcttctgtggcttaaccagggtcaaatggagaatagagtcaagctagaagcctgaacaattccagaagtggtctttctcctaaactgtgctgtaacctagccccacgctgtagtagtagtggtgatgactctacaccaggcactgggacaaacatttcacatgaatgtgcttgtttgatccttacagccagccaggaggcagattcaattagtatcccttcttagtagatgaggaacttgagggaggagaaggttgtcacttgcctaaggctacccaactagttggggggacttgatccagggctcccctcttgaccactaccccacactcttgcagaagaggtttaaatatagaagggagagaagttctaggtcctctccttggattcacgtccagatgcaaggcagggatctgctgatgggcacctacaccttgcattcatcttgcccaggtgatggtcatcatcctgaccactgatgagatccaccactgggtggctcacagtgctactgcctggggtgagtctgtgggccctcgaggcagtagacctaagtaatatgaaagaagttctgccttgggcccctcaaacccctgggataggaaatgtgctcccataagaagatcagagtaattttcatttctaatatcttgacaaatactgtattgcataaatttgttccactgaggttccgtaatttgtcactgtggtctcatgtgtcagtgtgagctgcagctctattaaagccagctagctatatgactttggctgaggtacttacttttctagtctcagttttcctcttctgtaaaatgggaggctgtgacatgtgtctcaccatgctcacatgattttgctgcagactgtgaacaaaggttctctgaaaaggaatttgagggaaagagactttattccagtgaacagtttgtataatgggaagacatggcctttggtgtaaacagaagaaggtgtgttccagagaacagagagggttcaattgttttgtttgtttgtttgtttggagatggagtctcgctctgtcacccaggctggagtgtag

SEQ ID NO: 66653 - DNA, 2924 bp, Homo sapiens
tggattatcaggtaaatacctcattagtaagattttgaaacatgtctcccaacagtttttgctttcttcataaaaacaactaaattttaaagaaaaagcaatgtatctgttgtactgtaaattcctctagctaattttgattatccctatcaaatgcacttgagaaaagagatttacaaagtggtaaattatgaagactgatatttaaagcaaatgtaggacaattagtacagtagacaggaccacaggcatgagtgttagactgggctggggttaaactgtcactgtggcatttacagatgtgtaacttggggcctcagtgtgatagaagcctcagttttcttgttgtaaaattaggatgaaaatacttcaaagagttactggattaaattagatagtgcagatgtcatgtaacagatgtttaataagtgctcattattttttgttttcattgttaaataatatcatataatatttcattgcccactaataaattggcctcattcagatttttaccatagctttcccatacctacggagattttaggtagagctacatgaattttggagccaccttctgatggagacatctgggggttttggggaaagggaatcagacttgggcagggaaaaaatagtgagattatgagggaacaagaggagagagagactacagaggaaccctttcctccaggccttgtcatccatggcaggcccattgggccggggggtgctgagatttaaggaaggtgcatgtgtctgtcgtattcactgcttcctctccagtgcccatcaggtacaggctctggcacatgcggttatggagcatgtgtgtgtttaatgaatagtttccatgacagagctaagattactcatcttttcttttcatagacagtatctcctcaatgatgtaacttaggtaaaataagggtcacccaaagcatttttccatctcgatcagcaaagtaaccattcatctctgggaatatgatggcattcagaaggtgacagccaacagctccaagtgaaaacatcaaagtaattgaacattaagttgaaggaccagacccagaaaaaattctttcagcttatgtgtcacttgcaaccaagccaacaaagtcacggtcatttcactgaaacaataaaggaaggaaatcccaaagtgcttctaagtagcaaagattggtgtatgagatgaaatgtataggatatactacataaaaattagatggataaaatagattttttcctaagtatgtgcaatctattatttttagtatcatttagtaaaacaacatgaagacattttattagtttattcataactttggtcccccagctcaatcttttccaaaagaattactatgataattatatcatatgaaaatctgcactggccagactctgtgctggacactttacacacattgtctcatgtaaccctcacattgcctctgggagataagtgtttcatccccatttatcagatgaggaaacatgagtttcagagacagcggatagtcacaacagactgcaccgataccacacagctgggaagtggcacagccacaagtcaaactcaggttagtcaaattccatagttattacatcgcaggttattttctgataatgtaatacctttcccagttccacatttttttacattccggttgggagaaaacctcccaaggatgagttctaaacttaaatgcctgtaggaattgggcagatggagcaagtgggctggatgggaatggagaacacacagcaattgccctaaaaggggcagctgccgctgaactgcagcaccctgtggtcagaaaggaaggtgagtgttttgtcattataccttttattgttccaagagaaactggaaatctagatttttaatgtaaagttttattattttaatatattttcagttaatttaattaaaagaaaaaagcaactgtactagccaacaaaacatatcaggagttgcaatccacctgtgtgagtcagtgtccaatgatctgcttgtcatccacgtcagactaatcgccagtcaggcaatgtgcttgttccaacattattgccactgctgacatcttagagctctctcccaggaatattctttggaacaagaaggtgggccacaccagaaaatcagtctaaaaataacggttaaagctcattgactgctacgtatttgtaagcattttgtctatgttaatttcatttaatcctccaacactcccatggtagactatcatgcttctcttactggtgaaagaacaggttcagagaggttgagagacttacccaggtcacagagctacaaaaatagtagaataggacttgaacctaggtctggctggcttctaaatctgtgctcttagcctctgcgctgtactgtctcccacaggctctataaatactgatgagctgccccaggcattgctttgttcagttcccgttgttccccaggattggatgtcagagagtgtgggaacttgttctggaaatgaacaccttgcctggaaaagcatcagtcttccaagtaaagtgctctgtgcatcataaaaccttcaatttagctccattatattttaggtccatgagggatagattgcagttcctgccttcccactgattagagcatcctatttccgtgtatacagtacctattagatggtgcattttgcagaattagctccctgatgaacaggtattatttccccctctgctgacatgcagcagctgtctgcgctcattgtgttcaagcctctgcacctgaaattgggaagtgaggtgaaatggtgcaaaactcagcagttacacatcttaccttcaagcttaaagatgtgtaagaccaggttctactgattgtatctcttttgctacttatatgaacttggacaagccattttatcagtcttggtctc

SEQ ID NO: 66654 - DNA, 1368 bp, Homo sapiens
aaagcagtgttaatcatgctgaaatgtaatgcgcccctctgaaccttggaagatgagaaattatacatgctgatttcatccgctacttaactcagggggtgacaggctgcaattgaagaggctttggcaggttaagtgctgcaaacccttgcccaggctcttaagcatctctcggaaacctctgagactcgttggtaatttggtggtgtcatttggagtgactcctggccctgccagctgcagggacagttcccagttaaaaaaaaaatgatttcattctcagctaggatgtggtctgttctttttttgtctggggaccggagactgttaagggaaaagagagtggggaggagattctgcaaagaaataaaagcagacaagaatgggcttgtgtacattgcaaccaccaaagccccctcaacaaagcttcatcattactggaatcaggaaagaaaagggagaaaactaacatttatttgacatttactgtgtaccaagtacctgtcattcctgaacgtattgactccacacatctccgcgagacagctgttgttatgtggagaaattaggctaattaatttgcccactacgatgatgacaacaatgatgacgatggtgataaaagcttatatttatatggcagagactattataaactccttatctgcattattcactcctcacaataaccctgtggggtaggtgctgttatgatccacattcttcagatgaggaaaatcaggcctagaaagataaaataacttgccccttagctggtaaatggcaggactggggttcaaatgtaggcagattgcctgcagaacctgtgcttttaaccactaggatggaagttggaaagcaagactgacatagtctaaacatccttgccctttcagccacacctggctgtcccatctcatactgatataaatagtattacaggtgagcatgtatggaatgttggccaagggtggcctctgtacttggttgacattactgcgtatttaattctcactgtctctgtcgaggttggtggacactgaagctcagagaggtcagctgatctgcccaggatcacaaatgctaactgtggctctgggccactttttaagctacgtggtttcacttgctggcttatttcattaaacatataaaataattcctggaggcttggtctgttgaatgagcagtgattcaacaaactgagtggctgctcttggcttctctgtggtgggagaccaatgagcacagtgatgagactgacccagtcctgccctggaggagtccctagtcttggggtgggactctggcgttggtgccttcctgccccgaatccccaagggccgcagcgaactcacatggtaggac

SEQ ID NO: 66655 - DNA, 1054 bp, Homo sapiens
taagaacatatgacttctgtaataaaaataaagtatcaatgaggctcctttgagccatctgctatcttggtccttcctcaaatgcagctttaatcttttacacacattacaggctcactaggaatgaattggaggcccccactagaatgatttaaccaatcaacttgttcattaactgtcatgatatcttctgtgtgttagacaaaagatttagaataatccttattatgggctggacaaagaaaatatttgaaatccctctctctcatttctttccagtctttctcatggaattcccacagggactaatgcccagaaaaaagggcaaagtggcattagagtctttgaaaggagaaggagttcaaggcttgcccgtcgttgcagccaaagcagaactcccatgaagtgcgtgtgtgtttactaattacccccggcttgcaaccgcattcgcctgcttcgtaagcactttgggactctgttaaaacttcactgtagtaatgcctttctctagactataactattttagaaattaacccattatcatttttttctcttaaactaccaagagtaaagcttagtaataatttctattagtgagcctgtgaaaaaactaggatcctcatataaaacaaattttagaaaactttttgaccaagcttataccatgacttagtgatatcatttttgaactcttcaggatataatccaaggtttatgtgtagatatatctatatctatatagatatatagatatagatatatatagttggaaacaaggtgaaattaatatctgacactaaggaaatgggctttccagtaattgtgctcactcagtgggctaaatgcaaccatttgaaatgctagttttaaataacaggagtcagtatgtaaaatgtttatcgccttagtttctatgtcgatgtgtgggtgtgtgcaaatttatgtataaagattgaggcgacaaatgactttgccacatagggacacagatgtcctccccacacccacctcaatccctgcaaaagtacgggtattgctattaattatgtatta

SEQ ID NO: 66656 - DNA, 1649 bp, Homo sapiens
ggaggcttccttcaggaagtattccaggattgctgccagtagagttcctgaggctgatctctgcagggcatgggggattgcagatgctggtaaaaactttcttgagaactccatgtttgctcattttgactaaattctggactgagagtggcatgtacataagtaggaggctttcattccaccgaaagcgaagcctgcacaaggcagaggaaaagaaacacaagacagaaggaacaaaagagcatgtgtctgaagcccccaggttaaggaagggtgttcacagagaccaccacctctaatccccagagaaccctctggcacggccactgccaattccctcagttgatttggctcaggtgtggctggctgaaggctgcccggccagacgagttacatttgaatcttggccctccccctaatgagctgtgtgtccttgggcaactccctgtacctatctgatttgctattttctccttcggaaaattgtgttgtaattatgtctaagttgagataatttatgcaaaaatattctaccaccatatctggcacgtgccaaatgctccctaaatgtgacctagtttgaaaccccaccttggaatgaaccaaagcctggaccctcttgttgtcattgaaatttgtgtatagcccgtccattgtcaaggcctgttcaaggaagagcagtgtggtgtgtgggctctggaacaggacggccttggtccagatcctgcctctgccacttactcactgtgtggtctgagggaaatcacctaacctctctggtcctcaattttctcacctggagataacatgagtactgacttcatatggctgtcaggaggaacatatgaaatagtgaatgctcagagctttgtaccgtgccaaacagcgctcaagtgaacgtcggatatcacagtactccttgaacccatccaattcaaatatcccaatgcttactgactcactgtctaccttgcacactagatgggctgctcatttgcaccctaatacctggccccaaattcggtccagagtttaatgaactcaattcggtcaacgggttgaatgaacgcttgagtggtgagcaaacgttggggactcttgaaacacagggctaggtcctgtgtgttagccactgcagaagccatggttacaacagacaaggagccttggagcattttagaaacctgatgcatttagaaagctgtgcacactggttctttcctcctggattttttttttttttccaggccatttgagctgtgggacataattgcatcattggctataaagactgctttcctgagggggtacttgtttagaagttccaggccggacttggctacccttgattgaccacttgagaagcctgataatggcagggaattgggctacctggggagcactgttgccaaggaaaaaagcaagctggtgtagcaaggaggtcagaagggctatctgacctgcacggatcatgcactcaagagtcagggctacaaggagcctgccagaggcctcggaggatctagagaggcctgttgtgttctaggctcctgcatttggggccttagtgtgagttatctccactaatcctccaagaattctacagggaagttattctcattctcaccagacagttgagaaaccaagat

SEQ ID NO: 66657 - DNA, 1092 bp, Homo sapiens
attttattttttgagacggagtcttgctctgttgcccaggctggagtgcagtggtgccatctcggctcactgcaacttctgcctcctgggtttaagagattctcctgccttagcctcccgagtagcttggattataggcacctgccactactcccagctaatttttatatttttagtagagacagggtttcatcatgttggccaggctggtcttgaactcctgacctcaagtgatttgcccacctcagcctcccaaagtgctgggattacaggcgtgagccactgcgtgctccgagttttgtgggttattgttaagctgaccatccattttaatgcctcactgtgcaggtgggaaatccgagagtcagaaggaagaagtagtttgtgcatgttcatacagcaggtgagtcagtgatagactgggactgaaattcaacccccccgcatctcagaccaggagctcagaatctggcacggtcagcagaggggtgaggatgatgagcagcatggggaagtgggtgtccctgactggagggaaggacaccaaatggggatgctctgaagcccacagatcaagtgcgaggctggacgcagaccaggtgctccatgactgttgttgaatgaaaacaagaagcatgcctgcacagcatcgtgttattactatcaatgttactcttcatttcgcaaaagaaatactgattaggtcctattgaggaaaatgaaggaattgtatggattcaggccctctgctatgttcagtttctattcattcctccacaagctgggtctaaaacactgtaaattaacactgctgtggcactgaatgaaattcctggtcatcaggctggcatgtgtgcctgtctgtctggctggctatttggctggctggctggttagctgtgttctagcagatgaacccatggggaagaaaggaagggggggcaggttatcttgattctagtgcagaaggtttccttggttgcttcatagaaatatggggctcaatattctggcagtgctgaagggcagggacgtgccttatgtgaacattcatttctgtgccgtggtttcttgttcaaggcttgacacaca

SEQ ID NO: 66658 - DNA, 1100 bp, Homo sapiens
atatcttctcccattctgtggcctttttattatctcagtggtgtcatttggtgaagataagttcctaattttaatgaaattcagtttattaacctttttcctttttgattagcacattttatgtcttgtttaagaaagctttgcctgctgcaaggtcaagaagacattctacattttcttgcaaaatctttattgttttaccatttagatttaggtttgtggcccatttggaattgatttttgtgtgaagtatgaaatcgtgatcaaggttcattgttttgcatatggataaccaatagacctaacaacgtctattgtaaagaccactctttccccacggtaccacagggtcacctttgccatagatcaggtggctgatcatttgtgggtctgcttctggactcctgcagttaaagtttcaggccagggctatctgattctaaagtgtatcttcttttcattattctataatagaaagaatttgagtaaatgattttggaacaatctaaggatgaaagaacataatatgctgtttttttgagggggattgttctgtgctgtttaatagagacacaacaggtactcaaagtctcaaatggcaagtggggtttggagggtgcaggtgtgtggtaacttggagggaggaggggcacagggatcctgtgtccacagactaagagagatggtgttaggaaaagtgctgccaacaggctgaaactgtgaaccaggacctttgaaaagctctggggattcccaaaggataggggaaaaatatgtttttcatggaataacatggataaatctcacaaatctttctatattttctatagctgtaaagtaaagcaaatttactttagaaaaggggttattttttgaataagaatttgtaacagttagattttaatgagggtacataatttgtaattaggcattattcgctcttcaaaatcttgttctaactgggtaattaattgcatttttgattatagaagttaatccatatatactctcatcttaacaggggattacttttttgtagatgaggcacaaatagagggtttaataacctagcttctttcagtcttctatgattgaaaaat

SEQ ID NO: 66659 - DNA, 1579 bp, Homo sapiens
catttcaagactatttgtgaaaggccctgtaccacctttcacactcaaaacatcttctgtttattcaagttttgagtttctttgtttattttgttttattttctgagacagggtcttattgtcacccaggcatgatcatggctgactgcagccccagcctcttgggctcaagcaatccttccacctcagccacacaaggagctgggaccacaagcacatgccaccacacctggctaatttttgtattatttctagagatggagtttcaccatgttgcccgggctggtctcgaactcctgggcttaagtgatccacctgccttggcctcccaaagtgctgggattacaggcatgagccaccacacccagcctgtttgtttattttctaatgttcataaggggaagagactaggtctcaggtcataagaggatattagagagtttcaatagggtagggaagggaagggaagggaagtgaaactcatttatgaagtacatgctatgtgtgttccatatgtaagtgtgggtacaagcttcccccactgtcatcctgcaacaaccttgcaatatatgtggtattatacttccaactattacagaagaggaaacaatgctgggtagattaaatgccttgcccaaggtcatacacagttaaaaggtggaacagccaagtttgtgtgtataaactttttatggacataatatagcataaagaaaactgcccaactcctaagtgtatagctcagtggatttttcataaaattaacataccaatgtaaccagaactttaaatagaacatgaaatagaatgtgatcccccctcccagtctctatctttccccttacttcttgcaaagttaactgctatccagacttagaatactatagatttggttggcccattttataatttaatgtatatggagtcacagagcatatactcttttttgtctgctccttttactcaacattgtgtttgtgagatttatccacgttgctccatagagtcggagtttattcatttcattgctgcatagtattgccgtttgtgagtatacataatctatttattcactctgctcttgctggacattcggttactttctagtttggggctgttacaaatggtgcttcggtgaacattcttatgcatgtcttttggtactaatttggtcttggggtggagtttctgggttataggatatgtatctgttctgatttagtaagtactgccaattttccaaagtgattgtagcaaatacccagaagtgcatgagagttctgatatttttgctcactaaaaaaataaaaaaaaatttttttgctcacttaaaaaaaaaaaaatgaactcaacggccgtgttcattttagctattctggtggttgtatggttgtgtctcattatggtttaacttgcacttccctagtatctactgaaatagggcaccttttcatgtgtttactggccatttggatgtcttcttttgtgaaatgcctgttcaagtcttttttccagatcaggttgtctgcttttttcttaattatttgtgggaattctttatatattctggcatcagtca

SEQ ID NO: 66660 - DNA, 1048 bp, Homo sapiens
cacagctgccagagtcctcctcttaacaaaaacccaccatgttacttttccatcaactatagcaggagtcagcaaacgttttctggaaagggccaggtagtaaatattttaggctttacaatccaaggggtgaaattgagtctactatgtgagtacttacctaataagagagaaaacacatttcacaaatctgtattgatgacattcaaaatataataataattgagtacttttttgtgacacaggtctactgatgggagaaatggaacttctttttgtgggggataacattttgcctaattggagttcaaattggagtttgcttaattggagttcatgctccctacaatgaaattgattgcaaatattgatctgtaaaaaccattcttagttctcaggccatacagaaatggatttggcctgaggcccatagtttgcagatgcctggactatagcaatgcttctcaacattggctgcatgctggaatcacctagggtgcttctaagaaacactgatgatgggactcggggcctaggcccattaaacacttatctctgtgctgggcacagtggctcacacctgtaatcccagcattttgggaggccaaggcagaaggattgcttgaggccaggagtttgaaaccagactggtcaacatagcaagacccttgtctacaaaaaaaaattaaaaattagtcaagcgtggtggcacatgcctataatctcagctactcaggagactgaggcaggaggatggcttgaacccaggaagtcaaggctgcagtgagccatgattttaccactgcactccagcctgggggatggagtgagaccttctcaaacaaacaaacaaacagactaaaaaaaccccactcgtctctgggcatgagggcaagatatcagtatgatttgaaagatgcttcataattctgacctgcagccagtactgagcactgctggcctacaggacagaggccaagaaccttccctgatctggtgctgccaacctctccaacctcttttcctggctcttcttgtgtccagcctt

SEQ ID NO: 66661 - DNA, 6228 bp, Homo sapiens
ggttgtgactcataaagctattcaagccactctattttctctgcccctgagagactaaatggtcctatggagtgtgaaccagagaggagagaggtcttgggagacccagtggccaccatgcctgaaggttagaggggagaaccatgcatgcgtcatacaaaagaaagggaagtggacgctttggcttggccgctggagcgctattatgcctctagccattcctttgccggcctcccaattatggctgcaatttggcagccatttccttgccctggggtggaaggggtccctgcaaaggtatgaacagttgggctgctttgggagccaggaaggcagaagtgaccatttaggtctggggatcacagggcttctattaagaatggtcctgttgtctcaacttttaggagggactgaaccctgaatggcccaattttgtgtgatatttttacctcctactttctgggacttgcaataataaagtaattagcaaaccaatctatagctactccttgaacaagaactagatataaagcatgatacaaagaaccatgagagataagaagctaggatggggtaagacacaaatttaaaaaatgcctaattggaccatacagtgggggagaatattaagactcatacagttggagtggttggaattctaagaagccattaggctggtcaagaaaagcttacagaaggatcaagctttcatctgagtcttaaaaatgtgttggccatgaagtactagagatggatgggaagaacataggcagggggaaggtctgagcaaaggtgcatccaggaaaataaatgcatgaggacttgatgtttgttgcacacctgctgagagctagacacttggtatgcctaccaactataaactaagactaatattattgcctccattttacagatgagtaaactgaggccaaggagctccaactagctctttggctgctcaagaacagggacaaatatgtcttacttatctctgtatcctgagtacagagttccagaacaggcctctgataaatattcacggatattaaaggccataaagcagagccaggattcaaactcaaaatccccccaaggcctgtgttatccagttattggagtgagtatgaaagtgtttctaaaagaggagtgggcagtaaatgtccagagaggattgaggggaattctgagtaaaatccaagaggtaggacctgatgctataccttctgggagccatagaaagcccctgggctgagtaatccgatgcctgtggccttttggaacttgggcgaatttgtcaacaacaacacggagctggtgaccgattgagtgggtcatgttttatcctcttgctgcatttcctcagagcaccctgtatgcccggtcctcttcaggaatgtgttcctggtggcaagttcttgtccaaagtatcctccatctagactgtgaactctgtgcagttaggaatggagtctgtgtgattcacccctggatcctcaatgcctggccctggaatatagtaggcactcaactatcacctgatgtgtcaattttagataacgatggttggtacctatacagatcatttccagaggcgtcttgctgacagcaagggactggaaggaaaatagctgatgtgaagagatggcaggagatgtaggaattcagggaggaattagttgtttttttctctgtgttgcaacacttggctcatctgtttgggcaccttctccctgtcttgattggcatattagcttcctacagctgccattgcaaagtaccacaaatggaatggtttaaaacaacagaaatttattttctcacagttctggaagctagaagtctgaaatccaggtgttggcaatgttggctccttcttgggggctccaggggtggaatctgttccatgcctctgtctggttcctggcttctggtgattgtgacactccttggtgctccttggcttgcagctgataagtccagtctctgcctccgccctcacatggctatcttctctctatatcttcatgtcttcacagggtggtttccccactctgtgtgcctgcttgtgtctcctcctcttcctataaggacatcagtcatactggatgaagggcctaccctattccatcaggactacaccttaacttacatcttgattacattcacaaagaccttgtttctaaataaggttgtatccacaggtaccagaaattaggatttcaatatagcttttggaggaacatgattcaactctcagtagttcgttatcacatattagtgttaaacaaaataatacctctatatggtgttttatgggtcatgcgacagtgatgattgcattaaattctcacactaaccctaagggtagctggcataatcagccctattatatattctgaaactgaggttcaaaaagtgatttgctcaaaattatacagtgtagaagtgacagaaggaggaggacctgaagctgggacttccaactcatatattgttctctccccttgtgcttctgaccttgggagctgctgggatgcgggggtaggcatgccaccctcctcacatccccacagggctcacaggatgcttgaggagaaccaggtgctctgtaaatacttgttggcttgaattgcattcagaagctcacccttgctctggagagaaccttcaagggtagcaaacaatgacttttactgaacatgtcagagagtgtaagccaaattttgagagaactagggtttagtgagtctgtgggcatttccgcaggtgaggtgttgaattcactgtacctcattccaagctgcggggagccagggttcaattctcactttcttcctttcagagaacaagcctgaggcccctgccaaggcttcttctcccctctcgtctgctcccctccctccttcagtgtcaccctcttcctccaggcctgttcttactctgatgcatcctccaaccccccactgccagagccagacagccatctgctcctcactcccccgtgtctccgatggccccagggcaaagtccagactcctgctgactgtagcacgcactgcatcctctggcagcaccacctattggaacacaccctcacatttgtgtatgacacaaattgtgaaacacaccgagtcccttcagtaagacttggctcttcagtggtgcccatatgcatcgtggagtgcccgcctctgctcctctgggcaagctttctgaaatccctgtttcctcagcctgccttttttgcatttcaatctcatttgccattgttaaaataaaggagctgaccagagggctgacgcagtcccatcagtttaagacttcagaagtgggaaacagcaggtgtgcttttgccccttgttaggctataagaagccactctgacagccactgaggactgaaggatggctttgctgttgtcccattttgtctttaaaagcatcctgtgaaggtgctaggattaacttagtgtgaagatgaggaaacggagacccagagagatatctgtctaggaacttgcccaacgagctgagtttgaatatcgcttccaccagctgccagtcatgtagttttgggcaaatttcttgatctcggagcctcttcttttttaacaggaggatctctgagactcctcttatattccacaaggctgttttgaggtctaaacccagtaatctacctggcatacagtaagcactcagttgactgtagctggatttcagagtggaaagaagggaaaaccgtgacagaaaaatagctacaaggaaaagaggttaggagcctggagggtgcagaagaggcacgaaaaggggagttatcaggcactgtggggggtttgggaaatgacactagggcctgatagtgctcaatatttggtgtccaagataggagccaaaatggatttctcactaaattcttagttgtgtcttcactcccttgctgtatgtggatcactctgtcccttcggaatgttaacatgctgggaaattcatgtgtcattttggtcaaacggagagaaagggagagacaaaggtcaggatgggtgactgaagcagcccaagaaagaaaacatgtttaggaagaccttaaaccctacgtcatgctttataagtctggaagatgacattcagaggggctctgtagcttgcccagagttgcacagcaagtagatagcagagattaggacacctgtttcccaggacctatttatccctgctgtgtcacagcgatgcaggacagaaggggcagggcccaggcagcccaatctgggaagccgggacctgtggttgattgcctatatcctggtttccttaccccaaatccttgtgatccaggagcacacaaagaaacatgtgggtgtatattctccctgcgactttccttttctaaagggactttcactagcaagcaacccagccatcctggctgctaatgtaacctgtcacttcaatgccccaaggccatcagcaattcacaacgtgcgtatctcctaattagccaatgaagtaactgttccatttcccttgctccctctgcctccaagttcacaatatgttctctcctgctcagcttcagctcatgtcttctgtttctgcccagaacttccctgtgagcaaacatcataaggaaagggttatcttgggatgtaagacaggggattaaggtttccgctctgagacccagctccatctccaaacccatccttcagagttcctggggctaagccactgtggatgttggctgtccttgacctcagaactggatttttctgtctgagaacaggctgatggagtctgtgttggttataagtaaatgttttctgtaatatcaactgcatgaaagaggaaagccaattttatttcttggatcccaataatatattgatttttttttcaaagggaaataaaaaatcatttggctatgccaaaccaattttctgtatcttttggtggaggggaacaataggagtgctcacagctgtcccatagaaataataaatgcatgtccacagtccatcattgaaagcccttggggtgaggtgtgtttcagaatttggtttgtttttagatttttgaaaggaaatagggtgcatatactgtatattatgtgatacgtctgaggctgtgctccataatcaaagccattaatttctctgcagcaaaatgtatgattgtacacactaagtaggaaagataaagacagtaaatagcttcacattacttcatgtcaggtttttcacccaatgagttataaaaaaaacccaaccttttggttttagaattttttgagtgtcaggattgataagggcctgtggctctctgattaatatttgctactttactatataaattcatagagagatgaagattgcctgtatgagactgcataaatcaattttcagtagttcccaaagacatgtggacctcaggtaccctaggggagcctggttccacttggcatcccacaggctagcacagatcaggccctgaggaaggaactgagaaacattgggtgagtaaatgcatctgcaggctcactgttggcacaaggtctgttgggtcccaggaactggcctactgttgaaattatgatggaaaaaaaaaaggaactataaaacaatagcaatagctcacccttgtagaactcttactattgccaggcattgttccaaatgccctacatattttaactcactgaattttcatgactacactatcaggtggcaactatttttagaaatgactcccccaagttcacatagtaagtggcagagccgggcttggcaccccagcattttggcttctgagttcacacttttaatgacgctgcctcttatgtaaaaaccatgtccactaaagccaggctcaagcaaacaagagttagactggcaagaatgaacctccttaataaaataatatgcattattgaatacatactgtgtgctaggctctatactcagctctttgtattattctacttaagcctctaaataactatataaagtagagtttcatcccccacttcccaggtgaaggacctgaggctcagcagtggaggacatgtggggcaggattcaaacccaggacacattggcctggagccaaggatcttggagtgaggtcacagatactggccttcaggagcttacatggaagcccagggactaatgtggcattctgagaacagctggagccagaccgatctctaggttatatgccagcatgttga

SEQ ID NO: 66662 - DNA, 4612 bp, Homo sapiens
gtttggggcttaattattatgtcaggtgatccagctttagtccagatgaggaccctttgtaagaagctttgccatgagggcagcagcttcagcggagggtcaaggtccttctgagctgggaggctgaaatggaacacatgtggctctgagccagtgaagtgctttcttgggactgccctgctgtccaggaactgaagctgggttcaaatgctgactgtcattctctgggcatgtgaccatggccaagctaatacacatgatgagcctcagtttctgcatctttgaaagggtgatcattgtgagtattttgcagaggattaaatgagataagactggtgaaccacccccaccacccccctcaaccccccggattttttggcctcatagctttgcttctatgcatgaagtgctgaatgccatttctggtactgactcagattcttcatgtgccagtctgggtactgacttgtggagtggatagtggttgagggaagacaactgggggtgggaggaatgggagaatgtgagtgtcgaggggtgggctacctcttgggcactggcaattacatgacagtggaacagcattgcaatttagttttgtgtttttcattgtaacccaactggcaacagaacagtgatgggagatggaaagggtatcaaatttgactagtgagttgccccttttggtcccttccttagagtaagcctcagtttcttcatctgcaaaatggaactatcagtgccttctctgactacctcgcagagttgctgtgaagaaaaagtgagataaaaatgtacctgaaagcatttgtaaaatgtaaagtgctgtataaatgtaactgattattgtttcatttaaaagacatggttttgttgatatctcatgaaaaacagtgctagtcctcccatttagtcatggcgacaacctttttgtcataaatgtgcatgggagaatcgttggttagtaggtgttttcctttatccaagtggtctgagctggaaaatatggagaattccttcactaaagggccatatcttttgactctattgacagcatgtcatgtggaactcaaaactgccttcgtgaatgcagatagattgcatctattagctgcctcttgtcatcatgacctgccagaagggaaaataaaatgtgcctacaaatatttcaatatttatgttgtgtgaaggtttaatattcatttggagcagtgaatggggaaagagaaaaaaaagtccacatcctttactttggaaattgctcagttcaacaagaatttattgagtacctactatgagctagtgagtgaatgatatgctagtgtctaccaaagaaagacaccaaattctaatattgacaacttcatgtttgcatactttgtcagaagccttggagaatcccaaggtcaggagtctttgctcattcctatgggggaactgatgaaatctgcccagaggttggggaagagggaagtaggtgaaatggctgcagaggagaggtgtttgtagtaaaattggggaagagaggagagtgggagggggtggatcagacctcagaaacacactcctacctgttaggatgtaggtgtgtgcttgcacttgtgggtgggaccaagagacaggtgtcagtagcctggagttataaaaaccaaaatgcattgaataattggatgggaaaccacacataagaaaaggactcttagcaagtgtattttttccagcaatgcaaaagtgaatttacaagcatattgttgtagctgtgaaggggcaagctctactaaagggatagatggtacatgaaaataagttgtaaaatgttgttaattgaagaatatgttgataatttgtgtcactgatattcagtgttttgaatatgttgtcattgtcatttctcattatgtaaaaatataataattttacaagttcactggtgacttcattcccctaaccctattttttccccaataaggtcctaaattcctgaagcctgacttctcctgccccaggggttttcagaaacctaacccccatggttggcgagggactgctgtgtgtgaaatggtaactgccctcaaggagcttacaatctagctgggggtaaatgacttgcacatgaacacaactagactgtgagcttctagagggcagggaccttaccctagtcatctctcttctcaccctgcacaccctccctgagggatctcatccatccccatggcgtcaaccaccacctgaggaccctctaggcctgaattgtctcctgagtgccacacccagctctccagcatcttcagtgttcctccccgggtggaatgctccacagcactgccaactcaacctgctcaccaaaacccagcttgtcatatctcctctgggccagccctggcttccaggctcctggacttggtcccccagatcaaagatccaggggtcactcatttggactgagcttgatggaaaagtgcttatgtttcaatgttaagtaaactggggagcctatcaaatgtatagacatgatgaactcattgatgttaagtacatagatggaaagagaaatgcttcagaatgtattagtggttgcctctaatggtaaaataatgattgacgttttctttttctgacacccttgtgctttccaaatctcctgcaaaaagtatttattacttttgtaaccagcaaaaatgcctaataaaaatgattgacaggtctccatttgagtgtcaccttttctgggaattattgtttattcctttgcatctcaaagagtctgaggctccggggttagacagcctcagcacgtgtgcttaccctgttggggaacttgttgcactgtgttctttctgtaaatcggctcttccattagtctgtgagctccgagagggcaggaatcatggttattcatctctcatttccagtgcctagcacaaggcttgcatacataactgctcaatacatgcttgttctttaaaggaagagagggagggaaggaggcaggaaaacaaaaaggtgaaggacaccagaattctcaaatgttatacctccatggatcccttgtattatttcctgtccccaagatcctttgtttattaagcttttgaatctactgtaccactgatttttcactcggtagtttgaatttttctgttttttagtaatcataggccttataaatcccaatcagagcttctcagggccaagtctggcatatgccacctgctgtcccaagtctgacttgggcagagtgccccctgcctgacacctaggtcatggcatgcagggctatctccagttctctggagctgagtgtaccttctggagcttcttttaaagtggaacgatggcaaactgcaatgtctgtgggaggaggagagcaagggaacagataacataagaatagaagtgacaattgcaaacttcaattgtgtgtttcctctgtgcaggcactgtgctatgcatcaacacgcactgtcccctcagccctcacagcagctctgtgacacaggcactattacaattgccattttgtaagcaaggaaactgaggcttaaagatgcattagatggggaaactggaatttgcactgattgcagagcttaagtccagcactgcatccctcttctgaagttccaggaagagcacagggaggagagggcaagagagatgcctgtcaggagaaaggagcagtgtttgcaatttcagagccttgtttggggatgtgccagcatagaggagtttagccccgaaggcacaaagcccttcacaaagtctgtgacactcctgaagttgtaggcaatttgttccaggtatgtgcattgtctgggaaggtcttcaaaggagtctgtgtggttaaaaaaaaaaaaaatggttaaggaagcggaccatggagcagaaagttgcagtgactggattctggctccaggctgcaaatttaaccattgaatatcacccaacaggatggatatggggatatggtcttgttgataaagcatctccctcacacaagacttggagaaataatcctggagggtgtgtgtgtgtgtgtgtgtgtgtgtgtgtgtgtgtgtgtgtgtgtggtgtgtgtttatgtgtctcccaggtatttagaatcaactgattaccaaatcaatcaacaaatatttattctagcagagacttgatagctctctggtttgtcagggttgtttaaagaaggatttctgccttgggtgggagtttgggctaaagagataataataattaccatttattgagtgttggttgtgtgccagccaactctgctgggcactttatatacatgattccacttaatccgcacaacaacaccgacaaggaaggttttataacccattctttacagagaaggaactcagagggtttgaatatcttgcctaaggtcatagtaattcaatctgtgtaagtagaggagccaaatttgactctacgtctgtttccaagattccacatgtttctgtttctctctttttttttgatgtgaatgtatgtgtttccaccagaactaagatccatcaagttatcaaattaataaacaaatgtattcaagcaagactcgatgcctgttaattagccaggctgtattataagggagccttgc

SEQ ID NO: 66663 - DNA, 1042 bp, Homo sapiens
tactgacacagtgcctggctgtggtgcaaagaagatgctcatggaataggctgcagtgatccagagttgtaagacagaatgttatgggagcagataggagaagaaaaaataaatgaatgaatggatgcatgcacgaaaacatgataatcaggagtgttttccaagaggttagtagttggaagttactgggagatgggatgagtatttatttgatacatatttataaagtatttttatgccatagtgctgttttaatcactttataaataatgaatttaattttcttacaaacctaggaagtaaggactgttacttttcctacctcgtatgtgaggaaaccaaagcatagacaggttaggtgacttatccaaggtcacatgggtagtaagttggagctgggacttgattccagataattcagctctagagtctactgttagccacctcactctgtgtggaatggggttgggtgttccaaagtcagggaaatcacttggtaactggtggaccccaactgtcttacgagggctgtcgctaaggctgtcctgggcttacagacaacagagggtctgtcacccagctgggccatcatgagggagctggccatctttgccattcctggggcctgacatctcacagcctgttggttatccttacgtggcaggctttcagtgatgcggatgcttcttgagaatgctcttgggctttaccaaccggctaacttgctagcagagctgggaaggctgtgtcctcttggggtgttcgggagggctcctgagctgtcctggtggtggcacccagtccatgccaggcctggccaccagggcctgacttctaacaggaaggctgagccagtgcagctctgtggttgtggctgagccaagcatcagtgctctgctagactcctttgtgaagctggagtcaggaatatcggctcccactaccatagaatttcctcttgaagatgagcatttgttgatgtttaataatgttgttcagtggtttgaattgctgcccaatacttgtcttcacacattgacag

SEQ ID NO: 66664 - DNA, 1072 bp, Homo sapiens
gtggaaaaagccagactcaaaagcatgtatactgtatgattccttttatgttaaatttcacaaattgcagagtaatctattgtgataggaagcaggtcaggggttgcctggagagggtgaaggggtgggagggattatcaagggggatggggaaatttgggggatgatgtgaatatggttactattttgattgtagtggtgttttcacagttgtatactgatatcaaaactcatcaggttgtgcaatttaaacatgtacagtttattgtatatcaaatatagctcaataaagtatgtttaagttaatgttcagtacaaggaaagacaaatcacatcctcatgctggagtttgtttacaagatgatgagttctcttcagatgccaccacagtgagtggagtttgactcccagccccagcactcactgtcaccttgggcaagctacttaagctctctgagctgcagcttttccatatgaaagtggagatggtaaacctacatcacatcattcctggggcctttgaaggagttaatatacataaagccctgagcaccgagtctgacctatagtggatgacccaaatgcttgtctataatgatagcattatttattattttcaggtatgcggaatacttaaataccctaaaccacctgtaaacgaatgaaaattcacgtgagtcaacctgggtgaaaaccaaaatgcactttacttccttgggggcatagacatgagtgcttccaaagtgctctgaaacagtttgttctttttggttgattaaacatgctttaatttcacagatcccagttctgttcagcagacattctttgaggattggaaggacttcccaaaggaagtgactaatcatagaatcttagaatcggacaagagagagacagtcttaatgcaaccctgtcatcttacagacatggaaacagaggctgaggaagaaaggtgccttgtccagggctgcaaagtggtggggtgaagagggaaccggcctcctggccccagtcagcatgcttgcccctgcaccacgaggcctctcccctaagccaggccgctttccacaga

SEQ ID NO: 66665 - DNA, 1035 bp, Homo sapiens
tacgtaagagtcaacgcatgaaacacacctgcctttaaagagcaaaagtaaagttcttttaagccatttcttcagcacaacataaatgtgctaaacattgacattcttatgccagcccttagatttgagactctcagttaactactttccagatatctgttttgcccttaatgttatacagtattgagatattgatcaggacctcagccacagtatatcttggctaaactgtcctaggtttctagcaaacaaggaatgactgtgtgagtggcaagaaagcgttgatgttacagttgcctgtagtgtctgtctttttttttcttttttttttgccattgtctggttatgtaccaaaatcctaactgtacctgagatagaagacgcaagctttgcgcaaaagcagtgttagtagcaggcataccctacaggatttggagcagagacctggagagaaaccctgagcctgccaccaattaatttgtgacttgaggcaaattacctgaccttgttaagcctcagtttccccatctggaaacccggatcttaataccatctcgttaggttgttatgagggtgagatgatacagtgcatgtaaacctcttagcatcatatctgtcacatagtagggttgtaccttaataaacagaaaccagtaatgttaattttaccaaatttttatgttatagctgaagagtttcttttgtcaaaaaagaggcacatgaaagaatgctcagtatcattagtcattagagaaatgaaaattaaaaccgccacaagataccacttcaaacccactcgaatgtctaaaattaaaaagactgaccatacacgtgttggtgaggatatggagcaacagaaatgtaaaaggagactactacttcagagaacagcttggcagcttcttaaaaccataaatacatacctaccttgtgacccagccattccactcctaggtatttaccccagggaagtgaaagcgtattgagatacaaagacctgtacaagaatgtttgaggcacctctatttgtaatag

SEQ ID NO: 66666 - DNA, 1034 bp, Homo sapiens
cagaattggcgtttagagccagcttgtaagccacatgattggctatgactcaacagatacaagtggcatcttgcaaccattagtatcagtattcttgttgttttcatgtcctgcatactgtagtttcagtgtttttgcttgtttagggaaatccattataccctaaagaagcaagttgataagaaatccccacagagagattctaggtaggtgcttttcagtagaggtttctgtaatgatggaaatgtcctgcatctctgtcctccaatagggtagccattggtcagatgcaactgttggacccttgaaatgcggctagaatagaattttaaattgtatttgtatcatatataatatataatttatgttacttattatgcatccttgtttgtcatatttatgtttgctttctattaggcagtactagtctagtgcgaggagacagacaatcccactactgatacatacaccgtttaaagtatactgtaggaaaagggccttccttgaagcctgcaccccagccaggaagagtgccattaaagagtgacaagatctgcctggaggtcagtaagaaaggctttcaagaggagagaacttcttattactgggctctgagggttttggcaatctctgagtagggaaatgtggagtgattcttccagaggagagagcatgagaaaaggtgtggaggttccagaaaagcacatacctgggggatatggagtgggatgaggcgacctcaggaagaaagaaggccacaaggagcttggattctattctgatgaagcaaggacactttacatagatgatgtcatattgcaagtatgagcagggatgtcatgagcattatccaggactataggagacatacatagtgttcttcaaaggacaatgtaattctttggacatggggcataaacaccatggttcaaagccaagcttttagaagcagaatgcgaagttgaaacttcttctactcaggtacagctctctttgctatgtggtaatgtttactaccactgtggtcatgttta

SEQ ID NO: 66667 - DNA, 2409 bp, Homo sapiens
tttcacttacagcaaagctaagtgaaagctttggaaggtttggaaagctttggaaacttctggaagttgaagtatcatccctgaggctacactgctggtggaattagcattgaacctgggtttatctgactctggagtgactgctcctacctctgtcccatcccagctccagggactaggtttcaaatattttttccgtattgtgtggatgtgtgagcatgtggaggggtaatagttttttcttttttccttttcaccataggagcaaataaccatcccccaccccccaaaaaaaaactggtttgtgtccaaataagtttgataaatgccaaattagagaggttaatgtattttcatgctgcagaaagtctcagagtcttcactatgcttatgcgaatctccaagagaggcataaatagcacataagagttcccaaacttctaatatgagttttcttttttctaaagcaaaaccatttttagcactctcacaagagtagggtttcttcagaagctctttgggaagtgctaactttgtggatttctgaatctgtagggttctgattatggttcctgtcttagtgatatggtccaagcaggaagcttggagagtcctgcaggggctgagtgtttccctcttgggaggctgcaagctgcctctctttctgacatcttagtagttcagataaatgaaatgcgtttttgttctaacccttcccaacctattttatggaaaacatcaaagtatttaaatacaaagagtaaggatttaacatgttaaaaaaatgtatttcaaatgatcaggagggagaaaacctttaccatagattgggaaggatttgcatccttgaaggagctaaaagacaaagataagcttttaaaatacatatatggaacaaagagaacacagtgggttggattcaaaatatttaaatctgtcttattccattaagggaactttaaaataaatggtttctcattcattcattctctctctcactcacacacacatgcacatacacataaaatatcacataggaagtctcatactcaaactccctccccgcacccaccttgtatcttgaaggaactaaggaataatttggctcacctaggtagctggggaaactgaaggcccagagaagggaaggagtttgtgccaacccacgaagccagttcatgggacgtcaggccaaggagtggagatgtggatgatgtctgacatgctttgcacccctactgtgtagcagacctaatctctttacctccttacaaccaaccaggttatgggtgttatcttcattaaagctgaggaaatgaaactaggaaatgtcaagcaacgtgacccatggctggtaactggcctcatagtgggatttgagcccatacaaagtacatatcacactgtcaagtccagaatgtgagtttcctttttgccaatctaatttaaccatctcatccactatccatccctgacttactagacagagcaaggtagccacccagttaccttctgatgagtcaggagggaacacatccatccccgtgccgtgggtgctaagggtgccattgggaacatggaggaagggagctgacctcttacctgtgggtgtgaacagctcgactgccctgttcccaagtgctctggtggtttataagcagtgaggtgagtcacaaagcagacaaaggccactgactcagcgggtagagggaggtgccctcagttcttgattcaacattgccatgacttgctgggagtggtttttgatccttccatgtgtttttgaaaagccaggtaggcttttcatctccttcaccactttagatgcgagtttgtcctggaggcagggaaatggctcagctgccctcgtgggcttctgtcaatcctatgcttcaaacaagtatgagctaagcctagtctagatgtgacctggaatataaacaatccaatgagtttgacttccttcagaggtggcacctggagaggccatacatttattcaagtgatgccaccattgctaaacacaaggctgtatgcctctttgggaatgtgggagttcagtcattcaactaatgtctgttaagagtgtccaatttccaggcactgtaaaagtgctgggcaaagtcagaggaaagccaatccctgccttcaaagagatgacaacctgttggaagacacagccacgtaatggagtaattggagtggggtgtaaatgtacaggggacatacaagagccacctctgcatgggggcagtcaggcagggtctcacagaagaggtgaagcatgaactaactgtactgaagggtcatcagagttcaccagggtgaccagagaggacattccagttgcagggaatagcatatgcacatccacaggaaaatgagaaatcatgtttcagtagggctaga

SEQ ID NO: 66668 - DNA, 1628 bp, Homo sapiens
agtgctggcattgtaggtgtgagctactgcacctggccaactttgccacaaatgaccagataattctttgttgtagggggtgttctgtgaatcacggatgttgggcagcatccctggcctctatctactagattccagtgccttccccgccaattgtgacaaccaaaaatgttgacagacattgccaaaagttcactgagcaaagaattgccaagattgtccgtccctggttggaagccactggactagcttgtatgacttttggcagacaaactaaactcttggtattagttccatcttttttaatgtatgacaacaatacctgctgtaagaatgaaatgaaatagcattaatcaagcttctaccagggagcctggcacaaagtagacagacacatctgagaaagaaccttcacacccaggttagtgggggaggcagggaagcttcaaaaagtgggaagcatttgacgtcgacttgaaggatgagaacatattttccaaaaggactagaagtattgtgattattattattcatcctccttcctctacccttgcaggcctcctctcacttgctggtcactccttcttctctcctgtaaaaatcaaccaaagagactcttctaaatcctcagctcctggaaacaggagatttggttctggcctcacatttaaccctccctgcgcctgctgctccaggagtgcatagactcgccccttgttctggagcaggccaagaatgacccgtttccccaccttgttaagtatgaattggaaatttgtacccatgcagtttccttgcaaaaaaaaaaaaaaaaaaaaaaatgcacttgtaagcattcagagctggcttgaacgagacaggagctacaaatgcagttgaatatttcatgaagaccctttcaaaccacatgctctgctcttgtggatggtatgggggagaaagcacaggctacgagtcagaccaactcagttttagccctgactctttagtggaactttgccgtaggaagtgtcttcacttccctgggcctcggtttcttcatctgtacaatggcgggggtgggggttgcaactgatttgggatatattgtgagggcttcaggagataatataggtaaaggatctggcagggtgcctggcacatggtaggtgcttagtcaatgttacctctccagttggaatcttcctgttctcttcccagtatctgtgcttttagggacagcatagtctttctggatgacacaggccaatggcatgggactccttgggggattgggtttaggacagcctcccagccttctccttttaacttaagctttgggattgggtccggcatccttggaaggctcaccagttggtctactttagaagacaggatgcaaagaattccctctgattcaaatggcccagctgagcatactttcagtttaaaaataagtcggcctatcagaaggctgttttaaaatgtagaggtgacaagcaaatgcctgccttacctttgtacaaagaggagtgattagaagagccaaaatagaagcccagagaggctcctgggccacagtccctgccccaggcccagaaccagccttgggtcagaccctccctccctctgttctaccagggagccaa

SEQ ID NO: 66669 - DNA, 3029 bp, Homo sapiens
atagagggaggttctataggagtctattgcaggttatttcaggtcagactctgagaggacccctagctttcttgtcccctgaaaataaagttgcctgtagacatagaaaaaccaaagggctctagattgagacagcagatcctggctcaaattccagctctgtttctttgccaccttgcaccagcttgatcatgttaaaaatgagaatgatattacacctgtttctctgagctgctgtcaggcactagatttagagttacttgaccctggcggtgcattagaatcacctaggtgctttttaccaaagactagcaccatgcccccaccacagattgctctacaactgttccaggtgggaactagtcatcagaactctgtaaagctgcccaggtgattctaaggtacagcaggcttgagaaatgctgcatagaatacagccttactgaatgttagtctcctccattttcaaagcagcataaagggatcttatattgagtaatttatgtacgaggtgagtgacctaatttgtttgagccatgggactgcagatatggtaatcaaggtttctttcccacccctgccctcgtttttggcaaactggggcatttgggtcagaaaagtggccttcttactcagcctgtcctcttctgattccaacacagctgccttctgagtgctgggaaatgcctggcccttgcctggagatgtcatgatagtcctttgacctacttttgtttcttttctgttcacttctgggctgtgccccattaaccattcatgcacaaccctccaccaagctggcaaggcctcagcattcttcaagtggaagagagaatgcttgatttctgtccacatcctataaaatgcttatcagatgataatagctttccagggttagtgacagagacttagcatgacccaaaggcctggaggctcttcacttatgcatgatttggtgattttacatctcttagacaataaatttttggttgagaagtacttctactcagcggtctgattttttcttgagatcttctcaaacccacctcaaactggggaaatgtgttgtattttggagagggcttttaacatttaatgtgcataggtaccatctgagaacttattgaaatgcaagttctgattcagtgggtgggagcatgggcctcagctcctgcatttctgacaagcttccaggagatgttgatgccgccagtctaaggccacacttggcttagcagagctctaagaccttggtcttccttcctgcttctgctttctcccttctgtcttcttaggtccaggagcatcagatgcagactgtcattgagtgaatggaatctgtcagttttgtgcaaccgtttgtcagtattgttgtagcctcagtggaggcaattgtagtgtgaagtagacagagtaaatagtggccattatcatcatgccgtggaaagattccagttccacgtattatgttatactctccaggcttcttttatatcttcaagcacattaagcctcatggcaccttgtggaataggcagtgatttttattactaggataagtattactttgaaaattttataacctttattatgtttttgtttaatgtggttttcttctgattatgacaataatgcatataaacaacagaaaatttaggaaacctaagataacacagagaacaagaaaaagaacccataatcttgccatggagaggtagtttctcctaaccttttgattttctttccagtattgtttctatgtaaaatcctaattctcaccactaccctctcccaccataatttggagcacattacacacattgttttgcaaccttaatctatcacgatcgtttccccgttccattaatttttcctccaacatgatgtttaatagctatgtagtattccctcataaggatataccattatttatttaactaattttctattgttgtattccatttctcaccaccataaataatgctgagatcaacattttcatgtagttgtctgtttattttcttcagtccaatttctttacttgaaatttctaggtcaaagataatgcagctttttaaagcttctgacaatgtgctgatccgtgatgggcctgtggaagcatggaaccaagaccagggtccctctagtctggtagtagtttgaccagggaagttttcatcattcttgtgttgtgtagggagtttcatcattcccattttgtgtcaccagggtaccatggtggcactggagaagccctgagcagacagccccctctgccacttcacctcctggttcatgtgtgctgaactgcatcacacaggggtagatggtcactaggtcattaagattgatctaggccatatcttgcttcctggatctgtgaaggtatctgcagttttaaaggagagaagaaaaggggaatgaaaggtaccaatactgtgtctatcaaattctagattcatatatccaactgcctccttgctatttttatttgaataatctcatatgtgtctcacacctaacacatccgaaactcatcttccctgaaagacctgctttactggcaatccttcctagctcagctaatggtaactccgtccttctggttcacaggcctcaaattttggagtcatctttgactcctgtttttgttttcataccttatagctcagccgtcaggaaatcatattggctctgctttccagccataacctcacagcggaccactcttcatgctctccactgctaccacctgggttcactccgatcttctctcatctggatgatcacaggatcctctttgttgaattgtgtgaggcatttggcctatattatcgcatttattcacatggagctgagtaaggtcttgttagttcccattttccagaggggcaacagggactcaatgaggttagacatcttgcctgaggtcactctaccagtgagtcagggagccagggtcccctacagacatccacctgtccgtaaagcaaatgttcctctccaggaggtgctggttgtaagttcat

SEQ ID NO: 66670 - DNA, 5278 bp, Homo sapiens
tacacaaattctttttccaagaacatttttcttccctggctcttggaatcatcactttctggagtgcttcagccagcaatggagttgaaatatgtaaatatgttcctcagcgttgtaggtggggctggctccatggtgaatgacaaatagttcctccgagaagagtgtgtgtcttcagcatttgctgaggctgtggatttccccctcccacctttctccttccctttggttcagaggccttaaactggcctgggagatcttacaaagcaaacagttgagactctaccccacagcaagcttatctccacctgctgtatggcattttactaggaaaaatcaaccccacggagtctcccttcacagttccagggcccaatcaatcaatcaatcaacatgcctacatgctattttgaaagtggaaattgttaggcatcttgtcccctctttgcatggttcaatcaatcagagggtgcttttgccgttaccccttctcaagtgtgggatttctgtgaccagaaaagatgtgttccctgtagttagatagctagtcatctgacaaagaattcagtggaaccagtgggggaagtccagtcctcccatttccaaggtgcccccatgctcagcaggagacatgaggagttcctttagatcaggtagagaggtcacctcaggattgtttcacggtgtggtcaccacagagggagcccgctctgttggttgctgactctgacttcagacaacggtttagatgctgctttgatacttatgccactctagtttcactagggaaggtgaaggggtgtttctgttctttgtcatgttctgaacatcaaatcagagcttttctttcatttggaaaacagaaaggaaacaggccatatgggatctccagagcagtggtcagcaccccggttccctttccctgtgtgttctgcactggctttacacaatggcatcactgtagcctcacccaatagtgcaaaagggtatcagaggcaattggttaatcattaaaatccttaagaacattaggttttaagaatgtttttctttgaaagtcgatttttctcgctgtgggatgagtgttgatttctgaaaggctggtcttgcaccctttgaaagtcaaacaaaagggttgcagttagtacatttatggcctggggtaaaccttgccaattcctgatgccagttttcctcactataaaattggtttgggagaagagagtggtttccatgtcttgttaagttagtgcaatctcaaactctaatgtgcacacccctagttctgggatcttgttaagatgcagattctacttcatttggtctggggaggggcccaagaatctgcatttttcgccagctcccaggtgctgccatgctcctggtccattgtccacacatggagtagcaagatttcaagctatctactgctctgactttatttcagaaagtcataatcatgacccctggatgtcaagaggagttgcttatatttgtagaatgacactataaagggatgtgcccattctttcattttagatttggggaataatctttatttccacaaacagtggaaataaagtgcagaggggcagcatcagtcctctcatcctgtgatcctataggagatggaaaatgaggcaagaacaaaacgaacacatactcaatgctttctgtgtgtcagagaaactgaagctcagtaaggctgagcccagggtcacaccactagaactagcatttgatggtaggcctctctggctcctaaatccttgtttctcctagaatggcaactttgtaactttcgagaatatgccatgtaattcaaactgataatttagcaaagtgtttccctttagaggtcctttttctgggcctactttgaaagtggatcgagacatgtaaaaatttgcatcattatcatgcaagcaattaaagtgcttaagagcttaaaagcaatttgttcaagttggttaaatatccaccctccccaaccttgtttgtattattaatttactcatcaaactgtgacatcaaaactattgtgaaggtaaatttcagtatcttctgttcggtaaaaaacttttaaatgtgaagggcttgtattgatgaggtccacagtgaaaggatccagttcagggtgagtcagagaaaccagctttttactaaataaacccagctctgctttgacctcaggatgagaactgatcatttaaacgttttattaatgtgcaattattctgagaaccagtcagcaatgcagctctttgcaaacattaattagctgaccctcacatcatcccacatgacagataaatagcattcacgttgcattggagaaaacaaatggacacacagagatgagggaggaagaaggcagctcttgccttgaaagaaatgtggtagaagtaggtggaattagaagaccatgtaagttttttacttcataaatatttattgagcaatgcactagataatctagagctattctatgcaatatagtagtcactagtcacattttaaactaaatttaattaaaatgaaacaaaactaatcatttatttccttggttgcactagccagatttcaagtgctcaacagccacatgtggttagtggctgccatactcgacagtgcagttatagaacatttctatcattgtaagacattcgattaaggttgggattaaaaaaaaatgcaaggatccttgccattgtgaactccaatgtaaaatttcctaaaacaatagctgacacatggcaactactgagtaattcaagttgtggttaagttctttgggctaatggttagggacccagcttctggagctagaggactgggttcatttcctgggtatgccacgtactgaatgtatgactacaggtagatgactatttaaatgatgtatgactacaggcagactatttgaatgctctatgctgattcatgctgctatttttcacttgtcttactagctgagattatttttaaggcagtgttggatcctggagagggtgctgggagacaggtactctcctttgctgctggttgaaatgcaaattaatatacccttttaggtaagcaatttggcagtaactgtcagtagacttcggaacacttattccgtttagtccagtattctgattctaggaatctagccaaagaaaataatcagagatgggcagagaaaatttaagaataaaaatgttcattgcagtgttatttataaaagagaggaaaaaggtaaacaattgggtggaataagtaaaatgtggccaagcctagcagcggaatattattcaaagattacgtattgttttgaaaatgtgttttgtgacaagggaaaatgccatgataaaaattatgtttaaaaaatactaaacactatactgctaaaccccaaaagtatttttaaaagtagatatttgttgaagcaggactagagaaataaagtactgagtagtagcttatgaattaatagaatttttgatggtttggggaagattgtttcgacttttttctttattaagttttgtgttttatttatttatttaatttattaattgaactaacctaagaaaattggcaacggtgcgtccctgtgctctttctgctatagaatgcctcagagactcctagctgctcctaatctgttttttctagcacgtttggaacttctggcttatctattctagagtttgtctgccttcaaggcctagatgttctttctaatgttaaaactgaattctctttatggccatttaagtacatttctacatgtagtaggtgattctgactgagcagcatggggtattgcagaagacatcaacttcaaagatggaaagaactagattcagaccctgaaccatcatcacctccttgccatgggaccttgggcgacccttctgttcctcaatgtcctcatctataaagagggaagcaatagaatctaccccatatctcatggctgtgtggattgtgctcacttcagtgggacatctggcacatatgggtaaataaaaatgcaaatgtcttccatgcctggggtgcagcaccctttagaatgtacactccttttgtgcttgtgccactctcttgagattgtaggatcatcactctccagaagagggagagtaggcatcaggtggttactcaacatgacccctgccataagggcttgtgaatggcaggctcaggacctggacagatgtctggctgactctgagtcttatgctctctctggtacaggtttggaagttctgttcccatctgggccattgtattttgcttattggtttccctgggctgcagttcattgtggtgccattaacccctcaacatttcccagccttgctacttgttcctctcaaggaataaataaagcagacattccttttttttttcttttttctttttttttttttcgcaggttgaatgattgaaacaaacatgcctaactaaaaaagtagcccaacgctgctaagtgacagcagccaagccacattccaggaagaatgtaaactgctcactagtggttcagctcactttttgccaccttgaaacaaggtctcctcccaaatttcacctcttggtggcttgaaagaggcactaaatttgtcatcagctacaactcccagttctcacactttctatctgtgggaccttggtcaaattacttaatgtctgtgtgccatagttttcttttccataacattgggataataataagtctttggcagggttgttggtaggattatcatgcagtaatctttgtgacagtgttgtgagtccttgccatccttgaatcagcaccattatttccaaagctttagaagtaatttattgaggtaccactaagtcactgcttcatttttctctgctactgatggttctcccatatattgcagttaagtccatataagactaaggccatataagacagtgaaaaaatgccaacaggttttgggttgaattctctgctttgctacctactagctgtatgcattcaagcaagttccttggattgtctatgcttccatcatttttttttttcagttagaaaatagaaaatagaagtgtctacctccaagggttgttgtgggattcacgaagtagcttgggtagtgcctgataatcactgtctatgtgaatggtagctcctggcattgctcttttccccactatctccccacctctcagctgctggtccgctggctcctgcttctggaccctgtcagcacagtccggtggcgagtgcaggtgtttattggggaggaggcgg

SEQ ID NO: 66671 - DNA, 5809 bp, Homo sapiens
ggggaaggagacagaggaaccgagactggggtgagggagcggccgcgcgtggcccccggagaggcgcccatcacctgcgtggcgcccccccgcgccggagtgcggccctgctcccagcgccagtgcgccgcgcggctcgccggcctcgtaggattggctaccgcctcccattcatgtaacctgcgtgtgcgtgtgcgtgtgtgtgtgtgtctctctctcgctcgccctctctttctgtgtgtaagagagcgagggtgggggacggaggcaggcaggcgagcaggcagggaggggaagaagagaagggaagctattaaacacacacacacacacacacactcacacacgcgcgcgcacacacccgccccaaccccccagaagcctcgggattgcagctgtttcatgtggggcagcagtgctggcagggacgccggccgggagcggccgggagcgggagccggtcgtgcgcgcgcggctggaggctcgctggggctccgctccccgcgggagctattgttggtctcgctggagctgagcgcagagcccggacctgctccttcctgggcgccccgctacggctcgcggagcagaggagccgcgccgccgagagagagaggagccaccggcgcggcgccttgcctccctgccgccgtcctcgccgcttccccggcggtagcagcctgcagccacggtaaggcggcgtgatccgctctacggaaaagcgccttggggaccgcggcgacgcctcgccagctccatcgccctctgcactgctggcccgggcagggttcgggtagctcacgcggctgccgagggctccgggagatgtttgcttgctcccctggcccaggaggagggaggctagggcgcgggtggccgaagaggcaagctgttctggagcctggagccgccgcagcccccggagcccgccgcggactggagcctgggagcaagggttgggggagggcagggaggtgggaagcgggtgggagggaggcggcgcgccccaggttcgtctgcctctcccggatcccgttccccgccccggcccggtcgcctgcagcccctctgcagactagctcgccccaggcccccgtcgggcgctggaggagcccgcgaggcggcgccgggcttcagcggctgcagcctgccctgcggggcaagtgccggctgcagcagccccgcacgggcggtggttggagctcagatcctggagatgcgaccccagctcctcgccctctgcaacccgcggggcgcccgcctctcctcaccgggcgcccggccgcggtattgatgttcgtctaggagccaactgaggctgcagccgccagatggacgcttggagggctcccgggtgtgagtgtgactgtatgactactctcacccccagcttcgggaaatgtgctctgggttgaaatgtgatcaccgagctcctcagtcattttaattgccatttttaaatgcggtcgttacattggaggagcagactggaaggtagtggggcggcgtgtgtgtgtgtgtgtgtgtgtgtgtgtggacacacacacgcaaccgaggaatacacaaccaactacttgggtgaagggcggggggttcacctagtgagtccttcttggcgggggggtcgggcgagttagctgcccgctgcccgccccttctctgcctgcccccgcctaggcgaggttggaaagtactggaaattcagctgcgtggtccttaactttggaaattggctccgctttcagggcaaaatgttaaggcgatttatgcacccgcgtccatgtggatgagtgtattactgctcagttgggtgcagagccctcaacagtaccgcgccaagcccccacccgatctctaactccctcccaccccctaaccgtggagagagggtttatagaaatgcagttatctgtaaaccatcgacgcagtgaaaggggcgcagggaggcagccagagttttgcctgaacctgcatactggcttggtgtttgtagcacacgagatcaccccgctgctttgtagaaggcggtggtggggcaagctcgggattccaatcgccggggtggggggtggggggaagagggtgcccatgtactgagctctgaggccgagtaaggagagagatctgctgagcggcatcgcgggcaattacataagctgcctcggtgattacccggaactgtgatgcgagctcccggttctcgaaagacaagcctgaaagtttgcctgcttggggagtgtaagtaccggggcgcccccaccccggcctgggtagctaggatacgcctcgcaccacggcgcccacttgtgcgatgggcgtcgggtgctgatgctgctgtccccaaagaaccggttaccgaggcagggactaagtgggggcatccggaattgatcgcagaggaggagtcagtcagaactgaggtttcattgggtcttcagagctccaagtcttccctcggaggtgttggaaggccttccagggaacgccgttttcagaaactgacttggtgtcctggggagccccaaagcccctcttttccgcccttcctgggcgcccctccttgtctttcaagccctgtgcccttcacgtgtttagaaacctgcccgcggtgcctggtcccccttggagatgcccaggcagcccagccatccaggcccacgctggcgaggggttagagggagtagaacgctggctctgccgggctgccacccttacctacacctattcctggtttcctgcgctagcccggcgctgatggggacgggatggggctggggtcgggtatggcttccgttccttcgcctctcgcctctgcagacagcagtttgcttctgttgcgtttattctccccgtttcgccgcttccctccagcgccgcagcctgtgtatcacgttgatgggctttgatagagaaaccacagtaagagtatgcttttaaatcttgattttcgtctgtagggggataagccaccccagccctgacacagccgtggggaacgctgaagtctgggacacattggccctgaactcccttccccccagcccgcagtcaggagatggtgatgtgcatgggtggggagtgttttgtttttgccacattccagcgtcctgaaacctctcgtcccctcccactgaaatccccgatctgtctgaatctgttccttgctgtaaaataaatcctccctcccgcagacctgtggggcccttcggatttcctgccgctgccatgatccttaacaatgcgattgaaaagccagtgctcggctggaaaaaaatccccaggtgccagccggccgcgccttgaccttgctgaaggagcctttaacccggctgccagaggggctctggtccagccgtgggaatccaggaagaaggagggcgccccggaggcggctgggttagctccccgggcagggcgggaatcaggtcgcggcggggaccgcagagggggaggggacgggactccgcggcaacctgtttcccggcgagccgggcccgcgcatcccagctccctcgccccagcccctcgtggcccgcctcccccgccggcctccagttgtcttcgtggtacaggagtcggccgcgactccctcgcgctctccgccggagtccgcgggacgccgccaactttgggctcctcggtggccggagcagcggtgcgaaccagcggggcggccgggtgggcggggcctgggcgggaaactggagccgagaagaccgcgttccaggccaagttccagccgcaagcgccgcgcggcacagtgcagggtcccggccgcgcctttctcccgtccccggcccggccgcgttcctgcggactcacagcgcgctccgggcgctctgcagttgggctttcagcgggggagcccttctcgtcaaagttacgaggggtgttttcactggtggtgacagtgggaactagttttctgcgcgcctgtgtgtgtgtgtgtgcatgtgttggggagcagagagatttgcagcgaagtcacacatagcacaaaaaacaggtttcccctttccaggtgttataagggaatgctgaggaggaatccgttttctccggtgagggtgttgacgggaagcccttccacttagtggaactggacctgttggagctgattgcctggagtgaacgggtgtctcctttagcggcacctgtgtgccgtaggtccttggaaatgtttggggaactgaaagtcctcaagatattcagccaggacttagggcatagatgtttgtgtgcttttagggggctaattcggggaagcttttatttccagcatgtgtcttgaactgaggggagggcagggtgcggaaggcttgtggaattgccatcttctgtggtgggggaagggatcagggacggagagctttggttttctagaaagagttcttgggttcttcctctgctctcatcttgttttcatcaaggcctctgtttgggggtggaggtagagtggtgcggtaagcggatcagccaccctaatagaccggccttgaccagtgcggatgccaacgggcagaactagtgcttggtctgaacaagaaccatcaaaggatagttctatagtgagtggagtgacctggaatatgaggtagaaggctaggtgttagagtaatgggttcccacggactctcttccaatagaatctgattctatttggtatagtctcctcaatcttttgtggttttgtgggagtaaggtgataggatgtgactttaatctcttaactattgggttggaatcatggctctgtggccttaggcaaattgtctttggagcttcagtcctctcccctgtaaaatggcacaatattacttagtttgcaacactgtcagggtttttttttatgatccagtctataaactttattcagatttttccaattgtcccaataacgtccgttatagcaatagaaaatcctggcttatgagttcattcagcttttcatgtctctttaaactcttttaacctagaacatttcctcatctttttaaatctttcatattattgaacactgtcagttttaacatcgataaggcctctggcatactgtggtcccttcacagatgcttgttcctttctacctccttatccccttccaggaagcatcctgcatttgttgggtggagattgggcagagaaatcaacagccccgaaagaaccaccaaccttgcatccagcctatttaaaaccagcttcaaatgcgtgaaatgaaaatttcttttcttttcttaggaaagtcatttccagttttgttagaatttgtgcttcattgagtccctttttctgacagagttgcatcctcatgcagattgacatgttacataacccgatatttccaaatcaaaagttacaaataagggaaaagaaggtgattaggaattaaagattgttgggcaacacaagcaaaagactcaatttaagatgccagctcacactctaattgtgctagaggttgaaggaaaatgagacttgataagcaccagtggtgcaagtctccgcccggggttctcagcccctgtcctggtctaacaaacagctacacagccccagcccaaaccttttgtagttcctgtcccagtaacttctcccacatccattaatctaaaaagttaaacaaaagaagaataggatttaaatcacctccttgcagatttgattccaagagcctagcagggtaaatcaatgtcaattctagatctaaggggccgatttctacctgccttcttacatggtctatcagcttggcttttattgtaactgaaagctgaatcactccatctttgctttgcactggcagatgggc

SEQ ID NO: 66672 - DNA, 1036 bp, Homo sapiens
tggatgttactccacaccccccaccccaacacttttctagggacggtctctttcaagttgctactgcagcacaatcagagtaattaagagctgagatcttgagttccttcttcaggcatgcaagatgcccaaagaaaggccctccttcctcggacaacttccccaaaaccatggtaacagctactgagtcgtgataacaatcacttaaaaaatagcagtgattgcggtccaagagatttctgtccctcgaatgtttggatcgtgatggcaagcacatttccaagagaagggcatttttatgtgatgagagcggtagtttgactgagtggcaacttggaagggctttggggaagagactggaggaattcccactccagccctgctgcctgctggctaaaggacttagtgcgagccatttccccttacccggcttcagttttctcatctataaaatggatgataccgacttcaccagttttggtgaggattaaaagagagaacaatggaaagaaagcactgggtgtatatgagatgcttaatttatgttagtttccttctttaagacaacttccttcatgatcttctgctacagtgtgtctctctgatctaaagtagtcaatgaaggaggaaatgtgacaatgctaatttcacataaatgtgaaaggaggggtaggctattttgaaaactcttctgtgtggtgaggagactgtctagccagttgccatatgctgattataaaggcatcacagattataaacgtggggtgctggaatgccccttcaacatctcataactagggcatctcagaaaggcagggatgggttggggtgggtgggaagtttccacacaatctgtccaatctatttttaaaatctttatgataagtgtacagtgaccagtgacaaagcctctgagattaactaaaatgtcaagtctctgcctttgaatagcatttatcaactttgtgtcctcactgcagacatcaaatgctgggcatcagctgtgattggcagttagatttagtccttcaacaaa

SEQ ID NO: 66673 - DNA, 1022 bp, Homo sapiens
atgctaacttctgatacaaaagcgttccagttaaccacaggcaaggctgcctggaaaacagtaagtaccaaaggtgctgaatgagaaggaaaaaaaaggaaacagtatggactcctagtttgagcaacagctgacactaacatagcacttacttctgttgtgtgctttgtttctgttgactcatttagtccccatagttctaggaggcaggcactatcattatcctcattttgtggatggggaaactgaagcacagagaagttaagcgggttacctaggttcaccaagctagttagcagtggagctaagattccaacccagacattctggctctgaaatctgcactcatagccactacactagagccacactttgaggactccatatgtacctggcattgtgataagcaccctatatgcattatttccttgatcctcacaacaaccccacacttattatcttcatcctttttgttagggaaacagaaatacagtgcacattgagctaagaggtgcctaagctgaggtttgaacccaggtctttctgtgatttgtgaatctccagcctgtcttgttctgaacagaataagggagtcctttaccaaggggcatcttgcagtgtgtaaaatatacactagaaaagcttccttagctatctggaaatagtcactgccaaattatatcatcctgtttcccgacgccaggactttgcttgtactgttcccttggcctggagtgccatcttcctgctcagtcctccgaacaccaaggaagaactaaaataaggtcccatctctttagttttcccagactttcccctttcaagcagctgttccctatctgtgcttgcatggcactctatgaaaaaattatgcaccaatggtctgctacagtatagattctttcatttattcattctctccctcattcattcgttcatgcatttacttaacaagtatttattgagcatctcctaagtaccagcattgttttaggtcctagggatacagcagtgaagaaaac

SEQ ID NO: 66674 - DNA, 1051 bp, Homo sapiens
acctcagaaatacccagcctcaaaagcatattcaagcagttcttcatgactcccgtaaatcaagctctcatcattgagccatgggagcaaatgaatattctcttttaaagagtgaacaagcaaatgcttggaataaaaagaaagaattacattgaatcttttaaaagactcagttttccaacctgggctggctaagcaggtaagcctgacccagagtcctgggccaatgtttccatcttctgtgaaatttgttggccactgagatgggatattttggtagctgtgccttttgttttaccatagaggacttctgggaagagtaaatagcataacatcccccaaacatctagcacaatgcctgcccatacattatatgccagttcccttgccctttctgttcttcttctagcttgttctgaccttaatttattgatttattaattagctcttcctgtgggtacctccactctagacagtggacactttaaatgtggtgataatgtcttattcatccctgcatccctagtctttctacaatgtctggtacacatgggacactaaacaaatgttagttaatgaaagaatgaatgatctcatccacagtctgcaaagtgagtgtgggaccttttatgatctcctgttacacagtggaagaaatggaagctcagacagttcaggtgacttacttgtctggggatccaactgatgacccacaatctgtgcaaaccctcagttaaggctggcattcaaagccttcgcaatggtctgaatgttagtgtcccccccaacattcatatgttgaaatcctaccttctagggtgatagtattaagaggtctggcctttggtaggtaattagatcatgaggatggagcccacacaaataagattagtgcccttataaaagaggcctctgaaagctgccttgccttgtctatcatatgaggacacagtaagaaggtaccatttatgacccagtaaaccagctctcaatagacaacaatgtttctggtgcctccatcttggacttttcagcctccagagctgtgaga

SEQ ID NO: 66675 - DNA, 1088 bp, Homo sapiens
gaaggaaggaaggaaggaagggtgggaaggagggagggagggaagaaaggaaggaagggagggaagagggagggaggaaaggagggaggcaggaagggagaaagagaggaaagaaacaaaggaaaggagggagggagggaaggaaggaaggaagaaagagaaaggaatttttccttcccttttgaggggcatgtgcatacatttttatatctctaccaaactttacagatttataattaatgacaaagtacgcagaagttaaaaaaaaccactgtgtgatggaaaaaaatgacaaaaccaccactttcatcatgcctctgattcttcaagggctgccatgatggctcttttgccctttgtgtggcttcatgggagggaacagggcatgctgctcttttgttttattgctattccagtggtgtgcaggtacgcagaggtgcagggacagtggagtgcttttagttttacatttacactgaataaagcacattcatggcatccccatctcctttgaggaggagctcgagtctggggagggggggagctctgacctattagtattgagggagtatctactatgtgatgagtgccaaggccaaccctttatatcaactgcagtggggtcggtgtctgctcatgagcatccctggagtaattggcttcatggaatcttgctttggctggcacagtttcctctcacagtctggggaacctctgaactgtggagttgattgtcatgacttgcccagctccccggccagacacctcactcaatatcgcaatagcacagatgcattggaaaacacggcatcttgatcttgttgtttgggtcataacactttgccctcactgttttgatcacacttggatcttttctccatcagcagtgggggcaattaatctgtggtatgcagagcggttggaattatggattagaaatacaatgtggccaacctggacataagtatgatcctgaaatgtctgccaggtaggtagacagtaatgagtaatattgttaattcattagttatgaattaacaacaaaaaagcttagtttcgttatctagttcacaatgaatattactggt

SEQ ID NO: 66676 - DNA, 1081 bp, Homo sapiens
aggttcaaatcccagctctgcttattaaaagctgaatggcctttggtgagttactataactctgtgagccttggatttctcacctaaaaaatgaggataacagggcctaccatgtagggtttttaggatgattaagtaagataatgtatataagcgcctggtctagtaccaactgagttgtacgtatgtgtcaactgtctaacaaatggccaatgagcaatttgcaacccacctgaccccagggttggatccccttgtgatttgttgttaagcatgttctagtgcttttcaatcttcaacgtgcctacaaagcagctggagtccttgttaaaatgcaggtccagatccagtaggtctggggtggggcttgagagtcggcatttctttttttttttttttttttttttttttttttttttgaaacacaaacgctttatttaaaggagcatctcagttacgtgtggcggacaaaaaaaaggagcagattgtgacagaccattcccatcggccaagtggtcgaacccgacatccaagacccagcgagcagccaagctcagcgcaacctccgggcttctcgctctgactccaaaagggtgagcacgtcgccctcgcgcacggggccttttacattgcggatgatggatcggctcgtgtcgtccatgaattccacgcgcacctgcgtgcactgtccctgagaaccggtcctgcccaggaccttggtgaccctggccagcttgataggctgcacacggctggtgtccatgatggcggcgcggcggcggtctggcggagcgagattcagcatttctaacaagctcccaggtgctgctgccgccaccactcaggggacatactctgagtagtgacactctttaagtgtatctagaatgtctaacccagctggccaagaggccccaaccacctgttttctactgtttttgcttaattcagaagtttgcaatcactagttgtttaactctgtctgaatcaattctaaaaatacagattcctgaatccacctgaggagattctatttctgtaggtgaggggtgtgacttagaatctacattttaaaaaggca

SEQ ID NO: 66677 - DNA, 1112 bp, Homo sapiens
atgtagattctaagtcacacccctcacctacagaaatagaatctcctcaggtggattcaggaatctgtatttttagaattgattcagacagagttaaacaactagtgattgcaaacttctgaattaagcaaaaacagtagaaaacaggtggttggggcctcttggccagctgggttagacattctagatacacttaaagagtgtcactactcagagtatgtcccctgagtggtggcggcagcagcacctgggagcttgttagaaatgctgaatctcgctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaaaaaaaaaaaaaaaaaaaaaaaaaaaaaaaaaaagaaatgccgactctcaagccccaccccagacctactggatctggacctgcattttaacaaggactccagctgctttgtaggcacgttgaagattgaaaagcactagaacatgcttaacaacaaatcacaaggggatccaaccctggggtcaggtgggttgcaaattgctcattggccatttgttagacagttgacacatacgtacaactcagttggtactagaccaggcgcttatatacattatcttacttaatcatcctaaaaaccctacatggtaggccctgttatcctcattttttaggtgagaaatccaaggctcacagagttatagtaactcaccaaaggccattcagcttttaataagcagagctgggatttgaacctgaaattgtctctccaaagcacacgctcattccactgcagcata

SEQ ID NO: 66678 - DNA, 1033 bp, Homo sapiens
gagagagagagactaacagtttctactctgttgaaagatttcttcctccttgtttcttttcattttctctcaataatttttttttcttcaccctgccttgggaacattttctgcttttaaaaaactgtaccttgagcttgatcatttttatggcattttttttttttaagggcatatatagagttcattcttgggatggaaagctgaaatatttcctttactttccctggcatctgggagatacaggaaaatctttgtcttattttgggagccttcagttctcattgtaatgagttgtctatcaaagcatttggtaactattttgtttcagcatcacagaacaatcgatttgggtgggaatttaagggccaaaacaatactagtttttattctttgtcaactaagaaattaaataatgcagggtttatgggctcaatagaggatattcttacaatttattttacgattttagggtttttcccttgtgtagaatctttaaaatactttgccattttatttgatgttgattatttggatgagttacattattctgaagaaacaaactgcaaaaaatagaattttttggcaagcataattgtatcctattactgtatgcattttaggaatatagatagcagccttaattgaagtgagtataattataatatgctaaggtttaattttaacatgaaaaagaattggagtgtcagataagccttattatttaaagcatccctctaataaaactgcactttttactgacagggaaagagagacatggagacttgagtgctttctatttttatttttttcagctcccaagagcttagaaagaattgggtgctttttattttctgtttttgttactttaactgcctggagtcaatgggtagaactaaagtaacttaggagaaccttcataaggaatctgtagcgccaagaggttatccagaggagccagtgtctaagccagcatagtagagggtgaaggcccctgagatatccagttcaactgcatcattttgtaagggat

SEQ ID NO: 66679 - DNA, 1018 bp, Homo sapiens
cttgaagaggaggtaatatttgagttgagtgttgtaaaagatgagttggtgttcaaaggcattagtggagtgggagaggagttggaaaacagtgtttcagggtgagaaagggcaaaggggaaggagcctggtgtggtggggaatggttttcctaggctggagcaaaggcagcaaagaggaagctaagatggtagatggagaggactttgcataccatgcaaatgacttcggtttatttctatagcctaaggagtaattgaagaggtttattcatttatggaggggattaaacccaagagagaaattaaacactgcagttagtagcttaagaatattttatgatcagatcaaaatcatatttcttctttgtgttattaaactgtcattttatattcatattctgactctttccccatttatctttctaaaatgacaggtagtgtgccagtatttgaaaaatcccaatgtatctgattcactgctgctgcagaatattttccaagctctgaatgtatattacaattattcgggccaggtgaaatgcctgaatatttcagagacagcaactagcagtctgggaacactgggttggagctatcaggtaaatatgtataatttccccaagtggaacttacttttcactgacacagttgtgctgtaaaaaaaaatcagggtacacaagattttgtcacctaacctggatccagttttgggctctgttaccttatgctgtgatactatggacaagttttcttgttcattcatttgttcatttaataatcaccaaatagatattgagttcttacatgtgtcaggcactcctctaggtttcaaagatacaaagataaatggtacatgatcaaatctagtgtagtaaaaaagtaagtaagtagtatttcaatagatcttgataagtcctacaaaggaagcattttatagacatataaaagaaagggagtctaatttgtccttcatctgcacaatgagactaataataataaactttccttgcagagtt

SEQ ID NO: 66680 - DNA, 1035 bp, Homo sapiens
gaagcctttggagctttaggggtagaagaatgactctgattaataaatcttaagaaacactttggctattgtgttgagaatagactatgtaggggaaagggggtaaacagaaagaccaggttgttgcaaaatttcagattagagacgatggtggcttggattagtgtggtagtggtggaggctgagaagtgctcagattctggatatttttgaaggtgtagctgagaggtatagttgatgaattagatgtaggttgtgagataaagaattgaagatgactccaaggtttttggcctgagcagttagaaggtaggagttgtcatttaccaagaaggggaaagctgcagaaggagtaggtttggggaaggaaggagaagaggaacttggtttcagaaatggtattgtgtcaagaatttagaagaaaggtggggcaagtaatacaaatttgaagctgttagtatacagatggtatgtaaaaccatgagattggaagagagcaacaaaggagttagtgaagatgatcttttcttttaaagatgatcttctcaacactgcatatttagaagtcagggaaatggggaaccagttaaggagactgagaaggaacagttggaggaggaaaaccaggagggtgtgataccctgattacttaatgaaaaaagcatttccgtaagaaggtaaccagtagtgcctaaataaatgactgggaattggccacttgatttagcaatgtggaggttatggtgaccttgacagcaatttcctcagagggtgagtggaggcgaaagcctcattggagtggatgcaagagagaatgggagaagctgaattgagaccacgagtgtggtaatcttttggggaattttgctgtgaaggggagcagaaatatggtgtggtagatggagggggagagggttcccatttttaagatgggagaaataatcgaatgtatgctaagggaaatgagccgagagagtgagaaagtgacggaacaagaaagaaatagaattggtagtgggatatcttaggcaagag

SEQ ID NO: 66681 - DNA, 1042 bp, Homo sapiens
gtgattattttaatgtctgtctcttacactagactgtaagtctagtgactaggtagggaccttgtctgtttgtccatcaatcacactatccccacctagcatttagcagctgcacaactaataactgatgaataaataaatatgttcgcatattaaattgggatatggtttgctgtgatggagctgaaagaaatgtaatactatatcatcatccttcccaataaatgtgaaaagaaagataaactgcaaaagataccacatatgaaattgttcccaagtgtatcatcatatcttcctaattttagtatttacttattcctgatgtttcattcaattattcatcagacatgcatccactatactgcaagtcaagcagtagagagagacagagaaataaaacaaagtataaaaacacccccagagcctaggtaaataaataaataaatacaaaaataaactaggtggcaagtatgaaggaaatattatgaaaacaccaaaggaaattaattaacagtaactgtctgaaacgatcttattctattattgtccaacagacaataaatgggaagcctttttgccattttctggggttcaccaggtgaaatacaaatagtaaaaatactaatgatccctttcattacagttctcaaatttgctgtttttatagatttttagacttacttatttgatccactagagggcagtaaacccttaaataaagacaatgtaaccaaccttcctttaaaagtatagtaataagtgctggcacaattaatttagaaatgaacccaaaatttcctgcttatttaagtttttcatttattagtgagttgtctgcccaattagcaattttttttaggacagacagtatcttattttcacttagcccagtgtacgagtcatgttacaagtttattacatttcctaaagtttgaataacaattgtgtaaagaacatgatttgatgaatgcccatattgttgtggtacagtataaaattctgttttagagccctaaagaaaatagtctctgctcacaatatg

SEQ ID NO: 66682 - DNA, 1035 bp, Homo sapiens
ggtaacttcctgacgttgccatggcatttgtaaactgtcatggcgctggtggcagtgtagcagtgaggacaaccagaggtcactctcatcaccatcttagttttggtgggttttagcaggcttctttactgcaacctgttttatcagcgaggcctttataacctgtattttgtgccgacctcatatcttatcctatgacttagaatgccttaaccgtctgggaattcagcccagtatgtctcagcttcattttacccagcctctagacaagatggagttgcttttttattcaaacacatctgacagaatcataaataaagccaattaagatctttcacaaaattgttgtaattttgtcttttgacagttgcaatggcaaggaatttgaggttttagcacttacaatggcaattttctttgacccttctttctgcctttcctttgtatcctgtattacctaccctaccatgtcctttgagattgccatgtagcctaaggtgacaaccaaatctaggaatacataatcggctttggcagaaccttactaatgtatatataagagtcccaacaaggatagcaaaaaattaggattagcgttctcttttctgtgctcccttcagtaatacagattagtgatttatttaaattatttatctttcatctgtaaatttccatcttattaccttgagtggcaagattttatttttatagaaatgttattttgattgactatcagaattagtatcactttaacatctcccttccatagtcaccacatttctatgtttgtcatcatctttagagtactataccgaaaagattttattattttaaaaccagtgacctccactttgtcagtttgctgatgccagtgtcaaaaacagcatcacccatttcagaattgaaagtttttgccatgtgtttaaaaatgaaagtttcttaatacagctttatctcaaacagttacaaagacctttgttgtaaggcatgtattttatgttatatgttttatgttatgctaatccatttaaaaaa

SEQ ID NO: 66683 - DNA, 1123 bp, Homo sapiens
ggccacaatacttttaataatttagtgcatgaaacaaagtttgtgttaagtacttatgtgtggaattttgatttgtgccatcatggtggcactcaaaacatttcagattttgggttttggactttcagattcaagatgctcaaccggtagtttcctttgtattgatggcagacacaagttgtgtatcttcttgtaaaggtgtgaagaagctaaatgacatctttcctgaattactgggatagagcatttattaagaaacaggatacaagaattttcttaaactactctgttttaaatgtgattttcttcctattaatattttaaggagaaaaagaattaattttccaatacattgataccaccttcactttgaaagtgaaacaaatgacatctattagctttgcagtagaggttaagtggttttcctaagaaaagaatatgcactgcaatgaaagatttgccagtcatcccaatggctattttgttttgcagaccacggtgtgaacacatgaacagaagacgaaaatttcttctagcctcagtacttgctctccagaattcaagttttatatatccatcatgtcagaagtgcttctctaggataatcctggtctccaaaaggtaaaagtaaagtctgtaagtgtgagagaggaaatacaaatgcacactgtagatttcctatggctcaagggcaaggaccagatttaccaaacaaggacattagattctctcaggggttggttcttctgtaaatcccagaacagatttcactgctaatcctctattactagagaaaagttttaagttactgtcaagtcctttgctaaatacttgcctcattgaagaaaaataacttctcagagagtaagttccaatactgggtacaaaacttagcccatttctgggatatccctgggaataatataggagacttgtgtttattctttgtttatttttgcatgatcagtagaatagttgttaatataaataaataaattccttgagaccagggactatgttatagtaatttctatcctttagcaactagaaaggtgtttggcgtataattctttatcatggtgctcagatgcaagccaactatacctgagagcctaaggtcttc

SEQ ID NO: 66684 - DNA, 1025 bp, Homo sapiens
ctaggatggtctcaatctcctgacctggtgacccacccgcctcggcctcccaaagtgctgggattacaggtgtgaaccaccgcgcccggccttttcgtcctctctttcatgcacagttctcctttagttttccatcaatttggtatgtatttctatcaacttggggctgtttaatttaaatcagtaacgctaactattctgactagagaaatttaaaataagttgatctgaaagagtttaagaagaatttgagttgtgtaggagcatttatacacaaaatgttattttaaatttttactgttctggatttttcatcatatgaaaaacatttaatgaacatctccacacttttttccaccacttttctaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtaagaatacttaaaacatcctttttcctgactgcccttagaatttgaagatacaagtttataaggcaatatgcatttttgtagaaagataatcattcaaccccagattgtcaattcctttaaaagacaagcaagtaagaaagatgtttatttcctgaatacatattatgatgatattaaaacagtctccttttatttagggtaattaatctgtaattagaatattaagttataaatctctaatccaagttacagaaatagaggctaagaaagtaacatcatttcaaattgaagaattatccaaattgaggttagcattgaaacagttaggttcccctgaggcagaagaatctatttgagggaatatttgcatttcagaaattgaaattttattttttatctgtattgcaatttaatttgcatagtttgaccttttacgacattgtcctgagaatataagaataagcaattaaagcttttcttggccgggcgcg

SEQ ID NO: 66685 - DNA, 1107 bp, Homo sapiens
ttgcaccactgcactccagcctgggagacagagcgagactctgtctcaaaaaaaaaaaaaaaagcttttcttccccctcagtcttctgccctcctcccctaatcacatgcaagaaatctatgtccacatttttgtgcttgagacaataaagggaccacaaccaggcttatcagagaaaagggatgactttttcctgctttcaagtgaagagctagagatgccaccactattcccactgccacttttatttttccttataatcattgccgggcctgatggttaggcaggtaactactttactcccacttgatcaattggttttgttgatttttctgtgctatgagaaactagagagaacaaactgcctggctcttaaagtcactttttttcctctataaaaggttcatgctgcattttcaaattaattgtgtctctgactttatggcaagtaaaatttcaaagttcattgcttcacattttttactttttttccaatcaaggtacattcaggatcctaataaaattccagaaacactggacaatgatacaactcagaatctattaactaaagcagttgaaacttgctttgttggacaaagctttatttttggagtgacggtaattgagactagctttctttttaataatctgttaacatttccattgtaatgaattatgtgaattttctaaatagttgttaggagttctgtacatgtgaaggcctgtagaaacactttaaactatgtaaaaatagcctataggtggtctgttaaaacaccatgtgtgacaacttcctctttcgaaagtcaggggagcctacttcaaatgctttcagagcttaaaaatataaatttattatatatttagaaatgttagatatttgtttttggtatttagtatttattttgccctccggattttgttcaaattctatagtaaaacttccaccaattctctagctttttaattctgtcttctataaaagagaataatggaacactgaaggcaaagtatcttgagtattgataagaatactaaaactagattaagaaagatggtcttaaatataaaagtgactgtagaagaagttaaaaaaaaaagaagtta

SEQ ID NO: 66686 - DNA, 3070 bp, Homo sapiens
gcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcaggttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttacctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaacttagtcttttttaattgttcagctcagaccagaaaatgccagctatattataggccaatgagtgtgctgagtttgggatagaaagctacaagatcactgatcttaaaatatgttagtctgctggataagacagataaacaggtaacttcaatacagtgcagaagatgcaatgatatgggtttgtaatgggcatgacaaacatttacgttgctatgagagcatggaagaaaagcagctaactcatcagtgagctgagggtaagaagaaacgttttaagaaaaaaagctatttagaagttgtatgtgaaactgttgctattttatttaatacgtatacactgaatgcctactctacatgccaagggccgtgcttagtgctggaaactgaagataaaaatcaagctccttccctcaaactcatgagctattggaataat

SEQ ID NO: 66687 - DNA, 1052 bp, Homo sapiens
aaatattagttctttttcactttaattaagagcagactttgaatggtctgatgccaagtgtagatccttaagagacaaaacaaagaaactttcctggcttcaaagaaaagaactccatttctgaaagggtgccttaaaaggaattcatttgtctgatccatccttttgcctttgggcattactactgtcaccctccatttctttacaaacttcaggcaaggtggtctctctctctctcccaataggcaattccagggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcggttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtacagaaaagcaaaagataatctactttgttaagataatttgtcactagctggttgaataatgcacagtttttgtttaaggttacacatttatgcctggattaaataacaatagtaaaacttgacaagtcttttgaaaaacagctgctaaacatattgctttctggaatgtaatcattagcaacaaatattctcttattctatacaatt

SEQ ID NO: 66688 - DNA, 1549 bp, Homo sapiens
agcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaattagtgcattagaacaagatgctctgtggttcagaggggtggaatgaggcctactgaatgaggccgtagggacacagatttgggttccatgtcagggcgaccattctcaaaaagttggttcactatgggacagtctgcctcaggtaatagcctctgtcaagaggcaaagatgtggagaggatccaattggttggagattggagcaggtgacctattaacctaaattccatgttgtatgtagtactttgcctctcataacatgttcaattaaatatctgttaattcatagctaatgatttttttaatggggcctcgttcttctgccacaagtgcatcccacctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgttt

SEQ ID NO: 66689 - DNA, 1226 bp, Homo sapiens
gtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcagaaaaaaatctttttt

SEQ ID NO: 66690 - DNA, 1030 bp, Homo sapiens
acctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatactt

SEQ ID NO: 66691 - DNA, 1050 bp, Homo sapiens
ataaatacttgttgaattcaactttaaggagctcagggttcattgttatgtgatggagtctaacgtatatgggaattgaagagaggtgaatttgggccagattatgaagagccttgttacaccatcctacctaaggagttgaactgcatcctcaaggctgataattagttggcacttttgggaaaacacttcgtagactggctgcagggagcctggttagaagtccacagtaggctgggtgggggagagctgactagtccctgagccatgttggtgcagtggggacaggggttaagcaggggtgtattcaagcaggccttggtgacagataggttatggtatgctgtgtgagtgtgtgtgcatgtgtgtgcgtccatccctgctgagggaaaatttgtaccctatcttctgcataagaatttgccatgatacaggaatttgccaggataatgcactggaaaacacttaggaaactaaaagtgctctatagatgtaaaaacattgatagtaacagtatgtaagaaattctgcccaatggggttgattcaaggatgcaataatggcctggtgtgtgtaaagctctagacaagtagtcattcttttgcttgacacaggacctgtcacaaacttgggagagttctttttttgtcttcatctattcaggttgctgagcatgtggacacttgcttccctctcactttttctcctgcttccagtgaggagggaatctgaacagctgaaggaggggtccagcctagtgtgacagtcttccaacagggagaagacatctctgttcctggtaggcctctgatctccggggcagaggaccatcaggggaaagacttgagcccagttctgagccgtggccctgacctctggctccctggccaggctgctttgtgtgttcagcccggtgggaggagactgaataagctgataagaaggttcttccggtccagccaagcaggcgcagggaagcttctgcagaggaaagattagacacggtccctgatttagagaatacaagggggaaggcaatggggcaaagcc

SEQ ID NO: 66692 - DNA, 1053 bp, Homo sapiens
gatctagcagttttatttttaagaagctctttggaccaagtgcggtggctcacacctgtaataccaacactttgggaagctgaggcaggaggatcacttgaggccaggagttcaagaccagcctgggcaatatagtgagaccatgtctccagaaaaatttaaaaattagctgagtgtggtggcatgtgcttgtagtcccagctacaagggaggctgaggtgggacaatcacctgagcctggcaggtccaggcttcactggccatgtgatcgtgctactggattccagcctgagcaacagagcaaggccctgttccctatctctcccaccccttcacccccacccctaataagaagaagctctttggatgagtttaatgcagttcaactggtaccagcatttaggaaacactggtctattgtcaggcatacgtacagccgtgattttcacttgtgatcaaaccaagaagtacttaattaagtgcctatgatgcattgagctatgttctaggaatgtggatgatctaatgaaatacataaaatatatgatctgtcttcaagaacatcttgttggagagataaaactgacattcacaaagtcattaggaggaagggaattaatatttatagagcacttcctataggccaggtactgtgacagatgctttacaaaaatatctcatttaaatctcacaacagcccttgaggtagtgacatgggatctttggggcgttgcttttctggctggaaacctgtggccggtggcgcctttgccctagttttgctcaggccttctgggcttgttccgcccactcggcctggcaggctgtgctcagctcatgctaccgggctggatcccatgcctccaagggagactggagtcaggcgtggagcagagagaggtgtgtgagtgagcatggagtctggcctctgcacagccagacatcccagctgctgctgccgggcgggcagctcaaggtgcttgcatgggcgctagctctctgtgaggctgcagctggaccaggtgcgccgcaagcagctttcccagctggcac

SEQ ID NO: 66693 - DNA, 1033 bp, Homo sapiens
acatggcgaaaccctgtctctactaaaaatacaaaaattagccaggcatggtggtgggcgcctgtaatcccagctactagggaggctgaggcaggagaattgcttgaaccctggaggcagaggttgcagtgagccgagatcacaccactgtagtccagcctgggtgacagaataagactttgtctcaaaaaaaaaattcgtttgtctttttattttttaaaattgtaattaaatttcaaagtttttatttatttattttttaaaaaaacacttagtatcacctcaagtattttctttgttattcccaaatataaaatcctctcccctaccattatcttggtccaggccaccattatctctcccctattcttaagtcttgcccactccctacactcacttctccacacagcaaccagaattatctctttaaagcgcaagtcagattacactatttccctgattaaaactcttctttgatctcccattgccctttggacaaaattcaaagtgttttccatggtcaacgaggccctgtgtcatctcaaccgttcttttttccctgttgctcacccagccttggtccctgttctcctttatgttccttggacacgccaagccttttctggtagctaacccttgcacttcttgtatctattgcctgcgctcttttcctagctttgcaaatgcctggcttattctcatctttcaggtctcagctcacatctcactttctcagagaggcctgatcccatcagtcctctgaggcctcatctcatcattctgtaattatctatctgcattgtcatctatcctcatgagaacagtagttctttggtaactggacctaccttatgttaacagttgtatcctctgtaggtgtcacagtagctggctcatagaaagtgctcaataactatctgaggaataaatgaatggactcataattgactgaaagggtgttgaagttgtattaaaaatgaatttgaggccaggcctggtggctcatgcctgtaatcccagcactttgggaggc

SEQ ID NO: 66694 - DNA, 1032 bp, Homo sapiens
ctctaggaaaaaaaatatatatatgggcacagttgtggatgcctgtagtttcagttgcttgggaggctgggtgacaaagggagacctcgtctctataaaaaaaaatgtttacagaataaatgaataaatgagtaatccacccttctttaaacagttgacacttccggtgatgagtcaatgggagttcagtgtctgtgttagaccatgtctaggtctgctgacggctagtcctttcatgagataggctaatgtgcagatttcggctaggaaagcctattgccctgcagttgtttttacagtgcccctgaacatttttgagaattaatgtatacagtaaaattctctttgaacatcaaagattccttgaagacctgatagcctgcttggtttctctgaatctgatgaagtttgtagagataactggaagattctctctgtatgtggtacctgccttttgcacagccattttaatttaaagctatagtttcaaactatattctgaagcatcctggggtttgtgggctaaaaaatcaaggaattctgtaagaaaaatgaggggtggatttggctttgagcccaatgatgcctaaaacaaattctttgctgcatttatttttcagttctgatgaacgagaacaaccaactcattaaatgtagagtacctggcaatattttcttctctttcttatataagttgaatgtttttctcatctgacaatggtaatacatgggattgctctggactttttcgaagttcaaagatctttgaacagacttgtagtgatatttctaaaaaaaaaatcttcctacctggattactgttttttatatagagaatgggctttgtttgccattcactctaagtggaatttttctatatggcataataaagctgaagtccttagattttagttcagaaagccatatcctttgaacctaggcctctgggtttgttcacataagtcaatatacagcgttaataattgctgcatatcccttgagggaaaatccaaattaaataaagaaggcttt

SEQ ID NO: 66695 - DNA, 1077 bp, Homo sapiens
tatacgtaacagtatgacaatgaagtgtgtggttggagtgtattgtacttgtaaatggagatgctctactgagggatggtggaaaagcactctcagcccttttcagaactcattgttagcaatcaaaaagaggaagactgaaagaaaaaaaaaatcctttgaatcagcaagaggtttatacatagcagtgatttatgggtgaacagaggaggaacattaaaagaataattgctggctgtttattttgggaaagtatgtgtggtcaagagtcgaggcagggagctttattttttcttttaccttgctctatcttctattattgttaataggatcatatactcaagactttccttggcttgttgccctgacataaatatttgaattccttgttttggtatcgtgtatttttaacaacaatagagggaaaaagaaataatgttgtgagctaaattattctatatgccttattgtggatggaatttattctcttgggtccatggctattaagatgatcagtttagatgatctgtgtttctgatagctctttctagatagctttataatttgcccaaggggtttgttcaggggatggctacatgtatttttttatttggtggaacaaggtgagttttaatcctggttatctgagctccaggcctttccaggtgccaccgtcatccaaaaggccaataagagtagattgttcctctcattgtggcgtccaccctgggggcatttattaggcagtcactggatacacattgacccaacttgcccccttggtagaggatttagttcttagggttgctgctgcagaattcatttatgcagttagcaaattgtagttgagttcctgttgtgcctttggtattgtttcagacttggtactgctctgcgtgaagagccggaatcacacaattcaaggaaacccagcagaattagaatgttaaaatgtcagggtttaaagggactttagagataatctaatccagaggcagcaagctgtttctattaaaaggtccagaaagtaaatatattaggctttgggggccacatatgatctctgatgcatattgt

SEQ ID NO: 66696 - DNA, 1033 bp, Homo sapiens
caaacagatacaccttatgtcttagtccatttgtgctactatagcaaaatatctgagactgagtaatttgtgaacaacagaaatttatttcttacagttctggaggctggaaaagtccaagatccaggcgccagcaggcttggtgtctgctgaaggatactctctgcttttctactcttgtgccctttggatggtgccttgttcctgcatcctccaaaggatgtgtggtcacatggtagaaggcacagaaggacaactcaccccttcaagccctttttgtaaggtgctaatcccttcataagcatggagcgctcatggcctaattacctcctaaagttcccacctctaaatacagatgcattggggattaaatttcaacatgaattttgaaaaggacacaaaccattcaaatcatagcactcctttactacttggtagaaagtgatcagtgagacaggaaggactgagaagtaataagtgttagaaatggcttccaagacagggtagatctggctgcgcagcagaagatggataaaatttgtgtgtcaatgaggaaggtgagaagggcaactcaggggaagggaacagtgagcaaagttatagacatgctttaaagtccagtccttgcaaggaacagatctccaagttcatggttctataattgtgggtgtcccagccatctttgctgtggtcagagacctgaaagcaaagtctaaaccaggttcatgaagttgtggtgtgctggacaggtactcattcatgattcattcagtaaacatttacatagtgccaggtgctatgctaggcactttatgtatggtggcagatttaataaccctaacaactttggagctattaatagctccaattaacagatgcagatgcagatgcagaaattgtgactcagagagaggaagtaacctgtccaaaatcacatgacgggtaggtggcaggagcaagacttttcctatagagcccatgctgtgtccactaagccacacgcttcttcttgcaggtgagtgccaggtgatgt

SEQ ID NO: 66697 - DNA, 1393 bp, Homo sapiens
tgcagacacacccccaaataatgctttactaggtttctaggtatttcttaatctaatcaagttgacacctaaaattaaccaccacagtacccttgccttttttgccttttatgatattgaaatttttgaagattccaagtttgttgtctgtgaattggatttgtctgattgttttctcattattagattcaagttaaacacttgtggtgagaattttttgcaatgttctatccctccccgtgcatcataggtgacacctaatgtcagtttgtaacatcactggtgacatgaggtttgatcatttggttgaggtggtattgccagatctctccattgaaagggcacccttttccctttgtaattaataaaattatctgtgaggtgatatcttgagattgtttgagtatcctgttcctcaataactttaattcaaaagttttaacatctatcgataatcctggcctcggtcaattggtattcatgaagggatgattttctaattctctttccttctgtatttatcatatgatagattagctttcagcccccaacccctctgccgccctgctttttttttttatgagacagagttttgcttttgttgcccaggttggatggagtgcagtggcgcaatctcggctcacggcaacctccgcctcccgggttcaagcaattctcctgcctcagcctccggagtagctgggattacaggtgtgtaccaccatgtccggctaatgtttgtaaagatggggtttcacaatgttggtcaggctggtctcgaattcctgacttcaagcgatctgcccgtctcggcctcccaaagtgctgggattacaggcatgagccactgtgtctggccccaaccaccccgcccccgcttttttgttaatatcacttggacccatgatttctttttctcacaatgtgttataatctattactaatcttcttgccttttttccccctcaaccttatgctttctgatattcaaattgtcccaaatgtagctattgtgagcctatcttatttatttggccccaaaagcaatctgataaagtaggcgagattttgcacttacaagtgagtaaatgaaggctcagaaactacaggtaactttcccagggtcgtatacctagttagcagaggtggccagatgaaaacccagttttgattaactcaagctggtcctgctacttggttcctgctactccacactgcatcctgttggaccatgaacagaatgtcacttgctgaaaccaatttaaaaagaaagcacaatccttgcatcattgttgctaatagcaaataattggaaaccaccttaaatgtgtatcagtagggaactggttaaataaatgggtatgtatacacaagggaaaactatgaaactgca

SEQ ID NO: 66698 - DNA, 1027 bp, Homo sapiens
aatgcttctaccaagttattcctcccgcttagttctcaaggctttcttttgggaagctgtgagcggtggggaggtgggggggattggggagaggcttgcaggcacagctaaggggaaaagctctgtgccatttgggtcactgcaaagaacaactccagcaaccttcccccgccagaggacgggtgcctgccaattccctagtcgcaactcctctcaacctttttgaggcggagagagggggctgggctgggaaggatgttggggagtgctcttggaaaatctgaggaaggcagaggtgggggactgcagtcctgtcacacacggcccgagagctgaggtttgagtgggaaggggtgatgcgtggggagaaatggagacagtgaattaatgtggtcgcactactttagaacatttgaatgtcgcttggacgagcactagttattaatttttaagatgaacgtgcttaagttttgtagggctttattttatgtgtgtatgtctatgtggtttgtctcgccttttctgctgatttgaggtgacagtgtcctttaatggtgcactccgtgccagtcagaaacatttcacgtgtctggcgaaggttctttcaggctgctggaagcagcgtttttgttaaatgttttccgttctccgactgctggattcaagattgtttggaagtggagccgacagatttgtgcttgtgtgttttaaattacattgcataggctctttgccactgacaatggtaccataatgagctgctgtttcctgaggcatagtcactactcacaaataacggtttgaagagatcgattagggaagaggggttcattttaacacattagagaaagggaaagttagaagcgctgttaaccttcatttgccattactgaaaggtgcccatggaagagtgattttggttgttttgttattgttgtttttttaaacgaactgacatttaacaggagagaaagcattctgacttacatgatgctcttgtaagagttatagggataattagggcaat

SEQ ID NO: 66699 - DNA, 2835 bp, Homo sapiens
tcgggagcggtgctttctgggaactgtagtcttcttacgtcctgaagggatacccaggcaatccccgaaactacaatgcccaaaatgctccaagtgggacgcgcccagagtgaaggagcaaaggggactcggccgccatgttaggagtactgggacgattccgcggagccgggcagaggttttaggggtgcgcaggagtcaagtggtggttcagtggggacggtgaggtggaggacgatctggtcggatagccgcgggcacgaacctgggaaccagagggtggaggccatgctggggactgatgtagggcgggaccgactggaagcggcatccagaggcccagtgagcctcggtctcagctcctgaaggggttgcatggggccctacgcttccttctccattttttagctaagagattgagagagtcggtttacttttgggcttggagtatcatttagatctgttaacagtacagttgagagagttggtgtcttttgttgaggtgcgaggacccgaggcggcgaccctcgcctttattcggagaagcccacttccacccacagagttggggtagtcctccgaaatgcatttttgttttgccgtttgttttccaaccccctttcactctccccaaagcttcagattcactgatttttcatacaggaatgattaacaaaggcgtccgaagaaatcgttgttggaaggtgaccaaggtggaaagagacgttgctttggccctgcaagtaagaagagagagggaatagcctgaaggagtaacactaaatttaaaatgacacttttttaccaaccagcgaaagcagatgttcaaaggggatattggccaggtgcggtcgctcacgcctttaatcccagcactttgggggcagacgcggggagatagcgtgattctaggagttcaaccccagcctgggcaacatgcggagaccccgtaccgtctctacaaaaacattaaacaaaaaaattagctgggcatggtggtgtacccctgtagttgcagctacactagaggctgaggtgggaggatcgcttgagcccgggatgttgaggctgcagtgagcctcgatcctaccactgtgctccagcctgggcgacagcaagcccgtgtctcagaaaaggcgggaggggtgggatattattgatgataggccttctgacgtctggcaatagattccagagtaacatcggtcatggataaattttttttttaactaagtgactgaaaccaaagttaattgtcttttgagtgattttgcacagtatctcaaaatgaactgtactttttttcttgtgtcactgaaacagtgctgtgtgttctttttcagagtctgtcacactaagatgagaaatgtcctttcttcctgaaggtgtctgatgtgtaaaaatatgatatactttgtgctgtttcctcccttcccttttgcatattattctgaaacaacattaactagttactttgcgtcattgaaggtatgcacttcccctctatgttaggagtgaataaaattaaaaatagatccttataacaaagaaaggcagatagaatgattaaaaatgaccaaaacatgttagaaacagtctctcaggtgtatgcagatggtaattacaaaaatactttttcaaaaaatgatcttctgtgtcatgtttctgggaacaagtcaagatgaatgagtttgatttttaagcagaagtagtatgtgttggtgtcatccatgaatacaacaatgaaaaaggctcaaagttgttgttattcagaaacttctctaagtaatggtggtaagtacaggaaaaggagcaatgtctaccattttctttctaaccttcgatttaactattgtaatgttgtaagcttaacagagacttacacttaggcttaatttcaagctcttcaatcatttttcccggttggtgattcaggtgtattctcatgtcttatgtaaacttatcatgagtgttgttgatttataatatatttctttatgtaagccatagccttgtcagtttgagttatatggaagacaaattgtagggaaaaagagcaacagattactcagaaaccttctgtgtgagctgggcatagtagtgcatgccagtaggcttagctacttgggaggctgaggcaggaggatcacttgatcccattagtttgaggctgcagtgagctatgattgtgtcactgtactccaatctggacaacagtgagactatgtctgtttttaaaaaagaaagaaagcttgtgtttgagaagtgatacctctagaatacagtgatttctataatttgtcatgtgtttgggtagtttgaagtttttctatccttgtatctaatggacatctgaccataaagatgaaaaaatcctgcactcattataaattttatttataaaattgatatttgaggagttggggaggccagcttctgaaaaaataacagtgtcccatagaaacaccacaacttaggaaaatattgttaaagtggaattaggaatatctagaggaggtaaagcttttcatctctcaaaaaagaattagggccaggcacagtggctgacacctgtaatcctagcactttgggaggccgagatgggcacatcacttggggccaggagttcaagaccagcctggccaacatggcgaaaccccatctccaagaaatagaaaagttagccaggtgtggtggcgtgcgcctgtaataccagctactagggtggctgaggcaggagaatcgcttgaactggggaggtggaggtggcagtgagcagagattgagccactgtactccagcctgggcaacagcaagaccctatctcaaaaaaat

SEQ ID NO: 66700 - DNA, 1639 bp, Homo sapiens
ttatttatttgagatggggtctagccatgtggagtgcagtggctattcacaagcatgatcatagcaaatgacagccacagactcctgggttcgagcaatcctgcctcagccactcaagtaactaggactacaggcgtatactggggcttctagccatttatatggtattaagtgacagcttctatagttacttggtacttgtccctgtaaaactgcacagtgtgtattctcttggctcaattattagcatattctgccatttccttgtgaatgttttgtattttatataggaaaacttaagtttttaaatatcctgaaataactgaagaattttgtttttgcctttaagtggtaatgtataaagtatactattgcagagatacttacagagtgctttcattgcaattaaaatactgcagctaactagcatgttccatatgtgtaatctaaatgacatactggtcatgtgctatttctatggaatactaacagtagtatggtacatttatgcagtctcaacagtttaaagtgttattttggtgataaactgtttacatttatttgtttttatatttggcagtctaaatgcaagagtctccatttcagctctttactctgcatatctttaatgttgggcattatgcctctttcttgagtttcagtcctatgactgttccattttcagtattcatgtttatgtgtctttctaaaattgttttgcttctgtttcttgctgctcttgagacaatttatgggcaaattttgttacttttcaactggccgtgtatttccctgtgaagagttgctggattgtctcattttccagataaactgaattaatgtagtagtgaggagaagccagatttcagaggtttgacaagtgaacaaatgggaatgagaaaagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaactgacaccttaaggcaacaaagc

SEQ ID NO: 66701 - DNA, 1393 bp, Homo sapiens
ttaagcatgttcatcattctgagattaaataaaaattaaggaaatatatgaaaaatgcttaataagtacccaaaaggtaatatggtgtagcaacttagaatgtagacttcagagccagtcagctaggattaaaatgacacttcggccaatcactgttgactataagcaagttatttaactctgcctcagttttgtctgtgaagtagggataaaatcttcctcgctaggttgctataagaattaaatggatatattaagtactatcatgtgagatcactttatttgaggctaaaaaaattttttttaactaggattcactgaaaatacatctataaaaaagccactctttatcatgagaagtatgattttctgtaccttaggtgttataaagcaatatcccctcagttttaactttaccaaaatacctgtcttagtaaatgatactatatataccaaatattgcatatgtgtatataaacttcaactgtctacttctatcactgacagtttaaaaattgagataaagtaagtattatctgagtaatataaccattttctatttatttatttatttagaaacagtctcactctgtcacccaggctggagtgcaatggctcggtctcagctcactgcaacctccgcctcctggattcaggcagttcccccaccccaccctcccgagtagcagagacggggtttcactgtgttggccaggctggtctcgaactcctgaccttgtggtctgcccgcctcggccccccaaagtgctgggattacaggcgtgagccaccgcacccagccaatctaaccattttcaagatttgatctgcaaatacctgaagtaagtacaagcactgtggcccagttaaagagtgttagaactgtaagaagtccaaaggcatagctaagaattgctttagagtcagttgtgggttctgaattcttgctctgatagttagcaactatgtctactttggcaaatttaggttttgaagccttccatatctttaaaaggaggtaacatttaacagagcaccaaatacaaggttttctgtaatattagttccatagcatggtctgcaaacttccaacatcagaatctcctgggatatatgctaaatgcagattctggtttcccaaccagaatatactgcttaaaaatctgagggttagttctaggaatctgcatttttttctatacaatgtatgtattagggttccctggagggacagaactaataggagatacatatatatacacacatatatttattaagtttattgagaacttacacgatcacaaggtcccacagtaggctggctgcaagcttgaggaaaagagagagccagagtctgagtctgaaaactgaagaacttgggggtccagtgtct

SEQ ID NO: 66702 - DNA, 1048 bp, Homo sapiens
ctgggccgcaaggtggaaaaaacttgatctaaagtatttgatttttttagaaaagtttttgaatggccaggtgtggtggctcacacctgtaatcccagcactttgggaggccgaggcaggcggatcacgagatcaggagatcgagaccatcctggccaacatgctgaaactccatctctactaaaatacaaaaacttagccaggcatgctggcatgcgcttgtagtcccagctactcgggaggctgaggcaggggaatcacttgaacccaggaggcggaggttgcagtacagtgagccaagatcgcgccactgtactccagcctggtgacagagcaagactgtctcaaaaaaaaaaaaaaggaagcttttgaataagaagcaactctacagtactctattgtagacaaccaaagtattaatatttggggggcacaatttcaaccaactttaaattatttcattctggaagtatgtgttgagtaaatatgaagtataaggcccctagaggtacagatggctatggccgtctaaaccattttactcttaacttttagtgtcatggacctctttgtcaatctagtgaagtctatggaccgcttttttttaaaaaagcctttaaacatataaagtacagtacattgaattacaaaaggatccaagaatattgaaatagttaccaaaaaaatttgatatagaaatatatgtggtttattaatgaataagatctagcagtggccttactataatttcaacacagtagcgtggtgagcataaatatttcaacttatctgcaacaattgtaatgtgatatggaaataatcagtttaattgtgacagtcacatttactgctaactactgtgattgactggctatgtttacattttattagaagttattgaaagtagatgccaggcatggtggctcatgcctgtaatcctagcactttgggaggccaaagtgggcagatcatttgagcccacgagttcgagaccagcctggccaacatgatgaagccctgtctctactaaaaataaaaaaaaaaatta

SEQ ID NO: 66703 - DNA, 6295 bp, Homo sapiens
gtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggtttttatacaccccgcagcctcctattacttctaatactccctgattttagtgtcagcctcatcccaggtctcgcttccatcccaagggggacagtgttccttctctccaacccccccacccccctccaactcaggctcggtctttggcccaggcttcgagcatgggcctctgggggggagggagtggggaggataaagggtggagtcccacttccgctttccaactccctttttaggccaccgcattgtatatcccgacacacacacgctttgaatagagccctttggggtgggggagacttaaaggcagtttgtggtttggggaagtaagagttaacataagccattttaattccctgggaagtgggagagtgggtctcccattttccccaagcaccctttttggtaattgtgttctgtgggttggaaggaggtgaagggggacctgggagcgagctgttggtgggtgggaatagggatttggccccgagtggagcagccgcctgttaggagcccaacatggcgcctgaaaagcacatgatgcgaaagggaagagaggagaatccattccctgccagccaggcagctgctcactcccgtcagccccattttggggtgggggcggctagataaaacttttattctcctattggagggtctaatttgtcccaaaataggggcaagtggggttgagggtggggtttgggtggggggaggagatcttatccaacctgtaggtggagaactggcccagagggtaacaagtacttgcagtttctctgaaaagttcagtccctcctcctcttccttttctctttttctcccttccctgatagcgaaggagtgtttttctttaccccttgacagaagtggtcctctgccaccttatatttccctgtagtcctcctcttctgtggattcatatgggagcgatatgtcatttaagtaaagttactgttcaacttagttacaatgagttttaatagcgtcccagtgctacattttatttttcaagcttgtactcacggtttagttttttctagttgttagtgattgcaattatcaggatgagcctccttttagcagagtgaacccctttttaaaggccactttaacaacaaccaccaatatattgtttagagacggtttctgtctagtgtaaaacttgagtggtctgactctaataaatggttttgaaatgtgtgactggtattataaaatttgtgaataaaacatataaaatatgtatttgtcttttttatttacctttgtaaggtgtagaatctgtttccaagacttatttttatctacgtggttgtgtgttttaaacaaaagtctttaagtgacttgggttcattcttctttaggttccatccactcttttgggtaaacctcttcacaagatacacggtttcaggtggtcctttcataatttaaagaggacgaaaaggaagggttttttttctttttccttttaaggacctcaacaagtttatcatgctcagtctgacagctaagatacaagttttcgttcactttttcctgtgaaagtgtatgtaaaacagcttttttttttaagtgtgagatttaaaaaggaagcattcgtcatactcaacatgctttttattgataccacaaacatcttggacatgaaaacttagtttttgccttgttgaaggcttaacttgacattaaatgccttaaagcacttgtgtttttaaggcaaaaacattgatttttaaaatctaattacctcgtatcttgggatttaatattccacagcgcctaatatttagcagctcaggttgtcactcaaagaaccttgctggtttttaatggatccggaagaccttcgagaaccgaaaactaaatgctgaatatagtgaccacataaaacttgtgtttgtatatcgctacacagtgatgaaaatagatgagctctttgctggtaaaagacagctgaaattttgggggcacacgtttcctggttatttttgtaaagccaggttgaggaaaagatgtaaaagtcactttgggggatctatcttaatctgggttgggatcgagggtgaggggagggatttccgttatttggtagcaaactggcctggttttgtgttttggaggtgaatgtttgtgtccttattctttagcttctctgcgttactaaacttaaaggattcacacttaatttgactcctcccaagagagagcagtagcgaaaaataatacataaaaggacttcacttgtacaataaaaaattagcctacttaacagactttggtgtttaagagagcctgtttatcttcataagtacaataatgactaaaatggtgtaaaacatgacatggtaaggtaaagacacagcagtaaaccatttgacatgttcgtacttaatatagttgacccacatgcagtgggtgaacccttttattagacagtaccttaaaagaaatttttcatacaaagttattcaaagcttcccttagccaacttttggttgtaaaggtgttatcagaagcaagagcatttccacacacttgtatgggcaattggttttattatatatgatggcattgtgtactccagaactgtgagcctaccctagcttcaggcagctatgggtaagtgttacttagggttaagattcctatacacgtggggtgggtaaatggggataacctaagttttttttttttttttttttttgtcttttttttttattttaaatcatgggtgctcctttggagtcagagttaaaactattatggtgtgtcttaatgctcctcaacaagtctgtgaacctgctgatgctttctggaagcttgctgtgccttctaaaagccagtggtgggtaggcattgcagttgaactggggcaacatttctttactttggaaagggccacctgtatcagcatcaccacactggctctgcacaaatttataacccctggtttgtgcatgtcagaggaaaatatctcggcggagagtccaggctgtgaagaaaatcttcaggacaaatcctggtttccagagtcaagttcaacctgatttacatgattcagcggctgctccatccagtttttcttgtctgagtaacaaacttgcaacttcctgcatgttcgtgtgcaagtttcagtgttttgccattgacttcctaggtgaagtgtttttaatttttgttcatttggattatagagaagtaatcctaatgattttacaggtaacaaaagcttcatagacttgaacatataaaatatgcccatggaaattagtttctacaagaggtctaaaaactgctttgagtgtaggcacaccgttgtaagttaatatgggtcacaaaactgacacttggattatataaagtaattttccctcgcctcctccttatttttgtcacttaaaacacaggtctttttaccacatgaacttgaaatttcattgagtgttaaatgagtatattagggattacagctgttgttcatcctggtaattctgagcttttttgtgctcaactaaggattgtgagagttgagagcttgattgaacacttaagtttcataaagattacttcaaaaatatttagtatcaacaaaaatagaggtctgtattgtaggtttaaaaactcatttttaaataattatttggtggtaattcattatactaaacttctcagtttctttttattcaggctccttcctcagagaagcttcctgttatgtaccttatggattctattgtgaaaaacgttggaagagagtatctcactgcctttactaaaaatctagttgcaacatttatttgtgtgtttgaaaaggtacatatgcatttagaaacatttgcgtttttttttaaaaaatgtgttcctgattaaataaatatttgctttgtgttgggttttcttgggtggtgaaatgttttatacttttggacatttatcgttagtaccatttcaaagaaagaggctgaagttaatgttttatgttagatttttagaacagattctaggggtttacattatccatttaagaatagatggatttgcttttagaattgtgctttttaaaaaaattgagtgtgttcatttgaacatctgtttcatcacttacaaaccaggcaaaaagatctgaaatcgtcaagagtaattaaaatttcattgtttacatttctggtgttaggatgttgactgttctcttgggggggtaaaaagcataatccctcagtgtctcaacctgtgattggttcctgaaacttgtgtgtttttttgttttgttttctggaaatgtttacttttgttacattgttcaaggtatgttttaggtgaatgttgttggtatgtgtgaatggtggaccagttaattgctgttggttattctggaaatacttttgcccctaccttagtgttcagaaattaggcttatttttcatatctagagattgtaaatttcttccataacactgtaacatggtggtttggttaaagcagtattatgttgaggaggacaagggatttgctgaggtaattctctgcctgtcaggctatatctttcacattgaacaaaaaggcacttatgagatacttaggtttaaagattgtttcctaacgtcaatatttggtggtagttattatattttagtagatgaacacctgtgtgtcagttgtcagatttgtagaattggaattttttttggaagaactattcagtattagattttacatgtttattagaaaataagtagttgctatttgagaaatgtttttaagttcttagagaaaaacagtatatgcagaagaaatctggaaagctctatatcatatagcattaaaatgcttgttaatagaatattgtagacatttgctgaatactgctaaccagaggctgtagtcttaaggagaagcttaaccaacctcttggtttcggtttcagtatgttcaaattcacttgggtgtttggtagcatacctttactgaatctaactgggcattaacatgacagttgattaaaatgaccttgtaataaatacattattatctgaagacttatgaatatagttaaggctttactgtctatcctaatgttgaaaatctaactcagttttcccaagtcctaggtttcttgatggcgaattttctttctttttcttttttttgttttgagatggagttttgctcttgttgcccaagctggagtgcaatggcacaatctcggctcactgcaacctccgcctcccggattcaagtgattctcctgcctcagcctcccgagtagctgggattacaggcatgagccatcatgcctggctaattttgtatttttagtaaagacggggtttcaccattgttggtcaggctggtcttgaactccctcaggtgatccacctgcctcggcctctcaaagtgttggaattacaggcgtgagccaccgtgcctggcaatggcaaattttctaaacatttttacgccatcacaaacctgaacagaaaagttatttaaaactaaggcttatcagtggttaagattttgtgaatttcagttgttaaagtgctttccacaccacaatatcttgttcctatgtacccaaccatatagtattgctgagcattagttagtgagatagttttgctttaattttaactttgtactactatgtaaataatttaaaacatttaagccatcaggtaatcaatttttctagttgttttatattttttagttttatattttctagttgtcttacatttttttttcccagagaaagagtaactttaggaatattatactaagctctaagatgtggaaacgttttgtatatagaaaggctcacctggttggttgcttgcatgaaggctaggtgaaaatggttttaattactctgtttttgaaggagaaatgcacctttaataaattattactgttgtatatacttaccaatgggtagtacagttctgtatgtgaagtagagcagatttatataacttatatttaatatataaaatattctatagtaacttaacaagccatag

SEQ ID NO: 66704 - DNA, 2543 bp, Homo sapiens
aaattcacttgattaaaaactgcataggccaggcgcagtggatcatgcctgtaatcccaacacttgggaagtctgaggtgggaggatcgcttgagtttaggagtttgaggccagcctgggcaacatagtgaggccctaccaaaaaaaaaaaaattagccaggtggggtagtgcatccttgtgatcccagctactcgagaggctgagttggaaggatcacttgcggctgcagtgtgctatgattgcttcactgcactctagcttgagtgacagatcaagaccctgtctcaagaaaaccctccaaaaactacaaaactacactatttcctccaaacagttttctgttagattgctatcttataaaatagcatcttaattttgtttaatcattacattatgtggacttaatatttcagtcccaagatggtaggcatgttgtggcaaatatttttgcatagtctttaatgttttatgagcttatgctccatgaacagaaatgacaaaattaaggaggccaggaagattatatctttctacacataaatgactttatactaagttattttgcttagcatctgagcttattcgacagtgaggtgcaggaaggcagaattttataagttcattaatagcaccactttgggagaaactaaattttaggacttagaatttagctgaaatgactctgattcttgtgcagccggagtgtagtgatttagcaatttcttaggagcagtatggctcagaatcctgaacaataaggaagagaaacaattttttttcattctatttagagattatattataaagtctcaaaaaatactagtaagaaataatgggcaacttaaatcatggactttttcttttcattgtaatctcaatttatacattataagtgtacaatttaaatgtagtgttgagtaaatatatttattgaataaagcattatcttcttcagttgtttgcaatttcttgacaatctgcatgttctgcagtgttaacatgaacatttattttgtgttttaggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaaggtatgatgttaacattttaagtcaagtgtagtagtgtatatgtttcaaaagatagtgttaatttaaaaattggaaaatgtttattaggtgctattagtactttttttccatctaattcttacatctctgtgggttaaatactattattatttctattttacagataaggaaactgaagtttagaaaggttaactaatctacctaaggctgcagtccaggacatgcaagaatcagaattcatatctgtttttgctgatttcatattttgtgctcttaatcatttatttaattactttttgtggttacatatgcccattttaaccatatcctttgaaaagaatctttaaatatggtcctgagtattttttaaaaaaacatttcaatgtaacatactgcttttatg

SEQ ID NO: 66705 - DNA, 2451 bp, Homo sapiens
agcaaaagagaattacttcaaaaggtagttactatgattaatcccatgtagtcatcattatctatcgtctatttttttggtatttttttatatttaaaatattttatttccttttatcacccctatacagacgagtgaacgtttagcatctggtgaaattacacaggatgacttccttgttgttgtgcatcaaattcgacagctatttcagtatcaagaaggtaaacatagatgcaatgtacgggatagtcctacagaagaaaataaaggtggattaaaaaagaaacctctcttatctgatgctgaattaacctactatgaacataaagcaaaactgaaaaggacacaggttcagcattcatttccaagacttgatctcttagatcctgatatttttgactaccctttgactgatgccttgttgtctggaatagaatgtgagccatccaaaagtaaacatgcaagtaggaatagtggagcacagtttgacagaaaagaacaatttagtgaaagagcaagacgtctttctcctatatctgggagtcgtacttatgctgagaatctttcaccccatgagggccggagaagacatgacgagcaagtctctgctaaaggtagaaaaagttaaatcagattatgcctattgaatcacacagcagtgaagggaaaatgaacaagctaagtggggatggatttttgtgactgttcagattaccattttttttcccatttattttgttatgttttttccctttaaggaaagggaagggaagggagctaatatttctaaggccagttgtgtgtcaggtacttcattaggtattttttatatgtaatttgatttaatcctcacaacaatacaatgaagtgtatattctccctattttacagataggaaataaaagagaggttaaataacttgctctcaaaatgaaataattagtatgttgataggatggtaatttttttgttactcaggtgtgtctgactctagagggcatcctcttatctgctgctttacgctgtcggtctctcctgcccctctaatgtagtgagatagttatatatttggataaacattcatacgaaaatagaagattttaagataactttagtgaaaataatttttttcctttttaaaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtc

SEQ ID NO: 66706 - DNA, 1092 bp, Homo sapiens
gtgctgaaattctcctaggctgagttttacttcttttccaggtgcagacattttcttactatgacagatttattttatagtagtaagattgcatggaagaaaatacaaaataagaaagattttaaaagtacattaggaacattattgatagaaagtagtccttctgttcatctctaatggtacgaaaaaacagttggcttgcctagatttactctactgtatatccttgaaagaaatgatactcttattgacagatactctagaatggtacttacttagtcttgtttctacattacacagaatcggtggggtttttattatgtgtactcactaccaaaagtccacatgtatactgaacaaggattataaatggatatttattcacataccagcaatatgtagaagtcctgcctccctctggactgcaaatgctgtatttgtatgccagtatagttcttgctccatgactattctgttttttaacattccctttgacatcttttacaagaccttttacaagattactttgtaatgtggctataaccatgtgcaaagatgatggccaagcaagatgcttacctgcttggtaattcagaatgctaattagaacaggcttttgatatctgtggaaaagtggcaagggttaggagttctggcctcagttttgctcctaactagcccttgtgattgtgtatagatcatattgcattatgtcagttcttctatttgtaaaataagggaaagcaccagcaaggtaaagtgacttgtgtaaagtaacacagctagttaccttatatttgcatggtatcttacagtttcctttttggggggctactttgcctctctagtaggtaccttaaacttttcaaagaagttttaacccattctcagtaacttatacctctatgaaacagataagggaaggttttattgttcctgtttgtagaagacctagaagtgaagtgatgcagccaagttatctttctaaatctttatttataagccaggccttgtgacatctatgaatatttttatgtaattaggatgttaaaagttttacttgaaatatagaaagcatgttcttaaaattaa

SEQ ID NO: 66707 - DNA, 1005 bp, Homo sapiens
tgggaggccaaggcaggtggatcactggaggttaggagttcgagactagcctggccaacgtggtgaaaccccatctctactaaaaatacaaaaattagctgggtatggtggtgcacacctgtaatcccaggagaatcacttgaacctgggaggcagaggttgcagtgagtcaggatcacgccactgaactccagcctgggcagcagagtaagacttttgggggtggcctttggcccaagtacttgtacagcagacatattttaaaagacgatttaaaaataggcttcccaaagactatgttatgtatattttaccacattaaaaaaaaaaaaagacttcctaaatgttaaaacagtaaaagggataaagggaaagggaaagcactaatagtaacaatgtccactataacagtgttattaaagtcactgcctctttatcttaaagaaaattagattacatactgtttcaattcttcaactgtaaaattagtaagatctggaacatcttgatcttcattttgatcttcctcctcttcagggggaggctgagcagttacttcacttacttcttcaattaagaagagacatacaaatttcttaataccattctccatgtattctctacagaggaacactatagtattataagcaaatagagaaatccacctagtccattcagtgcttctgatctcaagtttactggccaaggaacctaatacaattttttattttgatatgtgatgttaactctgatttcttaaaagtcatctataataaaagtcatttatttcattaatattcaaaaccttttcaaaagttaatctaacatacaattactggtaaaaagcctgcacattaggtatgttagttaactgaaacacatgtccactataaggtagttcaatcttaggaaatctaaaagaatttcattataaaccgaaaatcaaaaataaaagctatacctaggaattcaattattgtaaggacctttatcataacttatatc

SEQ ID NO: 66708 - DNA, 1083 bp, Homo sapiens
taatgacaacatgaaactaataattaagatcttttccattaactctatagttacaactactaattcaaaaaagacaagcttcaagtatatttttttttttacaaaaaacagtcctagagcctgggaattttagagctagaacaagcctgtaggctacactctaatcttaattaaaaaaaaaaaaattcccttcaaaattcattttttaaaaaatgtgtttatattccaggggtcaaagccttggacttttagagctagaacaagcctgtatgctatactctaatcttaatttaaaaaaaaaaatactcttcaaaattcattttttaaaaaatctgtttatattctaggggtcaaattttattcaggaaatttcaatgttagattccagcagttattaaaattattaaattacttaattaaaattaaattttaataattattaaaattaatatacttttagaatgatataatttaagcctaaaagatactatggaggcacatgggttacttactgttaaactgtagtaccaacgtctatgagtgacttttcggctaacatccttttcagttctattttgccgataatgccagtccaaatgatctgcataaacatctgtctgtgatgttgtaaacctcattccacaagagtaacactgaataccagtgtacagtcgatttataacactgtcataacgtctattttgaaaaagaaataatctttagtgttgataatatggcttaatggcctttaaaagccaattacaaatatttcaattttccatactgtaacaatggtgaaaccaagagctggctgaaacagttaatacccaaagatcagtattattctctaacaatgtgattgaccctctttaccttaactttggtgacttttggaagatggagcctgtcttcttattgatagccctgacccagttatttatttccttttagctaaaaatgaaatgatcctgtgctagctaacaaggcaatagttagcttattttagtttggagtcaagtcaagatggacatggcagaacagttaaatttcacctctctagatctttggcattctgaataattc

SEQ ID NO: 66709 - DNA, 1078 bp, Homo sapiens
ataaggatgaaaatttggttttatccattttgggaccaaataatttttgtcttctttccaaagactatcttctggcttaaagttaaaaagaaatatcagaatagcccattagaaatgaatacgcacatatttactttttttctttttgcttcagatttatcatccatcatgttatgaagattatcaaaatgtaagttctttttggttactgtatttgttctcatttgcattaataaattttacttttcagttttttttttgcatcagagcaatattgttattttaaacttaatatattgaactgtttttgttttttgatatagcatttaggttgttcagtaaaaactggtgccagattgacagaattgacatatatgaatatcattttctgtgataacgcaaacaattaaaattttgaaatttatcattccttgcattttattcacttgaatcatggtatcttttactagtccactaggcccaaagaaatgtgaggaaaagtgaagataaggatcctgatggggatacgtttctagagctatgggtagcatttactgctatttttttttcttacatctctattcagccatctaaataggtatattctttttgttgttttgttctgagacaaagtttcgctcttgttgcccaggctggagtgcaatggcgcaatctcggctcactgcaacctccacctcctgggttcaagggattctcctgcccctgcttcccaagtagctgggattacaggcgtgcaccaccacacctggctaattttgtatttttagtagagacagggtttcaccacattggtcaggctggtcttgaactcctgacctcaagtgatccacccaccttggcctcccaaagtgctaggattataggcgtgagccaccgtgctcggccaaaataggtatactttttaatgatcacatacggaatctaaaaatgataccagtcgttgaccttaaaagttcaaatggtcggctgggcgtggtggctcatgcctgtaatcccagcacttttgggaggccgaggcgagtggatcacctgaggtcaggagttcgagaacagcctg

SEQ ID NO: 66710 - DNA, 1062 bp, Homo sapiens
ctctgcaggcagtaggaaatgcaaatactaaaatgtatttattaaccaaatgatagctgaaggccctgcctcagccagacaatttatatagatatgtctatatatacataaaaaaattcttcaccttctagatccaacagcagcttttttaaaaaagaaaaacatacctttctcattttatttaaactgactcgactgtgtcattttctgttttaatttcagagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttgaacttttttttttttttttttttttgagacagagctcactcttgtcgcacaggttgcagtgcagtggcatgaactcagctcactgcaacctccacctcctggattcaaacaattctcctgcctcagcctcacaatcaggtggaactataggcacccgccacca

SEQ ID NO: 66711 - DNA, 1394 bp, Homo sapiens
ttggaggcaatttggaaggtttatttaggttgtcagaagactagtgttgagggtgatggtttgtggggatttaaaaaatcctcagactatttgaaattagggtagtaacaagtcccaggatatatgtatgagtttaacatctatgtagagattaaaatgtagaagcatgtctaatcaactttttttggctgtataatgtcctataacttagctgttaactgcttaactcactgctgagtacatattgaacgtgcaatatatattttatttctggttgtctttatggcacattttgttgggaggcaggtgtttcatttgcatttggttgtatgtgtgttctcttgttcatacaagggtcttacaagactaaatgttatttaatgtgagaattttgaactttcatcagtactcatagggcctttcattttgtagacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgattt

SEQ ID NO: 66712 - DNA, 1141 bp, Homo sapiens
ccacactacccattgcaccaggtgttggcacccatactcagctgttcttaggtcaacagttagagtatttctgagtcttacatattttcttgacttcattttgttgactacctcgtccattgaaattttcttcctgcgcacacctgtaatcccagcactctgggaggccaagacgggcagatcacttaaggtcaggagttcgagaccagcctggccaacgtggtgaaaccccgcctctactcaaaatataaaaattagccaggcgtggtggcgggcacctgtaatcccagctacttgggaggctgagacaggagaatcacttgaacccaggaggcagaggttgcagtgagccgagattgtgccactgcactgagccgagattgtgctactgcactgatccagcctgagcaacatagcaagactgtctcaaaaaaagaaaaaaaaaaattttcccattgctggttttcccattttctttttgaccttcccacctaccagtctttgttcccccatccttgaccctcttctccatgtggataccgttgatacacttttaggtttgaatatcaccttccttttagaatgttccatacctttaagcatttgataaaagctatggtggtttccccagaaaaatgttcaacaggaagttttgcctacatttttggattcacagacctcagttcctatggcagtgttcatatacgtaagttcagctgttacgtgtttacaactcaaatccaatggctaccagttttcccactggacctctctggatttagcaatctctaaaattgtattcacttgattcttaaaaaaataaaaaagcttaaatgcagataggatgtcaccctgtttaaaatttctagtggctgctctggtcatcagtttaataaaaattccttagcatgaccaagaaggctcttcactacttaaaaataaaggctgggcacgtggctcatgcctgtaatcccagcactctgggaggccaaggcagtaggatcacttgagcccaggaattcgaaaccagcctggactacgtagtgagactccatttctactaaaaaaattaatggctcatcataatctattcaaaactactgagttttaaccataagaagtcaatttttgaaaacacaaa

SEQ ID NO: 66713 - DNA, 1046 bp, Homo sapiens
aatcgccgtagcggcggccgccttccgctggtactttctcggagtctctttccagcctcccgactccagccacttggctggagaggcagcagggccgtcgccttggaaacgagtacacttccgacgtgctgaggtcatttcccgttcctcacggcccacgctacttccggtttcctttccctcagctattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtga

SEQ ID NO: 66714 - DNA, 1006 bp, Homo sapiens
ccagagataactattaccctgattttggtgtttattattcctatctatgttttatgctgttattacatatgattatatcattattttgaatgacatacattatataaatgatatcacattatgtatattattctttagcttttttttgttcaacaatatgtttttgagttttatccatatggttacatatatgtactctagttcatttctttcagccatgtcgtttattctattcttagactggtatcagaatttatctgtttttgtattgttggatatttatttggtttcaatttttagctagtactaactgcttagtgagtattttaatgcaaatctgatccttgggctctgtccaaggctaactagcacttttctcatgattcaaggttatgtgtatggggggcttattttagctacatttccccagcctataagctacaataggtctgttgacaatgcattgtctttttacccctaccacacacacatgacttccttctgtgagtatggcagtcctgtgtgatatcttctttatttgtacttctttgcttcttgtaaccaaatctggttcagagactctccctctaccagtttgtgtgcctcacttaaatgttattataaacaaaggatttttacttgtgcctttctttggagcctgatggttctttgtgagctggtatccgtgggtaggtggttctctctgctgtttcctcccacattcctatttgttctgcactttggcaggttttttaatctgtttgtagtttgagttacagatgtctcctagtttcatctagttggagttttctgggtttttttgctctttgcttttgggtgattttggagagaagggggaagtactgattttactctgccatattctaatagacatcaggatataccatttatttcatctcttttctggtgccctttcagcttctcttactactctcactcagtctactttggttaactcactcctcctattgtgtaattgtagtat

SEQ ID NO: 66715 - DNA, 1017 bp, Homo sapiens
attttatcatactgctttttcctttagttttaatttcatttagtagataagctgtggtatttattattgaggcattctttttagttatttaataattgtttagaactatgacttctcctttttaaacttggtcttaaatcttaattatttcaagtcatttcttaaaaatttctaacaactatataatttttcttgttccttttaaaacattggtcaaattagtcacatatcctaatcaatattcaataaaaatcttgggtaaaattctcttattgcatttcattgtagatacattacttaacctccctccctcctgtttttaaacatttcccatatgataaaatgaaatgttgggctaaattcattctgtctcgtaaaattcagcattatccatgctcataaatatgattttttgactcttaatgacagaaaagatcaatatgttgccatttttgtctaaagtggggtttttaatagaggtctgagaaatcctgaagtttctgtgttagtgggttctggataggctgtaggagagagagaagccccagactctgcagaagccagcttgtaatttggcagatggctctgaggcagaggacaacagaaccagagttcttagagacttgccacctgggctgtaggactgtagtgatagggttgtttagtcccttgatattcctctgtgtcctctcttttgccagtaatggaggtgggttcgctttttaaagcaccaaattaacacccaaagttcctgctctttgatttattttgcaaggtcatgtatacatattcagcaccaaccatgtgcctgtactgtgagccagaatgagatctggaccttactgttaaagagttacacaattataccataaaagaactagagatttctttttaagataggatgcaattaatggccaaaaataattaggttcttaaaatacatgtcataggagtttgggaataggaattgagggatggaagaagttgctaaggatcaaattattgaggagctattca

SEQ ID NO: 66716 - DNA, 1094 bp, Homo sapiens
tccaactatatggtaagtcactttgaaaacccacacaactttgttgtaataatctttcattttatagaaaaatgtaattatgcaatggttatcaggaaagttaattcagtaataaatatgtaggctagggaatggtttacaaatattcaaccaatacccacaaaatcctgtatgatttacacaactgttcaagcaaacataagaaaactctggttcaatttctattaactatcaaaaggacaaaatgctcttctatctcaaaccaggtctgagtgacagcttttcaatataataaagacacacacctgcactcacacacacacaataaagacacagtatctcttctcattctaaaacacttcctcttttagtccgtatacacttcgaataatcttgtgtagtaaatttttgctgcaactgacaatgttcaaagtaaatctctcccggtttggtgttctaagaagccaacagccacagcaggatgagcattaatactacttccagaatctataaaatcccaatgctattgccaggcaagtaaacaccgaagctgtgaaaagaagaaactgtgttataggtcttgtatctgtaattattttgcagagataaagagaataatgttatctttaagtgaagagcaaaaaacaggaaatccaaccaattttctatcctatgttttttattccctagacaattaagtatgaaagacattcttaagggcagccttaatgcctaattcttcttaaaagcacctgtatattaaaatgtaaattatgtcatttagaaacctataacctgtatttaaaatcattaacgctagcattattgactactttaaataattataagctctaatttcagatctcatgataaatgaaatctttcttatattaaaaaattacgtagttaggctagtaaaatatacatatatctgtgagaagagaattttaattgccttttcagtacatttttaaataatttctcataattcttaataaaattttaataaaaactctttaaactcaatgaggtagaagaaaaggcagaaaaagcattaggtttttaaaatagttaatatactacctgtactttag

SEQ ID NO: 66717 - DNA, 1043 bp, Homo sapiens
ctacaaatttatctctcttcactaggaaatcctttttttcttccttgaatctctttcttttcattttgatatttcagatatgtaggtttcatatttacttaaccagtcaacattataccttgtagcatgttaacaaattcatttaaatttcatgaaaacaattctgtaaataaaaagatggctttctatagatcactaggttatttttattttgttttctaggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacatactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttgctcataagaattattttctgaatacagtggcttactagtttcttttgaagatttttttccttatcaattctgtattagaaatccatagattgtccaaattttggtaatctagggtttcagatttttttaatcataatatagacttggtttaatgctaattgcatgtgatctttcctgtacctagaaaatgaaaattgaattagaccaagttaagcaacaactaatggtaagtgaattttttttctagctgttaattt

SEQ ID NO: 66718 - DNA, 1048 bp, Homo sapiens
gttcttttagagagtaatttagtattatctgtcaattttttaattgtaaccattatttaaaagagtataacaatttaaatgttgaggagttactcttgctgtctattttgataaggatatacactttaaaaaaaataaaatacctatttgctgcctacaggatttgacaaaacacaagcagaaacaattgtatcagcgttaactgctttatcaaatgtcagcctggatactatctataaagagatggtcactcaagctcaacaggtaatacactgattactatcacttctgatactttcattagacaatcatttcataactatgtctctgtctacctactgaccttccaaacatgcttatatcttccttgttctctctaaagggaccacaaaaaaaaacattgaataaagtcagtatttagagagactgaatagttagaatagttgtaataatattgtggtaacagagaatggtattttgccaaatctttgatgggatgagatcattatattgtgttattcatgagtggtggtagattgtttgtgaaacaactttttccctctagaaagctcaccacagaagagctaatctttctatatattcagtatattttattgctgctatacatacacattggttaattttcacagacatagctggaaaggacttagttggctgggagggactttataaattccctggctaagacgccttaatttaactgaatataaaaatccttaaagtcaaacataagaatttaacatgtaagtggcacaatgctatgtacttttcgtatattatttaatctctaataaccttgaaaagtaagcagaattctatttggccactgaagacaggctcagagaaattgagtagtttgcaagagttttcactgtggtggtatggacaaaaagcaataattttatataaaggactgaataaactaaatgaacttaactggaataataattcatttctgtcagtcatgaaataatgtattatgtttaggaatctgttttcttcctatggttatatttttttcatttta

SEQ ID NO: 66719 - DNA, 1019 bp, Homo sapiens
tatctagatattttaagtgacttaagatacataagagagacagcatggagtgtaagatttggagtcagaagtacctgagtctgaatcctaattctgccattggctctgtaaaggtaactccttcaccttcccaaaagttgtttatgggcagggcaccttgtaataaattcatcagcaatatatagaaaaggtctttactgtgtctaggttaaaacttggggaatttattgaaataggacaagaagggttatttcagaaatgagaaatttttcttagggttcttatgttgataccagtaaatacgtccatgatttcaaatcaaattcattgattgaatcaacagtaaaacttggtggcccaactatgtgccaaagcactgttctacgtgctaaagatacagtagtgaaaaccacagtcaaagcatcatggaacttccattctgatccagagatacaaacagcaaataagataatttcatgttggagctgagaactacgtaggaaataaactgtggatatataagtgagtgggagtatggaaagctactttaaacagggattaagtgtaaaaaattttcatagctctttgaaagactattactgagcacagagaagaattgaattgtgcagtttctgcttttcagtaattagagctgaggtggtgataaccaaagcatttgatgtgtgttttattacaagtttatactgactcttaacatttctgaataccaaaggagggaaaagaaacatttattgaatgtttggtgtgtacagaagaacgtcagagacttttcagataaaagagaggctcagaggagtcaattaacttgggtgagatgacaaaactagaagagctggaactatattataaatggatggggaaaatgctttgtaagctaaagtagctttgtaagctatcagttactacaaaagaaaaaaattgtcttctctttcagagttcttcactaccacaaccaaggagggatatgataggcggccagtggatataactcctttaga

SEQ ID NO: 66720 - DNA, 1035 bp, Homo sapiens
ttccactctcctactgcatgaccaaactccctagcgagagtcctaatccccgtgatgcatcctgctaaaacgggactacaggctaggagtctcagctgtaatggatttgcctctatttgcaagttccccctcttttcattgaagtaggaagaagtgagaattattcaatcagtcacaacattataatgaatgctgtttattattgcacttgatttgttggtttgccctcaatcactcctaggacatgaatgctgcaagtgacctcttactctctgagtctggagtgacatcagatggtggggggtaaagagcgcactgtcagctcctgaaactgagtcaacatccaagggggtaaagctgaataccctctcctatctgaaggagggagggagggagggagggaatgaggggaggtagaaagaaagaacatcttcctagtatagagtctgaatgctgtaaagaaccatcagggtcatctcacttaactccctgatggtcagaaaaggaagctgatgttcagggagcaaaagtgactttcctaagctcacatagataaggaggacccaggccagggccaggaatcttgcctctgatttgcaccacatttatagcttaaatatttgcctattggccttcactagacattaagccccacaagcaaagtatcttgtgtgtgttagttcacagctatattccgtcccctagtgtgagcctccatactacgcgctcaagaaataactgatgaatgaagagatgaaccaaaacttacgcccaggtctcacatctctcagccctttcagcttgcactttctcccaagacatctctgatatgccttgtgagtttttaacagtatattaagggggagttgtatcaaaagtagaaactgttccaaataaatctattcaacctggatgttctttgtctataacccattacttacaacatacactaactcacaaggtatatttcttgattcagtcttgaaatgcgagcaaggttaatttgacttagacaaaagaaatggcttgagagat

SEQ ID NO: 66721 - DNA, 1032 bp, Homo sapiens
ttaattctattcagcatatttttcattttcaacattgtagtttttatgcctacaagtttaatttggattttttttatatgtttcatgtccctatttaacttgttgaccatctgcaatacaattataaaattgttttaatgttcttttctgccacttctaacatttgtgtcagttatgggttcgttttgattggttatttttttctcccattgtcagtcatattgttctacttctttttatgcctggtaatatttgactaaatgccagacatggtgaattttactttattggggccagatatttttgcatttctgtaaatattgaaatgtatcatggaactgatcttttcaagttttgctgatctcttcaagttttgcttttaaatttttttagatgggagggcagcatttaggggtaattatgttttactactgaagcaagatttttctgagcatactacttaatgccccatgaattgtgaagttttctagtttagctggtgagaaccagcactgatctcagccctttacaaatgccaagtattgatcctactcatccttcaaaatggttctttctctggcctcttgtagtttcttcatgcacacagatgccaatcagtactctgctaaatactcaagagtggttctcagcatatttccagaattttctttctgtgcagctctcttctgatactcttttctgcaaactctagccatgttgatctcttcagattctcagttccatgtcttcaactaagagagtctgccaggcttctcctgggttctttgtccctgcttgatggcctcgagactctgtcaaggcagaaagctggggcagttacctcatttgtttcccatctactaaagattcttgtccttcattgtctgatgtctggtgtctgggaaatcattattccctatagtttgtctgattttatttacttttggttgtttgaagcaggaggttaaagctgatttctctcattccatcttgcatagaaattgaagttccttcttacatctttaaagatga

SEQ ID NO: 66722 - DNA, 1045 bp, Homo sapiens
aagattcattgcatcaagctagtagaagggaaataacatgaaggcttgtgaggggattatttttatgggccaagcttgttcccttacattggccagaactcacattcccttggcccagactcagacacatggccacacctaatttttagggtagagtctagttttgtgctctaggagaagaggaaatgagtttggtgaaccagatagtctctgcctcaaagtagtaatgacaaaaattaacatttataaagcatttgttttgtgccaggcattggctaagccctttacctacattatttttaaattcatataccatattattcacttgtttaaaatatacaattcagtggattttattatattcacagagttgtgcaaccatcaccacaattttagagcattttcatcatctccaaaagaaaccccataactattagcaactcctcatttcctcccaccccctacctccagccctaggcaccatcaatctattttccatctatatggatttgcctattctaggcatttcatataaacagaatacctacattcttttatataaccctcaccatgatcctaaaagttaggcatgttattacttccattttacagataaatttacagagaatcaggctgtttaaatgatttgccaataattttaagccctgctcatcattgaactccattatgctgtactgcatcccagtcatatcatgccatgatttgttgcagggaaggggtgtttgtttgcttgttttctaatgactattatggcaacaaactgacttctttataacaggctcctttactgaaatgacaggcacttaggtgtcagaaagcttcaggtttgaaactcagatctaccacttaccggatacatgaaaaatatacactgcttagttcctcttgagtcccagcatctttatctataaaatgggaataacaaattcctgtttgcggggaggagtcaatgagattaacatatgtgaaagctcttctcacaactttacgtagtccatgtcctgccagtgtagttgtccttgct

SEQ ID NO: 66723 - DNA, 1038 bp, Homo sapiens
ttcacatgtgttaaatgaaatagttcaggacagtgtacccacctcatattcctctctcctttgttttcatatgatcccaggcaccctattttcatgttacactttcccctttgctttttctaaaatctttcacaaaatgctcacccacaacagtgagacacacctatccagtggagtgtggacagcaagagggtaaagctagaaagggttgggaaaggaaggcctaacctgatttttagaggctgtatctgccctttcaatgatcacctacttacgcttagaaccttctttctcctgccttcttttgctaagtaaccaggaaggtcaagtgccattgttactttccaaatgacttgggggggatcacttccagatacatcaagttctgcttctgaagacctgtatcaacagttaatttggagagtcaagtttcaccttctgaaacaagccaaggctgttatgtaacctgaagttctttgttgaaaacaaaacctgcagatgctgagaaagctaaattaaacttcttacttgccactcagccactaagcatcacaggcagcctagagaatattaccagcactggggtggtaaatgtaatgattgtaatgaaacaccatattcacctaccagccagtgtgattttaaaagtctgcccagattagttggccagaaagcaaactaaggtggagctgaactttacaatgtggttcttgcttaatgagcaatcttgttgaaaaaactaaagttatatatatatgtgtgtgtgtgtgtatatatattatatatatgtatatataatatatataactttatacatatatacgtatatgtatatatgtacatatatgtatatatacatacatatatacacacatatacacacacacacacacacagtgtaaaattttgtcctaggcatgctgatttcagacttttatttttttcctctcaaaaagattctttcttgatgaattgcataattaagaaggggacctgaatgaatattattggcagctaccccaggactcagacttgtct

SEQ ID NO: 66724 - DNA, 1050 bp, Homo sapiens
gaaagccaccacaagtggggagaaattgagaagcattcattctgtggttcagtggaatcaacatgttcctctgacattgtgcccgtttaccgcccttcatttattcttcaaacatacgtggatcacctattgtgtaccacatttgcttcagtgagcaaagctgaatccatgacttcacagagcttggagaatagtagggaggccacataattagaggtcatttctgcccagtgttcatatggttagtgttaatgcagggataagcataagttattatggaagcacagagaagagaatgatatacagtttgagggcaaccagagttttcccaaaatagatgataactgaggtgacatcatttattcttttgtttattcaacaaatatttattgaaggcatagcagtggctgttcaggtaactaatgacctggtgataaaatgaataagacccagtcctttttcttatgaagaggagacatacatgtaaaatgttataaatttgaaggtagttttgaatgtcttgaaggaaaataaggcaaaaaaaggggaaatgatggtttatacttgtgctctgaatagtatgacacatttatgtcagagcagtcagatcgtgcttccctaactcttaggtgatatgttgagctgagacttgaggaaaatgagagagcaggttaatcaaatatctaggcacaggaaccccaaagcacaaggactttgaggcagtagtagttcctgtgtcagagaaatagcaagaatgaccaagatgagagcaagtagtaggaaatgaggtcacagatggttttagggacagattatataagtacgatggtaattcaaatgaaaaatgttagaaattttgagcaaatgagcgacacaactggtttatgtttaaatgggtgtgtgtatgtgggtgagcttgtgtgtaggtgtgagcatgtgtgtatgcttctgtctctatgtcatttcccatggtgtttgaagcacaggaaagtgataagagaaaaatgtgaaaagctaaataatttgagaatgattcttgggacaatgcaa

SEQ ID NO: 66725 - DNA, 1052 bp, Homo sapiens
tggaattgtacaagaatagcggattcatgaaatggcaattcatgaagcttgagtggtaaagaagagtgagcagaagaggaagtgggagaagttggaagggacaatttaaagaaaattatttaagtgaaaggcaagataagatttctgctttttaaatactgtcctcctaggaacatacactgattaacatgaaatgattaaagactaaataaaaactaaagtcttgttgatgaccttgactgtacaaggattccagagaagggcaaccaagaagctttacctaggaggccaagcttgagaacctttgaaagatgagaaagtttaatcagtcaaagaaaggatggcattgtatacatagatttatagaacctcagtgaccataattcatttgagactgttttccatagtcattacagagaactggcttcataaaattctgaacacttctgagattattcttaaatttcttatgtatataatttataatatccagcgaggtcataaataccctaaagcctatgctgtttcttctctttcttttgtactgcccaaatgtgcctgtacagtgctgtaagctaacaatttcctgtaaatacttattaattgactatacaatcaccttgtaagatattaataataatagcatctacttacacagttactatgtctcagggagattcattcataacatttatgtggcttgaaacaaaagttcaaatggaagtcatataccaaatattttaaagttctaaaacaagctaacaaaccgtcactgaatatatttaatcctcctactttaacaaatattttttcaaaatgaacctgcaaatccacgttcaaagtgagactcaactgagtaaactttcagactcttcagaattcctagccataaggaggtagcataggaagaagggacctgagctcctgggctaagaaccacctcgttttcttccctccccatgaagatttcttctgcactgtctcatgactcacatttagagctattgacactttagcacatgcttttaagccacaccatttgaaacccattg

SEQ ID NO: 66726 - DNA, 1025 bp, Homo sapiens
tttactaaaaatggacgcctggcaaccaagtaagttcttccttttccttcttttttcttttcttttcttttcttttttttttttttttttaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaaatgggtttgggctttaaggtctcatctgtgcagttatatattcattcattcatcaaacatttattgagctatttctcaggcactgtgttaaatataataagaaacattctggctgggcatggtggctctcgcctgtaatcccagcactttgggaggccagggaaggcggatcacctgaggttaggagtttgagaccagcctggccaacatggcaaaacctcgtctctactaaaagtaca

SEQ ID NO: 66727 - DNA, 1103 bp, Homo sapiens
gtgaaaccctgtctctactaaaaatacaaaaaattagccgggcatggtggtgggcacctgtaatcccagctactcaggaggctgaggcaggagaattgcttgaacccagaaggtggaggttgcagtgagccaagattgcgccagggcactccaacctgggcaacaagagcaaaactccatctcaattaaagaaaaagtatttagaactgctgtgtatgtgcatcttggttggtagaccatactaatatgaattatttgccacattatataggctagcaagatttaatcttaactgcattacagcatacagctacttgatattaataagtatggactaaagctgcaaataacatatactaaggcaaactctttggtgatagtgaagtagaatttacctgtattcaaaggaaaacttacaaaacatctgtaagttaagtctgttgtaagaaaaggtatccctgccattggtaagccagcagctatgcgagcctttgtcacattcaagatgcgtcgaaaaagactgtttgctatgaggccacaaagagcagcatttaatccaacataaaccgatccattttcaagtagattcctgaaagggtgagaagaaagaacttttctttggcattattgtgtgtgtgagctttcccgatcttgacatgtgttataggactttgggaatacactaactggatacgacatctatcccttatagaaccaaaatcttaaaaattgctttatatataggtttttgctcttctcccagcagccagtgggtgcctctcctgagctcccataataattaatacttaacctctctagcacaacacattacaagacagtactatcttatataatcaccgatttacatgtcaggcttctacactagtctttaaacaaccagaagacaatggatacaaagatgtattcagcctgacacagaagatgttcaataatgtggagttaatgtgatttctttcactcttccctgaaacattagtgtcaggattgggagtattaacatttaagcaataccctatgctaggtactttataacaacccattgatgagaaataaactgatgttttcaggtagtggtagaactg

SEQ ID NO: 66728 - DNA, 1014 bp, Homo sapiens
tagatattttttcattttttattcctgtttgtcattatgaagtcttcagtgtaaaatactatatagttactttttcctcttgtgttacagaccaaactcaacgcctaaggtagaacaagcaaggtagaagagacaatactgggcaaactcgtgaagttaaacttgtttaagtgggtagcttttacttagattcagccttttgttgccctgtgtagccttttgttgtaggtcccagaattatacctcgtgataaattacaagtctatgtttatgcataacattagacataacattagacataaactgtttttaccattttatttttgtttacatatttgtttaaaatcagtgaatttctttgccaggttcagataactgaagggcctttataagtagtttatattgttcagacccaaggtatgctgaaaacatagtctggagcaaaataggaaataacatctttctaaagacaggcttagaagttctaatccagtaacttaagatgttccctttgtgtggtaacagagctgattgatacctgtaagaaaacattgagatagttcaatagaaaagattgttgcatcaaatggcaaacccatctgtgatacatattagtcctagaagtcttaagataaaactgaatattaaagtaaaggtcttcagtgtctattaatcctaaaaacttttgtttctttatccagtttgcttcaaggctatagcatagattgctgatgcaagagttcaacagagaatagccagaattattttagaatagaaggctaatataacagctagacattttctgatggaattttcctttagtgcaagtgttcaaactcatccaagataattgtttatatgatagaagtttcatgcataatactgtttgcagctttgtagttagtttagtattcagtacacaaattaaggttaatagcctaactacacaccaagtataactgtttgaaattcttgataagtagaatttcattataagaaaaaacaggtcttgct

SEQ ID NO: 66729 - DNA, 6271 bp, Homo sapiens
caaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctggtaaggatccatctcttcccgtaacgctcatgctctgctgctttgtctactttaatgggcaacatctcagtttgtgtgtgtgtgatttttttttttttttctgttttggaaggtgggagggaaatctaatttgggccctgtccaccctggaaacagacttgtgctggtcaagaatgtatttaagatgcctcttctggttgaaatagctattaatgtgtccccttattcagacttgcgtgtacctagctcttctgtccccagtgtggacatggccttggatgacatcggttccaactgtacactgaaacctgcttatagagagacagtttggagacagtgaaacaggtgaagttgaatggaagttccgagttgtacaaggtgcaaattggaattccgattttagggcaacttttcagaggttgacagttaagtatttggggcatgcacaaatgtgatagttattttgctggaggtgacaggtatctcttaaatatcaacaatgccttttagttttcagtatgagatatagaaacagtctataatggagtaacattttaatgtctcaccattagagaagttggaaattaacatacatatgagactcctgcgttttagttaattggagaataagaatggctaatgtttctttgaggaccagcagtgattaccctatcactgagattgaataaattgttgaacatctttatttttgttgtattaaaattttaggttaaatttatatatgtatgattagatattgaaggttgtgaaatgtgaatgaaaacgtgtaaagtgaggcttcacaaagaatcttattctctgtgtttcaaaagtatttgtcctattttaaaataattttttaaattgagtggttctggccacttaaatgacacgattggtactattttcctaaggtgggatttattcccttgaatctattaaccagttgtataaattgaattatggtgtccttcagtgtaagaggcattaagaaattctttgtgaaacatcactgcttgataaagtatatacgtatttagcatccttgtttttctttgtgctaaagtggatacagctgttggggcagaagagacgggaccagctgctggccacatttcctgctttattttaaaaggtagtataagaaatgaggaaaaagaggtaatatcagggcttctgctgttttttatttttaacatgttcataattaaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtgaaactgttgtcttactatttttagaaaattgtgttctggatgattagcacatggataaaggagatttctggaatataaaatggattgtttttgaaatttctaggtttggctctatttactgtaatggttgaaaacaatttagtatttgggtgacccttttgtttttcttctaaatgtgcctctggtaaaatacagaactagactaaagatgtagctttttaatatttgtcttttgatggtggcaggagttcatacattaattgaactaacacatcatattttgacctactatttctatcatattgacttactgtttctgcacttctttgaccagacttatcttaaaaagtccacttttgttaaaatgtagtcacacctctgatataatccaacaagaagtgttcaaaatattttaaatatttgtgcattttataatcactaaattaatctctctctcttctctttgaacagcttagcagtgtctgcaaaaacgaatcttttcctacaacctgttaactgactggactgttggtaacaaagtaattgtgagaaccatgtcggtcaaaaatttggcatctgctgaaaaaaatgaatgccattttcaagttcccaaattacttctatactgatttcactttccagaaatggagatatgaaaagattctctggaatccttgaaagacttaatagagatacatgagactaagttaatcttggaacaaaattatactttttttgtctttcatgggagtgatactcagttattgcatatctttacaaaattgtaacctttggagaattacagtatttcatcaagaaattagagtttttacataatcaagagcatattctatggaattaacatttagtggactagaattacataagcaggccatcagtgatcacaaggcatatgagtttgtatttatttcctggaacatgagagctaatttggagtacagacagacaccctgctgagtagaatataaaagttaatgtaaagttctgaactataaagagtagtccttttaaatagatgcattgatttgtatatctttgaaaaagttgattatgattaaatgtgtgggtagttaattacaatttagggtaacaaccaggatgtatggattcttgaggttttggcttcttgagctttctcttgagtacttgatactgttttctgaatattttgaggtttctaattaatggtatgctagtttctactgttttatataaaaatttatctagtgttgtataaggactttagtattgtggatgatgggagtggctttttgtggcatatggttgttttaattgaaatattttttcagtttattacaagtgtgaaaaaacactcaaaactctggattgttttatttcatttttgttggattatgttaatacattccttcacgtggtttagattgagtcattttatctcacttacttggaaatgtgcagctgatagaagagggattgggtaggagattggcttttacttcataataaatatacagttggttattgtattattcaaaacttattaaatccattcagtttcttaccattttaagtgtattcagtgcctgtgaagccaggcagcagagtattcccactggcttaaaacttaggcgctgatgctcctacagtacagctagttataattccagaaccaaaggcaccaacattatttggtgaccttaactactactttgatagaacagactgggtaattcactgataatgagtcattacctttttaatatgtgattatctagttcagcattttgaatgtgtagtttaaggtctgatttagtaaaattttaaagctaaataatctgatgactcttgaaagtttaattggtagtatgacatttatgtttttttcccccagactcacagccaatacaaagttttgagactcctaaatgttaatatttttgctgtttttctgagctgtttttttatttacttaccacctaagctgcggatcaaaaagggaattcttccattagaaatttgtagtgttgtgtggccagcacagtatttttcagatttgaatttcagtacctctgtgtagcctcagtactctcaacaccagtcactctttattgtcttaaaatattccatactttttgttgacccaaaattgttgaaaatattttgctcagttttcacaatgaactaattgaaaagtgtagttactgtgttgtaaacatttgtgtagttctgttaatacactgatttgaattttatttatctcaacttcctttagcgtctgcctccaaattttgtctttgctgtatacccactgagatcaattccctagacccctctggctcttagtgtactataatttgggctttataaaatatattgtcttaatttaaatagaatgtgagccctctttttttttttttaagccaaataactacacaaagtaaattataaaagatttaaatagtttgtctacagtgactagactgaaatataaaaattgattgagggtagtttacttcaggtgttagctacaaatgactaaatgtccttaaataatgcagatatctgccctctgaacaaaaattttggcaaagtaaatttgtagcaacagacttaacatgatttattgcttatgttgcccatttctgctaatggaaaagataatttaaaaatatgtggcagaggacagatattagaaatactttttggttacagaaaccattgtaaactcatcctcatttataaatggtattatgctagggagtaattggactaggaatgtttaaagataagtaaggaaacaatgtgtgctcaatcgtcaaagaacttagttatatcattgggctttgaattatctaagttgattacataattctatattcttaaggagtcttaactcggtacttgggttaacgccagaaattacttttaattcattgtttttttcactggg

SEQ ID NO: 66730 - DNA, 1041 bp, Homo sapiens
atttgaccttcatagcatcatccaacaatatactttgaaaatagtagggtgcaatgttataacaaaaaagtttttgcattctcattggaccatattgtgggacctaatcttacactgctaccagtataactctccctaatacacacacattgttgtttcatgggaagtgattaaagtaggtgtcattttagtgagacaccataaatgcattctgatgtgcatttacctatgggagcctaaggataggtgaaaattgttatgtgagcaaggatatctttagtacgtgtagctaaatttttagtttttccttcattagatttctttaaagatgaatttaatgtttaagcatgaatttgagtcttttgtgttatgtatataaatataatttgatttttacctattttcttaatatctcttataatgataaagtcaatgtatctgtttcattcacaatataatttaagattctttatcatatgatatttattagattagaaaatacttatatagagcttactctgtgctaggcactaagtgccttggaaaatattaacttattcattataagagctgtgattcaccataagaaaagcttagatgttgtgattcttagaaaaagaagaaaatagttttctaactaggtgtatgcaaattaggattataatttatcctcttcttgtaccttctacacatatactttctatatcagaaagaagacatatgctacattttcttattaaattcttagagtaccctaactttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaa

SEQ ID NO: 66731 - DNA, 1030 bp, Homo sapiens
atgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgtttaaaaaaaaaaggaacttgcccagatgagtaagttaacagatggaaatcaaatctttgctttcatggtccattgttctctctgtgacctgctgtcacgtaattcatatatatatactgacatggagattgtttccctctgcaatctagactgatggccactctttattcccagtggtctttagtgaagtacatttcctgcctcctcctctgatgcccagacatcgttgacaaggaagaatgcaaacatgcgacaagagcaactttaaccaaaatataatgagtgaagtaaatcagctattgattacataattacatcaggctgtaaactcatacatgctcatgtcattttactatccagttagcaagtagctattggctgagataagagagaagattgtaagcagaggacaactgtacctgtcccaaatcgttttcaaaattatttgcctttgatttaacatctatcagcattcagcattttttaaaaggtatccctttcttaacaagtgactatgagaatacatatttaggaagaggacttccttatgttagcctaggaatcttctgcttttccagaagccaacaaaatgtgacttatgagaaataggccttaatgggatgtttttcttgaactaaaaataatttcaaggttcttctcatttatcgtaactcacaaacacgcttccaaactc

SEQ ID NO: 66732 - DNA, 2258 bp, Homo sapiens
gggttgcttgagcccaggagttccaatgagctttttttttttttttttttttttgagatggagtttcgctcttgtctcccaggctggagtgcagtggcacgatctcagctcactgcaacctccacctcctgggttcaagccattctcctgcctcagcctcccgagtagctaggattacaggcgcccgccaccacgcctggctaatttttgtatttttagtagagacggggtttcaccatattggccaggccagtctcgaactctcgaactcacctcaggtgatctgcccacctcagcctcccagagtgctgggattacaggtgtgagctatggtgcccagccattgagctttgatcatgccactgcaatccagcctagacagcagagcaagactctgtctcaaaaacaacaacaaaaaacattatttggaagtccctatatgtgtcaaatattgagctttctggcacataagttgataatactgactttgttttataaacagggtttgtgataagcatgttgtgaacacttctgggccagttaaatggtaaagaccacaaagcatttttatttatgagaagacatcctacaatacaatgaattaacatacccactttttttttccagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgccttt

SEQ ID NO: 66733 - DNA, 1075 bp, Homo sapiens
ctcattttgtaatagtcctgtgcttatatgctttgcaatcttatacagagggagaaaaagaattaaaagcttgttccaaagtaaaaaggttcatgtcgggtttgaaacgctcatgtcagcttaatgaaggatacatgtatgaaaattaatatcttggttcttcaggaatagtctgtgtttgggagaataaagatacatactgaattcagttgtttacttgccttacagtatattcgaattaaacaataggacagattctaagaatcaagtaaatttgtccaaacaggaagcagaatcaaagatcttaagtattccccatattcagggcagtatgtggacagttacagtaggtgacctctaaggtccctttcacctcccacagtacgtgtgtcagctgcagttcgtcaagataaatgagcaggagacaacttcgtgtaaaaagtgtgtgaacctaggacaggacttttcgacccttatgaagaaagaaaggaaagaatattgcagctagatgtgttgggtccggactgaggtcagagttgcacagctttggacagatagcctggacacaggaaaccatgttctctcaattttaaacaaaaatgcaattatgtattccctcccctatccccccaccaccccccatacacacattaaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccagctgtcggcagcatccagcccctccagtcacagtcctcacagagcttcaggaaaggacccctttgcagagctctctttggaggatttcttataaatcactttaggtattgctacttgttttgggagatg

SEQ ID NO: 66734 - DNA, 1043 bp, Homo sapiens
tccttatatgaaaaattcccactgatcacatatcaatctgcctattttcccagaagcaatatgaaaaatacagagtattacctttgggcatttaattttaaaattaactgttggtttcttttttgttgtttttgtttgtttgttttgtttttttgagacagggtctcactctgtcccccaggctggagtgcaatggcacaatcatggctcactgtagcctcagcctccagggtagctaagactgcaggcacacaccacaatgcctgactaatttttaattttttgtagagcaagcatacatcagactggtcttgaactcctgatctcaagcagtcctcccaccttggcttccaaaagtgctgggattataggcatgagccactgctcctggccaagttttgttggtttcttgactggtattaggcctttttttaaaggaggactgccagttttgtttatggaggatatggttaaagatgcaaaatggctgctgttttttgttgtttgcagtggctaattttaaatcagtctgacatcagttaagtgtctgaaaggaaatgatggcttgttgtgagtgctttttatccttctaaatgggaacactgttgcctttagatattcgaataatttaagtcttagaaaaagccttttaaagtactttcttgtatttaagaactagtggctgcttttaggtttcgttttggttttgttttttggttttgttgttgttgttttattctcttggtgtgttaattgtgagtattggcagtacctcctctgtcagccgatctctccagctggatttctgtgaagaaggctttttgccttgtaagcaatgtgttgtgctcattcatccttgcctactgcagaataccatgagggacgtttccttggggattgggatgtagtaccataggtgaaaactagctcctagtacacacacctgaatcattcgaaatagaaatgttagaagtctcatctgctgatcactattgctaacaagacaacttatagaataagaccttgcttattactaggttttt

SEQ ID NO: 66735 - DNA, 1072 bp, Homo sapiens
acagtattctgtttgtgcattatttttacactaggtattgtcacttactaggttaattttataccctgtagtggtaatttttaaagaaacatatttggttgagattgtattttcagttactcaagaaagagttaacctctggtttgtagtttaagctctttcttgattcttatatgaaataaaatggaagaactagagcaggcttattcagagaatcaactgtcttcacttgtgatcacttgcataatggcaaaagtacttgatttgttatacaaatttactttgaaatttcttagcagcgaagacagagtcttaagttttcttgatgtctaaacctgataaatttggaaactcttagtcttaatcattttatctgttgtaatacaataaagtttacattttgcaactcattgaatagaaaaagttaggctttgttactacattttaaaaatgagcatgttaaagactttacttaccaaaagaaaaaaaaatactctcgaaagtttgtagctgttagtcttacttatattcagaggaagttaccctttgagtcaagcaaaggtactaggacctgtcatccctgttgtcattgttatttacttagtcacaataaggaagataggagtcagtatcttttgatatttttctcttttttagcctccacaaatgggaagtgttcctgtaatgacgcaaccaaccttaatatacagccagcctgtcatgagacctccaaacccctttggccctgtatcaggagcacaggtattacacactacatgtaactgtggtaatgtgtttgatttggaaggaatatgatactataaaacccttttgtacaacttgagaaacaagttactagcactttctaccttcattatggatattgcttgcttcatatctttcttatataagagctttaggaatattgattatttggagggaaaggataagtagatagcaaatactaaagacagaaaattcttggtaacttatagttggtagatccaaaggatgatttttctgagattaaggagcctacttgctcttcgtgattctggtgtagtatcctttg

SEQ ID NO: 66736 - DNA, 1045 bp, Homo sapiens
aaatgctctctgtgtattttctgttgtgtaagtacttgttctaatccagtgttattgcattatgtaattgttctccctgggaaaaacagaatggcatgcattttccacaatacgtaagtgaccaaaaacgagcctttttgcaataaattggcatgctattaaccactgctgtagcagaatctcataacctttcagctattacttgttttcacattcagattttcaatgtgccagaaattcttcctagcatctactgatttcatgggtgtgttgcagaattgattctgatggtggcatgggaaataccgattttttttcttgcttaatattccgccatttgctgccagatggctgggtgtctgtgtgtgtatctgtgctgccactatgcacttgatgacttctgaatgaagggaaatgttgattgtggtaatgtttaaaataacaactgcatgaaatcttacaggcttctgctcttcttggcagtttgtctactgctcttgcagatcttggttttaagtagggagagaccaataagtcctacacgctcacccgaatactaaacttataactattcactttagtgttatttttttaaagttatatttcatttaatttctccatgcatatgttcaaattgccatataatttcagttattttatgttttagcagtgttattggtctttcacctttattcaatttcagttttcattatgagaaacacacacaggaaatgttgttaagacagcaactatatctaaaatgattctgttctcaaattgtatgtttacagataatcaaagtagtaggaagaggggaacttaaacatcatagtgatagatggttcttttaaacatgaaagcataaactgacctaattgattgttcctcttaaataatttttggaataaattagaaagctaacgtacatactctatataagaactatggctcatagaaatagtcatactcaatagtagtttgaaacctttggagttttttgaaaagagtgagtaagatccttagaaactaactttttggaagatca

SEQ ID NO: 66737 - DNA, 1111 bp, Homo sapiens
gttcattgccatcactaattttattattttgtattttttttttttttgtgacggagtcttgctcttttgcccaggctacattgcagtggcgcgacctcagctcactgcaacctctgcctcccaggttcaagtgattctcctgccttagcctcccgagtagctgggattacaggtgcccaccaccaggtccagctaatttttaaatttttagtagagactgggttttattatgttggccaggctggtcttgaactgctgacctcaagtgatccacccgcctcagcctcccagagtgctgggattacaggcctgagctaccacgcccagcctatcatcactgattttaaaactttgcatttaagtagtttagatttttatacacacaaatacacaatcttaaacatgtaaatgttgctgtcttgagggaattggagcatgtatcaccccacttctaaagattttttttttccctaagtgcaaagcagttgaaaagcagatttaagttgaaatccatctctttgactctgaatccagtcttcttcccactataacacacctcactgactagggtatggtaggagtttagagtagtggattttatggactcgtgtgaattatgacattgatgatgtatgaggaatgatataaataccagtgctgctattaaaatataatgaatattttcttatattaagttagtattaatctatatgaagtattaggagttcatagatagcacttaagactgactactaaaatgtagtaggtatttagtcatgtagaatttgtatttaagttgataaggtaacagtctttatcttgctgtgttatatatggtaatgtgtatcatctcctaaggattttgcttaaatatttatatgtattttatggagttttctttttaatggctaatgtttggggctgataatgtgattcactacttaagataaactgctgcttttgacatttctttacatttctaacctttttattaatccttaaacactgtcaaggtttttcagtgttttttaaatttaacacaaattcattggaattttattaaaatatatattatactacaaattcttttaattagtgcttgctttttttc

SEQ ID NO: 66738 - DNA, 1050 bp, Homo sapiens
tctccatgtgttatttggagggttgatttggctttcctctcaaaaatatgtgtagagatatcaagtctgcatcttttttttttttttttgacacggagtctcgctctgttgctcaggctggagtacagtggcgcaatctcggcccactgcaagctccgcctcccggattcacgccgttcttctgcctcagcctctcaagtagctggactacaggcacccaccaccatgcctggctaatttttttgtatttttagtagagacggggtttcgccgtgttagccaggttggtctcaatctcctgacctcaagtgatttgtccaccttggcctcccaaagtgctgggattacaggcatgagccaccacgcccagcctcaagtctctatcttactctgttctatataagtatatagctaaggaaactttataattagagacatttaatattctcacttatgtttatttaaagtgatgtaaattggagtcaaccaggtgaaaagaagttaactgggggatctaactggcaaccaaaggttgcaccaacaaccgcttggaatgctgcaacaatggtgagttgaaaaagctcctgatagactaacagttgaataatttagttaaatatgtaacatgaaaatgtttttaaagtgatagacataaatagaaggattgttactgagtttagaagtataagtaattgtatttctttcaaaggaagctggttgcctatatttaccagatacattttagtggctaacaagtatttaagggttactttgtgccagacatattccagtaaataataatgttttattttttataatcctcctattaatgtgttagtcactattattatccctattttacagatgaggaagtggaggctcagagttattaagcaatgtgctcaggattacagagatcttaaatgatgagttgaatttttataacctaggcagcctaactatagaacatatgtccttaatcactactctatattactgacctcaaattttttatttatttttctaaaatacaaaatcttgtgatttcat

SEQ ID NO: 66739 - DNA, 2463 bp, Homo sapiens
ttcagcctagacaacacagcgagttcgactctgtctcaaaaaaaaaaaaaacaaaacacacccagaactttcagcctaactggccaactgtaagcttaatgcaactcctttcttatgcaagaagaagctagagtggccatcagtatatatattagctaaaatatatatatatttttagtactaaaaaccaatgtccttgttggctcatgcctgtaatcccagcactttgggaggccaaggcaggaggattgcttgagtccaggcaggtgttcaagactagcgttggtatcatagcatctctacaaaaattaaattagccaggcatggtggcacatgcctgtagtctcagctactcggaaggctgaggtgggagcatcacttgagcccaggagtttgaggctacagtgagctctgattgtaccactgcagtctgcctgggcaacagagcaagacccactctcaaaaagaagaaaacaaaaaaacccaccgtgcccccctgcaacttcttgtaactatttaactattttctagtttctatttctgaattactgttttctgattcttttttcccagtgttccatttattgggggtggaatgatgggaaagatttcgagtttgaatagcataatcagcatattttgatagatttgtaggacttttttttttttagtgtgaattgatgttccataagaatactatatagaaaagttcttactacagaaaaagttgtatttaaaagatgtgttgtttttaaaatcataacctgagtattttcttgatttttttttttcctttttcagacagttgtatttgagcttgtagaatgcttgccttgaattttttgactttaaaggaagtgtgcctatatcatagtaaatgagctggtccttaggccactgttgccttcttaatgttcaatcatacaatcttaagagtaaaatacagtacctagtactatgaagataccacagtatatttcagtgaaggtcaagaactaaactagaacagacaagaagattccactgttgagaattacaggagtatcctcttattttaattatgttacaaagaaaaaattatactatttttgctgctttttattttttctttccccatttagttagctctttaaatcttgagaagtaaggaaaaatagatttcagtcattagaatgataattatcttgaataaggtatcagtataataattatctgactctagaataactttagataaaggatttgatataatacatatttatatcattctagtaggcaaacaacacttttgttgttcctttagcaattcatttaaagactaaagctcttagatagacattcaaaggtgttcgcagtctattaagtggacattctttcatctctgttcttaattatctaaaattctttcccccatccttagatttttttcttcatctttattttttattttgaatctatgcaggaattatctgcacatgccaaaaacagcttcttagccctaatttgtcattaccctctttttttctttgaaagtttactcacaacacacataccaattgtcaatatcaattattcaagtaaacacagctataccaccacgaccagcacactcacctaggacagggaagattggtgcaagatgggtggctctttatagaaacatcttggttattattccattttttaactacctgactgttggctttgtggtgttaacaaataaaaggattttttctaaggattcacttaaaaatatattaaatgcaattcttctatcttgatgattaggtattttttgtttttgataatttagatatttaagattaataaacaataatatagttactacttttcactttgcatcttttgactaattacaatactaatttatttacttcctttcttcattttgctataatacatttggactgcacagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggtaaagtaccatttaacctttttttccaatcaatgtttatactgcctaactatattttacgtgtccattaattattttaaaagcactgcaatagttactttagattttaatatcaaattctaaaactaaccagccataatgtagtgaggtttttaaattgacactggtatcccaattttatttatacagacttttaggaaaatttctcttgatgttgaactttttttttttttttttttttggtgtttggttctctgtcgtgttatagtgcaatactctagctgtctagtatcacatgcagcttcctgttttagtttggagaactggttgaaaagtaacatcacttaaacttacatgtttatatgtgattatatttt

SEQ ID NO: 66740 - DNA, 1050 bp, Homo sapiens
gatgttgttataggtgaaacatacctagacttacgttacgtgttactggtatgcatgttttggtgttcctgtggcactgccgaaacgtaggctgtaaattagcagagggttttccctgtgataaactcaacactttttcccatcagggattttgtgggattatgtgggctctttcccaattgcactggtttcctctcttggggcttggaagaggcaatgtgccccactctgttgtgaaccctttccaaagtcaaacacttactctgaaagcagtgagtgtatattaagtcaagatttttctaattgctttaatcctgtagatcactaggtagaatatttcatctgaagtactggatttgaatccagaagttaagtttataattatagtgcctatccatggcaaggttgccagaccatttcatgacctgggtgtaatgtgaagtgtttagcaaaaagccaaattatctctgttcaattatcctagggcaactacactttccaatgcagtgtcttccctggcaagcactggtctatctctgaccaaagtggatgaaagggaaaagcaggcagcattagaggaagaacaggcacgtttgaaagctttaaaggtaagtttgtgcattctccttatttcgaaaaatgagtacaggtgttcattaggtaaatggggcctctgcacagacttagagtcttaaatgtatagctacctaatgggctgaaactcagtctaacttttcgtcctgacatagaattaggtaaaacagaatatctgctatcagaacaaattagaaaatgcttttttcagaggctgtacaaagaaatctggtttctggaatccttatggtagttccctttcttaacaggaacagcgcctaaaagaacttgcaaagaaacctcatacctctttaacaactgcagcctctcctgtatccacctcagcaggagggataatgactgcaccagccattgacatattttctacccctagttcttctaacaggtaggagtagaagttaaggttacctttgaatatgtaggttcaaagacttc

SEQ ID NO: 66741 - DNA, 1042 bp, Homo sapiens
ttttctatgtatacattaaacttaaatgaactttctgagtgacatttgggcatggtaaagttgttatcttagataatatactattagtaagattggaaatagatgttagtgctgttttaaatggggtcaagtgtggtacgtgtttacacacaaatatgtacttaggtaattgtgaggaaaagtactatggcacaaactaggaatatgagtagggtcaagtaatgtttctttttttagtataatagcacctctattctaatttgctttaaatacctaagctaacttaacactgatatttttctagtagggtatgtatgctcctttagagacctatttggagctattacctactttttttttccttttttgggtgttatattttgatgtgaacaaaagaatttttacatttattttgtcagaaaaatattttgatatgaaaaagaaccaatgcaaagaaggtcttgacatctataagaagttcctaactaggatgacaagaatctcagagttcctcaaagttgcagaggtaaactgtctttaagtgactgtctcctaacttgcctttttgtctgtaagtatggattttgaagtcatcactcactatccaaataaaataaatgtcttcaatttagtattcaatcattattatgctgtattgaattctgtggcaagatatgaatatgataaagtagtgaataaaatacatgctgtaaatttaattcaatagcgagtattgaaaagttacctgtttttacattgtttacttctctataaaattaagtaggtgacatacagtagtgccagagatttttatggttggaatgaaccatatatttgagaatgtttattgttaaatgtggtagagaatatccagtatcagtgcaggtttctttccagtgagacagctggagccatagttcaaaatgttttcgttggctgggcaccgtggctcagacctgtaatcccagcattttgggaagctgaggtgggtggatcacctgaggtcaggagttcaagactggccaacatggcaaaatcccgt

SEQ ID NO: 66742 - DNA, 1027 bp, Homo sapiens
cagagctctaagactttgttaactcttggcctacagagtgtttaactgttttttgacttgaggcaaatgattattttatttgtaattttaaaaaatggtaaaactgctctttacacaccaatgattgtgaggatcagatcatttcatcttgtgaaaatacaagctatagaccttgctgtataatgtatacttttgcttttatggctcatgctttatgttcttttttagttctaaatgagtaccttgatatttgacatattgtgttgcctgtttttgttttttctgtatgatctctgcttcagttttcatgttccataatgacttaaaaatatgtgacatttcatagcaacttggttctctgttttagtagaaaaccagggggggagtttgaaatgtagatttaattgcagattcatttgtttatttctctggttttttcataacagggctgatggagttatgagaacaatgaacacagaaaaactcctaaaaactgtaccaattattcagaatcagatggatgcacttcttgattttaatgtgagttatgcttttgtaatttaagattttaaaaaattaggtcattataattcatgagaatttttaacctcaagttttcacagactctagtttttcacatcctgatatcctatatggctaaggattttttataaaatagtctcaagtcaaattactttctgatttttatgactgttttggatttatttctttagtgcttctctagctctagaattttaagatatacaagctaaagtggtgaaaggattgatctgaaaatatattttcttttgataatggcttttagatcttgaaaatgtacagggatattttttaaataaatagccaacttaatattttacttttgtctatttaatgggactcaaagcatggcaattattcagaagaagaagtttaaatagcagttataatagcttattatgtagctattgcccaagggcattgtgttcgctggaatttttgttttaatgaccatgacttgaaccaa

SEQ ID NO: 66743 - DNA, 2140 bp, Homo sapiens
ttcagcctcctgagcagctgggattacagatgtgcaccaccacgcctggctaatatttttattcttaaatattttgtagagatgggctcttgctctgttgaccaggttggtcttgaactcttggtctaaagcgatcctcctaagcctcccaaagtgctgggattacaggcatgagccaccacacctggcctctttttgaaatcttaaacagaagccagatatatattatagataaaaatggagtgtctctattttcaggggcatggaagaaactgcctactcatcctttaattttcacttcctccctcattcagttcattttaactttaaaagtctatggaaaacaagatgcagagcagtgctctaggcagagtttatgcatatatccaagtaggttttttgtgtcttattagcgactgatttatcattttcttaagatggaaattaagcaattctagtggtaaggtgttaataatttcactctttttatgtagacgagaggttgagccttgaaggatgagaggtgtttaccgtcttaggatggggtatagtagatagaaccatatgaaccgaagagctgaggaatgtgagcatgtaacacctgacgtgtacagtagtaggtatgaagtcatatgggagcagtatttttttttctattttgttcactgatttttctccactggtacttaataggcactcaataaatattttgctaaataaatgaactggtgatgttgaaatccagttagtttacattttggttggttttggtattgtcttttaaaggtagcaaagaccaagtaattaaatttgttagatgaatatgagataaaatgggttcacttttcaatgaggagcaaaaatttatagacttccttgagccaggtaataactaaaacacaaagtttttggtgtttttagaaaataatattgattagattttatgttgctaaagttttcaagtcaaggtcatgatgaaacaaaatcttagaatgatttatgtattcatttagaaagtttcattgaaaacattcatataattgtttttgttacaccctgaacttgcatgttgccatttcttatattacacagtaattttttatactttttataaggttggcacatacaagttatggttctaaatacagctaaagattttaggagtataaaaattatataaagttgcttgatttgaggaatgggattgtggttccataggatgttaaatttgagttgtgagattatcaagttgtgtaaaagaacgtttttctaattcctgatgaataaagaataggaatattgagagaatagtgaagttctaagggaagaggttttttttttaaaactacataggacttatctgatttaaatatgaagccttaagagaatttaatggtaatgttattaattagttacttaatttacatactaaattgaattgggatatcaagacattttatagccattggatgcaatgagttgtttttctaggcatattgggatttttagtcatttataaaaacttgtctctctctttgttttgtttttgtttttgtttttttacaggatatgacatgtctacatttattaggcggtatagtagatatttaaatgagaaagcagtttcatacagacaagttgcatttgatttcacaaaagtgaagagagggtgagttaagctttttttgacatctaattgatttgaatttttaaaaatgtaaaacataggagttactagattatgaattatgaaattttagccagttttaaaagatgagcctcatttttctttgatgaggtatatcaagtactttttgtggtaggatttgtttttaagttctttttatagcacctttattgagatatcattcacataacaaaatttatcattttaaagtgtgtaattcattggtttttagtgtatttacaaagttgtccaacatcaccactaatttcagaacatttttatcacctccacaaagaaactctatacctattagcattcatttcctattccctcttcccctagatcctggcaaccatgaatctactttctgtgtctctgggcttgtctattctgaacatttcatataaatgaaattatacaatatgtgacctttgtgtagcatgatatgtccaa

SEQ ID NO: 66744 - DNA, 2359 bp, Homo sapiens
ttaataaattctcgcatgctagtgaaaaatatgtattatgtttttaggtttggtaactagttaatggaaagagtgaggatgagaaatttaaactagataagcttaatagaatgtgttaaccataacttttcctcctaattttcgaattagagttggtgagatggcagtaccttaatatgatgtaattttttttttccagcgttttattcagtatttggcttcaagaaacacgttgtttaacttaagcaattttttggataaaagtggattgcaaggtaaagataacttttacattatagaaaatcaaaagaatgacacccacatgatgattactccagagtagaactctgtcttttagaacatgtgctactttaaaccttatattttagtgaaggttgtaggaaagaaaaaactgtcttttaatttgaagattaataataatcttcctaccagatactcagagctctctgagacggagtacagagtagttatttgagagcatgaattctggagctggactgtctaggtttgaatctcatctttgctgcctaccagctatatgaacttgggcaggttacttcacctctgcatcagtagaatcgagtaatagtgatagtacctacccagtaagattgtcatgagacttaacctagttaattactacaaagtgcttagaacagtgcctggcacacaagacatgctatgtaaggctgggtacggtggctcatgcctgttattgcagcactttgggaggctgaggcgggtgggtcacttgaggtcaagtgttcaagaccagcctggccaacatggtgaaaccccgtctctactaaaaatacaaaaattagccgggattggtggtgcacacctgtaatcccagctactcaggaggctgaggcaggagaatcgcttgaacccaggaggcgaaggttgcagtgagccaagatcatgccactgcactccagcctgggtgacaaagctagactctgtctcaaaaaaacaaacaaaaaaagaaatgctatgtaatatttgctttcattgttattatattatgtttcattccaagaaatgtagttgaaatattacatgttttagtagctaaagtggatataatttgttgagatgaattgttccttcatattcgtagctattttcttatttatgtttttttgagacgaagtctcgttctgtcaccaggctggagtgcagtggcatgatcttggctcactgcaacctccgcctcccgggttcaagcgattctcctgcctcagcctcccgagtagctgggactacccgcgcatgtcaccacgcccagctactttgtgtatctttagtagagatggggtttcaccatgttggccaggatggtctgcatctcttgacctcatgatctgcttgcctcggcctcccaaagtgctgggattacaggcgtgagccaccacacccggcctgctattttttatttagtaacttgaaatggacataatgtggttatagctgtccatgcacattgtcttaatgggatctgttttacttagttctgtaactaggctgttagcattatagaatgttagctttagggagaacctcataaaggatatgccaaatgaattgggaatattcaacagtgaggctcaatcagggaaatgtctttagagaaggtgagatttgtgctgggcttcaagagaaggatgagaagatgagttggcttaagcacaggtacaatacatgaatgtgaaagtaaggacagatacacagatgtatatggatgtgaaagtcattcacatggatatgagtatttaagatttacagagcaaatgaatgtgaatagaatatatatgaatggtgtatttgagaacatgtagtggcagatagccctcaagaagctgttcagagccaaaatcaagcacaaaaattttttatagagttggaattttataatgcagtagagagaggaggggagagggaattatgtgttaccaggaaagcatcatagcttagtcaagttagatcagagtaaaccaaatcttgaagatgctgagactgtttcagttgttctggttatctagtgtagagttaatcagggcctgaactgtggttcttctggaggtgtaaaaaaaaaaaaagatcaggggaatttttttttttttttaatgtgactggctgtatttgagtttggaggtgttcagtccaatacttgtttccctttggtaagtgcaggtattgcttaaaaagaatttaataccctatcttccagacattctagaagaccagtaatctatatgtaggacccatgttacaaaatgcattatattttaacaagagttacggcgctctaacttaaggaaaaaaaattaaaaca

SEQ ID NO: 66745 - DNA, 1026 bp, Homo sapiens
cgtgcccagccgtatctccagttttctagatgactgaataaatcaattttaggttgtaaatttatgagggcaggtgtaaaaaagaagttctcgttcaaaatgacctttttgaaagggattactaaattttatatgtattactgtgtttggctaagtgattgtggtatgttgatttaaaaacaaacaaacaaatactggtttaggccaggcttcttttttagaaaatcttattcgggtatcagtgtggttttgatgtagcctagtgagttgctgtttagatgggaacttgagaactctgcattctgatggcacaggccactggctgggttgcctgacttgctgtagaagtgaaccctgagtgtcctaatttaagtttctaaagttgatgaactctgcctggggaaatctatataggctgaagttggtgaactctgcctggtgggagagtttgtaaaggcctacactaggaatatgactgtaagattaatgaaaccatttggtaactgcttagttctaaattttttgtactttgttaaaaaaaaaaaaagacttcctcagaatacaaaaatactgttttgcatttcactgtttttctattgtttttgtttttaattagttttcagtcgagaacgtgtattaaattggctagttgagcatttacttgctgtatgttttagtggatccttatcctttgcaaaaatttaattctagtcattaatctgtcacttagctcctgtgaccttgcctgtgtaaatacagttaacatcagctttatctacctcagtcattgtttgttgaaagagcatatgaaataataaaagagcatttgtgtttgtatggtgggtattggttccttctgctttctctacatggaaaagtgattgtcatttctatggtaggcttatttttaggcctattgtcttcatccccttaaatattggaaatctttgtaaattctcactcatacctaaagcagagaacctacgtgccatgtggtacttgttttttttttagtgtgtgtgggat

SEQ ID NO: 66746 - DNA, 1046 bp, Homo sapiens
tttctgagtgagggagcctctggcagagagtctaactgcaatccattattccctgtgactgggcagaatttaaaaatttttaagagaagagatgaaaaatcttctggattcctacttaatttagacatgggtttggctcttaacgaaaaactttaacctacctacagggaaggctttttcgctgttacccttacttctgtctcctggatcttatgagtggagaaatgagcctttgtttcacttacaaatccacaaatatttatgctgtcatatgaacacatgtataaggcgctgtgtcacattgtggaagatacaaagagacaggattcctgagaatttaacaaagttaagaatgagtgttattaattaaaacaaaaatgggacatttaggttatagttgagaccatgttcttgttttttaaacgtgagatgtttttggacacagaggtgaaaaattctaatgtctctaactcccccagaagaccttagattgatttttctgagaagaaatttgtgaatgatttgcatagagattttctttgaggttaagaaattagatgagtttcccggggtgaaaaaaacagaagcagagattattgttaaaaatggtcatgggtagaggggttagagggcaaagtaggcagaatagaagcatgtttgtgttttaaggaggctaagaactagaatatagcactcataaaaggaaaatgcaaatgcactgtgaatagctgctactggtagtgtattaatttcttagctacatgtaaacttttattagtgtgcttataactaaggtgatgtgtaatatgtcatccaaacttgggtcacttttaagagtgaaagggtgtgctatctgaatgggaccctggacaacaggtgtgaaccaggactgttccagcaaaaccaggacggttggtcattcctaactaataacgtacttttctccagacttagtcccaattcctttaacctctccagaattatctataaataattatagatattataccataaatgttttttcctttatagtactctgatctgca

SEQ ID NO: 66747 - DNA, 1729 bp, Homo sapiens
tttttcttttctttttgagatggagtctcactctgttacgcaggctggagtgcagtgtcgcgatgtcagctcactgcaacctctgcctcccaggttcaagtgattctcctgcttcagcctcccaagtagctgggactgtgagtgcacgctaccatgcctggctaatttttgtatttttagtagagatggggtttcaccatgttggccagactggtcaggaactcctgacttcaagtgatccgcccacctccatctcccaaagtgctgggattacaggagtgagccaccactttatcttaagataaattttccatatgcttcaagaggagtaagctctaactggaatgtagggtactgaccctagctccatatgacctcacaaaaatctgttactaaaatagtttattttctaaattaccttcttactctgttattctgtgatgctataattgtgctcctttagctttttttgttgtaggcttggtcctttggaaacgaataccagaaacagtttctctctgagcctttgcttcattctccatcagagtattctgtcccatttactactatatcattatttgaaaaacagtttgaatttgcatatcttattatcattggtaggaataggtggcattgtcttatgtgattcttgttttaggaggaaatgggcaacaaaaatgtgaattttcagctgggtgtgttggtgcatccttgtagtcccagctactcaggtgactgaggtggcagtatttcttgaggccagtagtttgaggccaccttgtacaacatagcgagaccacatcacataaaaaataataacaataaataatttttttccagtgtgtatcttggatgtaaaaaaaagggagtttctttctacctttattaaaaattgtcttatatgtgttgcctgttgttcatattgggggatcagctgagggtgtgtaaggagcatcactaatccatcaccatttatgttctaccacagtgacataatcttaaaattattaagtgatgaattgatggataattgcttcaccttatttttatctcttcattttaattcttcagaaacacagaaatgtaaacattattattgttgccaggatccttaatttaatttgcatgatggaaggactgtgtttcttaaattatatgaatgctgtgtatatgtattgtagaatggggaattgcatgtatctgtttaatattagaaatctgtaataggtcaaggctgcatcagtttttgtggctgtaattgcttgcacatttttggcttataaacttttgtgtaccagtgacaaccattaagagccagaaaagtttgcttttacttgcagtacatgtacatctagttttgagttatttgtcaaaaaagggtgaactttctttttggctttttttttgggggggccttttgtgacttgaaattaagcaacttactgatatagtttttttttttttttttttttgagacagagtcttgctctgttgcccaggctggagtgcagtggcgcgatctctgctcactgcaacctccgcctcctgggttcaaggagttatcctgccttagcctcctgagtagctgggattataggctctcatcactacgcctggctaatttttgtattttatttttagtagagatggggttttgccatgttggccaggctggttgtgaactcctgacttcaggtgatccacccacgttgacctcctaaagtgctgg

SEQ ID NO: 66748 - DNA, 1085 bp, Homo sapiens
catttaaggtaaccgctttcataaaaacatcactgaataactccccctggtcctgtcagtccagcattattctcaccatttatagagtttcaaatattgttaaactgtagtggctatcttgcttttatgtattttgggtttatgcacatttcctccacagaataggaattgttttcggtattgttctctatctcttctccaagtacctagtcagcaaccccccatgggtgctcagtaaatattgaatgattatacttaacctcccttcatagctcagactattccatgaacaatttatggacataaaaatctatgccagtagacatttaaggatattttttatggtgactatggaaattgcctggttacaaatttatatatagagtcagtaacattgataaaaacataacaaattactgtttcatggaactcatgaggcattaagaggcttatttagttttgtttagatacaaggtagtgtcttccaaaacattgttacttcaaaatttttgtagctgctccagttgaacactatattaaaatgcacatttttgaggacatattcttgaaattaggaatgtaatttttaagaattaaacagaggaccagaaatagatctgaggagtttatcagagctgcttccttgcacaactctagaaggtgcctgtcacacctttttgtatgaaaggtgcctcctagagtataactgtacagtagactcatttttgatataagaagggataaagcacacttaacagatgatatcaaaatgtaaaagaaaagaagtgtctgttttagaaggaagctgtatgagataataggcaaaggttagggtggtggtagcaatggtggtaaaaataggatcacttaatctagattacttaatcagtaagttgattccaggggccagtgggaattgctgaaagtttcatctgaatacatggaatttttagcagtgattaggggaatggtgctggtatttatagccatgaacttattacttgaaagcatcctagggacccaagtcttaatcaaggggcagttcttccaagtagtggttgaggaagttgggtatgctttccaaa

SEQ ID NO: 66749 - DNA, 1090 bp, Homo sapiens
cttttgaggaactagctttagcttctcttacacgacatagtattcgtccattcgctaacgtagatacaattagtagagctaactcctcgtaacttttttctaacctggaagtcacctgtaataccctcctttttctttgcgctcttttaccccagggtacaaagctcattggatcactcaagccaatggagcttagacctgaaacttttcagggaaaaatagggcaatagtcacgataagtaagttccctttttaaatgactggacacattagtctgactgactttcatcatacatgaaagttactttgttttactgtttgaagcaagagtgagcatgccctgaaagataattcactgtctggaagcctgttttgatttctcatttggactttggccgtaaagtttgcactttaaaaaaaatgtacgaaatgtagattcttccaagttactgtgctcatgaatgctgttagaacaagtttttgctacacagaagcctattattctttgtgattgttcctccactgtggaaaaaagttttaaataaaaaagcattagtgcttgattctttcagatatgcatgcaggctgcttttaaactctcagtccttgcttgtcttagagaatggagaatatgtttaaatggtgacactcttatgaacagaaaactttttaaaatgcatcgtaaagccatatgtgattttttgattatctgatacgtgtagtagacgtttctgctatttacggctcttcaaatactacttggtttgccctaccaaatcttacagtttgtcctgacactgtgttaattcttttgttagttgcttttggtttttttttgttttttttttttgtatgggagtatgaagaaactagttgtgactgtgtgaactattttcctctttcctcattcaaaataagaatcgataaggcttttaaaagttttttttgtaaaggtttgtgtcttatttcaaatgtagcagtggttcttttaaagcattgtcaaaaagaggagaaaataggtagggttagaagagtgctatttgcatgttgtttcataaatgttattagctatttctcttgttatagccac

SEQ ID NO: 66750 - DNA, 1025 bp, Homo sapiens
aaggccacgacccacgagatcatggggcccaagaaaaagcacctggactgtgagtgaagccgaccgcggcccccgctccccggcgcccgcgcgacccgcgcgcgtccttctctctctctcttgtctttcacccttctactgcctcttccctccctgcgtcttctctggcacggccggtcctgtgcccgttgagctgtgttcttttgcttccatcacacctgccttcacggcctccgctccccgtctcaaaatctgacaagccactcccctccctattcctaggggaccctcgtctccctgcccggtgcgctaccacaccccatcatacccaaccaacttgcttccccacctggcttctcaccccctacccgtctccactgcagccttctgctcttccttcccacccgtccggtgccgcctcgtcgccctcgtctgagcgtctccaagccccattgtttcttcatcagcctccttcgggtttcagtaaacgcctggttccttgcatccagatccttgttatccctccgggctgcctccctggaagggatcccccacttcctttgctccactagctgcttcgcccatcccttcctggctttctgttccaccttccctcctgcttttgggttaccttttcatcgcctctatagtagcttcagtgtagtttcttcgactcattttaaataccatacccagttacccgacttttatttcagattaccttctttgtgggagtgaaagtaaaaggattcaatttggtgtagggaaagctttctggaaagttgggatttttatttgcctctggtggaatttaatcgttgtgttgtccatacttttgactggggtgagtttgtgactgtcagctctgccccccagcttttcacatggggatatggaaaaaggcattttgctgatactcttatcagttcctggaactgttaattctggcggcttgaattcagaagcttgagtgttaagcgtagactgttggaattccaaatggattaataaatttacttacaaat

SEQ ID NO: 66751 - DNA, 1032 bp, Homo sapiens
atctgggagtgcccatctctcaatttcactgcctcacaggctctgctctgttttcctactgttgctcccagtggtattctctggttttggggttcaacactgccccattgagttctggcttcttttcttcgaccgcatcgccctgcttgctgaggctgtgtgccctaaagaagaggggggtacttcgcaggcaaagttataactaatattctccccaatgcactaatcatactcttgggctttcatagtctaccaacagttaaatttttattaggcccatttcctcagtttcctgaagaactttgtcaaggacttggaggaccttccctacagcctgagttagagaacatgtgggttgtgctactcagtgactgactaaagaaaattcctatccactaatggtgaaccactgtcccagaactgagctagaacatctgacgcctttcctatcttgaggagactccttctatctgggtggttacctagaggttagaggcagagtcactgccctggaccttccgccgcttccagcatatcttgccatggactccccaagagggacagtcaagatttcatgcacatagaaccctggcactagataggaaatagatccaaaagaaaggattaaagggtaaggtctgaggatgaagagcccataaacattccacatagagtccagagttttgagtctgtctgtgaaccacctttctggtactatggcccagccagtgccacagcatggaagtgctcttgggagaatatctgcataccctgtagagaatagtgtatatcatacaatcctttcattcccgacaagggaacactaactagttctccatcccatcctcctcttctgcccccatatctacccatgattgtgaactacttggataaatttctcaagacttttggcctagtgatggtgtgacctaataattttgaaatctaattttgaatttcaccctagtttactttctggttgtcaattcagtattatttttatgtaggctggatgttcacgctggtcagatt

SEQ ID NO: 66752 - DNA, 1166 bp, Homo sapiens
gaagtgtcgactgcgccggcgggaacagacatgcctgcggccaagaagcagaagctgagcagtgacgagaacagcaatccagacctctctggagacgagaatgtaagtgcagcttctggcagttacgagactgcggagtgaaagttttaaattcttttaaaacggggggcgcggggacgagcgggctgctgtggggggagggagaggtgtcactcaggaaaacgcgggcgtgcgggagaaaattgaaattgcctacggggattttgatgtggggccgagagcaagcaggaactaggcaaaggagagtggttctagtgattgcgtgggtctgagaagtctgccctgaaatcagtttgcatgtgatggggagtgttttggcctttggggggatttaaggggagagtgcgggtctgagattctagtagtttaaaaggcacgttagagacttttctaagaaagttggaaggacggggcagagttagggaccctgttaaaggagcgtaagggttgtcactctaagacccttgtggaattttcaggatggaaagtgatcttcgatttgcggagtttgggagactttattaaagggggttttgtgtccgcctccgtcctgtccgcggagaccgggtgcgcctgaaggtcgccttttctgtaggaggagccgaattgagaggatcgatttttgatttgggggtggggagtgactacctttgaggaagtaagagtgggtgatttcttctttgaacgtttttacttaagataaaggtgaggggggtggcgacctggaagattttgggcaacagtggtataggcagatgtatttaagtgtgggttcctggcttcgccaagtgcgcgatgttttgcaatcagatttttttaagctctgaaatgggtattcgtaatcattcggtaccaacatttaacccaactgagttttaattgactcgccagtaagagccgaattgacataaataagttttcagtttcatgttttaggttgataaccagtaaggtcaacgaagtatcttgacaatttattcaaagatactactccaaaatgtgattctccttctcatgatatataacaacttgtgaatatcttttaaaaaatccttaaaatgtttcagaagagtggcgtaagttcttcattttctcagtttggctag

SEQ ID NO: 66753 - DNA, 3874 bp, Homo sapiens
gaaccaaggacagagtgggtgacagagggagagcctgtctcaaaaaagagttgtaagatagctcaaagacatagtggagggctatagtctggtaacttggaaggatgtgctatatagataatgcatagttttccactgagatacagaattgttttctacgtttgatgttaattatgtgaatacaactgaaaaggtggagagaaaaagagattaaaataccacattttctatttctgtaaagactaatgatattcacattaaattacaattcaaatatttgttgagtacgtactgcttgctacccgcctattatttcatttatgatattttttaaccttctatataaaaccaactttaggaagcaataatttaaaaatagcccctaaagcagtgtttcctaggctgtttaataggcatttcatggaaaaaaaaaaaaaaaaaggcttcctctggaatgtattttagaactgctgccctaagatcctagattaaataaatcttttctttccaaaggagacattggaatctgtaatcaggaggtagtggaatcctcttctgagattagagagctgagattagagggccactcgtgtgtgagataaggtatgaattaggagaattttcaaggtttcctgcagtcatttcttttttttggaaggatttactttaattgtgattgagagtctctggagttctgatttatgagtattattactttagaacaatgagacagttttaacttgtaaatagcatagaatatatgtagcactttaaaaaaattctaaatgttttgcgttataagcagaatttgaataacaggattttaaaaagtgacatctaatgtagaagccattaacactcctgcttcaaacggctccccagctccatgctccagactgagcagcagtcaaatacattatgaagacatatacatcagtcagatttaagagtcacagctttgggatggaattaccagccaagagaccagttaggctttttcagcacttccagtaccttttgtaaagagctgtaaagattcactgatacagtgtattaaagtgactggaacagaccagtgccttattaaagacagtattactcttccattattctcattagtatttatttcattttcatttttgttgaaatataaaatatctacaaaccttctaacctgtagctggattatgtttatccttatgtggaggcaagaatacatttttttcttcttgtagaaattatttctcttaggtcagtcagcatcttcccagtagagttatttactgctaaaaacagtattgctgtttcatgtaatttttcctcatttactgcttacaggatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggtatgtgcaaaaaaagatcctttgggctgaatgctaggcttcagaaattatttctctgtggcacgcatttcgtactcaggatactctgtcaagttgtaaatattttaaagttacaatgttttctgaagggtttttttttttgtagttcagactgcgtatctattttagtccatcccatgtttagttttttggttttgttttttgttgttttaatttaaatatgtgacagtgttgcaggatgtttttgctttattgtttgcattcaaattataagatttgggtaactattactctttatattttagtaaaacttaaaaaacataagccacttctggcatcagtttttaaaaagaactgaatgtaacccattaactttgactaagtataaattgaaacagatgttttactttgtacagtttctgtcctttgttttatttataactgttttcaaagaaaaaggtgtaaaaaatttttaaactttttaatattaaatatttagggaaaagggggttttggttatttaaattaatctgtccccaatagtatttttatttactttataaaaggggttactggtgtttaagatattttcttttatatatgtccagtttgttttttaaatgtgaggctatttttttctatactgaggaaaaatgtgtattatctcatacatatgtaagttaaaaccttttctaaatatccaaatatattttttataagtaaagttttgggaaagcataagaagctatgactatgacatttttctgtctgtgtagcaaaaattcgatgctcagtgtgtcagattttgctcctgtaaaaggagagaaattaatctcagcatattttttaaaagtcaattatagtttcatgtgcatatttatttacattaacgtactacttttaggtactgtacctggaagatgtttttagctgccttttatacttaaggcagtatttcaaaatcctaaagctgtggcttttcaaatgatgagaaaacgaaagacgtactttaaaagtgaaaacagtgccttaaactgcatctgaaagtcagtgttaaatgccagaagttggccagtaaaatcctaaagctgaaaaataactttgtgaacaaaagtgcataattgttctttgtacatctcctatagcctcctggtaactgtgcagttacagtttatttcttcccctagtccccagtgttcagatattctcattctgactaacagaaaacagtgatttgaatggagtctgctatgcttcactttacaagggaaaaatttagccttataaaatttagtgaatgccagagaagctattaaggccatctgttaatttcctgtttcagaaaaataaattgtgtccttttgtatccaccaaaattatccagtttattgtgattcagaatatgattggcttattaagaaaaaggcaaatattataagtgttttcgtaggtaagcggttattacctaacttgtgatttcagcctttggttgtgataaaactttatcatacacaatattttaaaatgtgaaaactagactagtagacatcttttaattttagtgtcaaaagttagcttatgtatgatacacaaaataatgtattgcattttggaaaaaagaaggggataggttagtttactgtcattttctggtttgtaagatacattaatcttttcttatttcatgattattttataggaagatcataaccaaccattgtttggagttcagtttaactggcacagtaaagaaggagatccattagtgtttgcaactgtaggaagcaacagagtgagtgttaaggggtctatttagtatttggcttgatttccagatctggtgttaatgtaatattgaaatagaataatttcaaagtgcattttgtgaagctggtttagcaatatgattctttcatgtaagagtgaaggtttctagaaattaattaaaactagtatgcatggctgaaaatacatctatatttaatatattacccctaattatttatgaaacaggttttatacttgtatttgtcttcataaatacttggttgaaagaattggcgtcctttttttttttttttaattggcgttctttttaaagtgattttggtatttatcattcaaatagcgtaagaactggctgtgatttttttaaaattaaggtaatgaatggctctataaatgaagcataaatccagtggatttaaataagttattgagatgttttaattacttgcagtaaacatttgagtttgctgggtttttttgttttgagacaggtagtgtttggtggtgattgttgttgttgttgttgttgtttgtttttgagagagagagagtcttactccttcctccaggatggagtgcagtggttaatcaaggc

SEQ ID NO: 66754 - DNA, 1847 bp, Homo sapiens
tctcttgacctcatgatccgcatgccttggcctcccaaaatgctgggattacaggcgtgagccaccgtgcccggcctaatatttattttttaatagagatggggttttgctatgttgcctaggcaattgaatggatgaaatataagtttaaaagattggaaatcgaaacgactattactgcaatatttaatatgctctgtgtattatgtaaaacattcagctttataatggcttctttaagctcacaggaggtattttaaggcagtagtttctgtagtatatttaagataggattgcgattaaaatatgtttaaaagttggagagagtatgttttctatacttgagatgaaatttactgtatttttattttcattaggttaccttgtatgaatgtcattcacaaggagaaatccggttgttgcaatcttacgtggatgctgatgtatcctttcctgggtttttaatatctttagtcaaaggaatttattttcaataagtgcaccaaaacttttataaattaatcatttccctaaagttattgttctttcttaaccgatttcttcactatcacccaagagaatcctgtatctagttttcctgacccttagaaatccattgtggtatgtgtcaactcagctaggcaaaaagaaaaagaaaagaatccattgtgggatggatgtgctggttgggtgcagatgtctatagagataggagcattagaaatctagtaatagaaaatattagcaaagactgattaaaacctcctttttctttgaccttgcctagaatatatcatttcattgtagttataatgatgaacttggcttgtgactggtagtcattctaagtatttgatcaacgaagcctaggaagaaaaaaaaagtttaggaaaaataaaatatataaaaataaaataaaataggaaataaaaattgcaaaacaggttcataaagaaacagaaaaatttgaaaagcccgagttagagcggtaaaagctaagtaataagatatttcttccagatccatttgaaaaacctagcaaacaagacaaggcaaggacattcagtcttctctaaaagatattgaaatgtgacctgttgttgtattgagactgtctcacaaagaaaaaagtggaaaactgaattgttcttttttagatatttatagaggtatggggatagagcagaggttaaactacagcgtgcaggttggtcacctgtttttgtaaagttttgttttgaacacaaccatgcccattcatttgtatattttctgcagttattttggtactgcaactacagagttgagtagttgtacaagcagctaaagagtaaacaaaattgagtggagagactgtaattttgtttgatcatttgttatggattttagacctcaaatcaccattgtatatatttggttgtataaggaaaattgagaactttggtgtcaaaaactttagcagttctttataagtttctattataattattgacatgtttctttttcaaaaacattatgtttcttaactgtggaatttcttaggctgatgaaaacttttacacttgtgcatggacctatgatagcaatacgagccatcctctgctggctgtagctggatctagaggcataattaggataataaatcctataacaatgcagtgtataaaggtgggtttttctggttaaattgtagatctgcttcttttgaatccacaactgtaaaaacttgtaatgttaaatttaaaactaatggtatgaatgtaacatttctcatttgatttgtacttttcttactgctctctttggatgagtcttttgagacgtttgtcacatttgggtaatgtaaa

SEQ ID NO: 66755 - DNA, 1100 bp, Homo sapiens
aatttatttggctcctgtttctggagactgggaagtccaagaacatggtgccggcatctggtgagagccttcatgctgaatcgtctcagcaaaagggcaggagagggtgtgagggagcaagagattgaatttatagcctcaggcccttttataatcagtattaatccatttgtgaggatggagcccccatgacctaaatacctcccattaggccccagctcacaccactattgcattggggattgagtttctagcacatgcttttgggggggcctattcaaactatagcacttacctagctaattctacatctgatgtaaacattttaagttgctatgtaatatggattccatttttaggctttactgtgcataacttacatctagactttagtagtttttctttcacaagatgttgaaagttcacagtaaataaaaaacattcgcctaatttttgtatgtttatactagatcatgctttacgattatggaatatccagacggacactctggtggcaatatttggaggcgtagaagggcacagagatgaagttctaagtgctgtaagttggaaactgcagggcaatgactttcaggtttacatagctgtgaacagtctccatggaactgtttccttataagaaagtgtgtttcatgtagcctgtcaggcagacattcacttacatttgacatagaagattttaatctccagatgaaggaataaaacaagtaaagactatatttatttatttattttttaaattacttgcactgtataccaatccctggagtcttatgagagcagtatgatcttgctcctttccttttaatctaaaatcactaagttaatgtttgttttgccatttcgcagttattaaagaaaaaaattaaactatgtagccattaaagtgcttttccatcttttgtttgaagttgaaacataacgttttttgctatttggaagtgttttattgtgctcacactgttttaggtaacttatttctagccattctctttgggtggcgtggtataatacaagaccagtttaaagataaataccacctttatattgatgtattgtaatccattggtccattatac

SEQ ID NO: 66756 - DNA, 1174 bp, Homo sapiens
actccttcaatagaactctctactgttatttcttagaatgagagcaggagacagtatgtagctcttctgtgtaatacaggagttcactggaggtggataggtgtgtgagattttcattactcattatgtgccttttgctaaattaaatagcatctctgggccttagtgtctgcctatgaaatgaggttgttacaatagatgatctgttacatgcctgttaaaaattagtaaacagcaaatgaaaaaagttaaaatctgttttttattagacttttaaaaattcacttaaaagtgaactctaaaactaacttcaaaatattttgacttagaattataaagtaagatgtcagctctttaaggattcatgtattttcacatgcacatgtcagtttcattggttggttgaggttggataggaaaagtaatatcactattcagctctttgtgtcagaataattattttaacttagtattcaatttaccttcaaaataagcaaaataaatattttagtgtaattgaatagataaaactaagtttaagtaattttttcttggtttatacattgtaaatgctcttatattccgatgttgacaaactaattaaagctgtaaatcttgaaagtagtaaactctgatttatggcctatttagatgaaacccaaaatgtagtttgtattgtgatttgaaatacagttttcactatgttgcacattaggcaaaaattggataaatataatttggagctgtaatttatataaaactttttggttttgcatacaggattatgatcttttgggtgaaaaaataatgtcctgtggtatggatcattctcttaaactttggaggatcaattcaaagagaatgatgaatgcaattaaggaatcttatgattataatccaaataaaactaacaggtaacagttgtggtatttgaaacaatttgctatgttgtgctattgaatataagttttattttttcccaaaattgctatataagccccaacaatgagtttagaagaccttcttttaactttaagggacaatttacatactgtaaaattcacccctttaagaagtcctttatttgcagtgtttgtggcttagttttcaaaatcccctttaaattgtgttgtcatcttaacttagtagcacattttacttatttgtattttgg

SEQ ID NO: 66757 - DNA, 1015 bp, Homo sapiens
gcctcacttcatggtactataggttggggaattttgcagttttcttagtatatttttgaaatgtctcaattcttaatgcagtaactgtctttagaatcttatcaggctgtcattaacactttcactataaacgttgtatgtctgcatgttaactttgttggcacttttgttttagcaaagagctagaattcattttctggttatcaagccagattgttaatagattattaaatttgtaagcatcagtaaatatttcaatgcactaacattcatcagacctaagtgtcctctaagaattattaaaagttttacctttctcctttaaaacaccaggagctagtaggacaatgttaaatttatatttttagattattttctagatatctggaataaatacaaactatatttcagagttttcaaaaaataacagttgtactcgttttttctttgagagaggtttggccatacaattatagtatgtatttagctaaaaagcaattaatataattatagcagagttaagaatttatatcagatcacgaataacattttaatgtttcaacaaaatatcccagaatttgaattggaaggattgttttgagttgctccaatccaaagtgcttttttacatatctgagggaaaaggtaaagagaggacatatgaattgcctaagacaactaattcatggcatattatacttatacagctatttctgatttaaaactgagtatattaggaatgttaagtgtactgttaaataactccagaattaatagcagcttgttttgtttcttctcacaaatatctctaatgaaaacagtgttgccatttagtttcctaaatacagaaattatttggaaaagtcctaggaaattttattttgttctatttgtttttttgagacggagttttgctcttgtttcccaggctggagtgcagtggtgcaatcttggctcactgcaacctctgcctcgcaggttcaagcgattctcctgcctcagcctcccaagtagc

SEQ ID NO: 66758 - DNA, 1888 bp, Homo sapiens
tttgtatctctgtgactattttagtaaaattttatttataaaaacaggtggctggagttggcttatgggctgtagtttgccaacccctgcccctgttgatggatttatacagatgctcctcaacttatgatgggattacatcgtgataaacccatcataaattgaaaacgcatttaatacacataacctactgaatatcagcttagcccagcctatcttaaatgtgctcagaattagcctacagttgggcaaaattatctaacacaaagcctgttttataataaagcattgaatatctcacatactgcatactgctagcccaggaaaagatcaaaattcaaaattccaagtacttcaaaattgcagctgttttgtaccattttggtaaagttgaaaaattgtaaatcagaccattgtaagtcaaggccatctgggtgtgtgtgtgtgtgtgtttgtgtgtctgtgtatttttttgtagctgataatttagagaagctattggtgatgttacatgagcatttaggattatcaaatttggtgaaattgctgtccggtttcttttcttgatgtgaatttcaggccacttcacattttcttgggcagagcctgatttacttttttcttggctttatgtgtaaactgtttttttcttttttctttaaacttttgaccttcaaataacttgattcataggatgtttcaaagattgtgcagagaggtcccatatgatctttatccagaatccaaagtttatatattatataactgtaatacaatatcaaatccagaaaattgacactggtacaatgtgtgtgtttagttttatgtcattttatcacgtgaattttgtcatttcaagaatggtacagtttgggaccttttaagattgtttttttccactcaaacccttgagatccatccaggttgttgcctgtatcagtagttctccttttttattgctgagtagtattccatggtatggattaccatagtttatgtaactatctatggtaggaggttttggtcatttccagttctgggctattgcaaataaagctgctaatcagcagttgtgtccaggtttttgtgtggacttaagttttcatttctctgggtaaatgcctaggagggcaattgctgggttgtggttaagtttgtttagttttttaagaaactgccaaactattttccagagtggccgtgccattttacattcccaccagcaatgtatgagagatccagtgtctccgaatcttcgccagcatttggtattgtcattattttttattttagctgttctgataggtgtgtagtgatatctcatcgtggtcttaatttgcatttccctgatggctagtgatgttgaacatctttttcatgtgcttatttaccattcgtatatcctttttggtgatgtcttttcatatcttttgctcattttctaattggattggttttttgttgtgttttttttttttttttaactgttgagttttgagagtttgaatatattctaaatatgaatcctgtatcagatacatagtttgcaaatattttctttcagtctgtagcttgtcatttcatcctctttaatagggtctttcacagagcaaatgtttgtagtttttattaaatccagtatattgattttttaaaattattttatggattatgcttttgatgttttgcctgagaactccttaccaagctatagaccttaaagattttctcctgtgttctcttgtaaaagttttatactgctatgttttacattaaatgtgtaatccattttgagttgatttccttatgaaggtgcgaggtttaggtggaagttcatttttctcttatagatactcagttgttccatcagcatttgttggaagactat

SEQ ID NO: 66759 - DNA, 2230 bp, Homo sapiens
cctgggaattggtagttctaaaaagctcttagatgattttgaagtgcagccatccattagctctggcaacatctttttacctcactttgctttagtttttccatccagggactccagtacttaaaaattcttcaccggtgcagttagtaagaagcacttgaagagctattttacagttcttctgctttggcctttctcttagagactctgaatcagtaggggctgagagactctgaatcagtaggggctgagatgagtcttttgagaaaactccacagactattgatccaattttgcatttagccaagagtcatcacactgggtggtttctaaggtcctttacagttaaaaacttgaataatagatgtcatatagcactaggatttaaaaagtctaaataaaaaaggtagagaagaaaaatgtgttgtctcctccctaatcttcaagtggccatactattaaattatttaaatgcctgtgaaccccacagggctgccacctgtcactatattatgtaggctgtccagtaaaactctaggggcactgttcacttacatgaggatttctgaatcctggtgctatttagtttaggccagataattcttttttttgtagggggtttcctgtgcattataagatatttagtagcatctttggcctctacccattagagcacagacacattgtcaaatgtcccttcgtgggcaaaccactgacctagacagtaatatgaatagtgcccacagttttgcaattttttctcattgtattctttaccacttactgcttaggtatgtgcatacaaatttgattttataggataggaaaagtataagtttgaagcctatttcaatcctatccccatatgagtgtcttgatgttaaacaactgctttacttgccttcgattgccctatttataaactgaattctaaggctatttatgtgagttcatcaactttcctaagatacctgttgagtacctactgtgtggcacagatactggatgaaggaataatagttaataaggtaaaggaaaccacctgtgattagaagcgaaatgggagactgcatggggaaagatgaaactagtgaagtaagcaagagccagattaatgccggattctgaaaagccatgtattctaattctgtgtgtttgtaattgacctgtgctataaaacacttaaagtctctgggtgtcagagtatctagagctgaacttggtttaacttgaaagagaaatgttgacttccaaaatgaatatttcagacaatgtgattcttttgtattatcgaattctgttgataatcagatttcttgtccttaagtatggtcattgactgtaaatataaatgaatgtacatcactgtacttgatagatggattaaccaggttctaagagctgtgaattccaaaacaatagaaaagccttgtttttactttgtaagattcagttcctcattaacatttctttttctcatttctctctctgttttagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaaggtatcaacatacttttacattttgaaatgatctgacttatgaaagaccattgtaattctagctttttctgttgtgtccatgttctttttcctttacaaatctaccctgatgttttgtattgattactttgccctttgatgtcattcatcaaatactttggtgttattcattctacttttgtggctctgcatatgatctgcagtgcttactttaaattaagttggcagttaggtatcaatggtggaaattaggtgtttatgttccataacataaacattatcataacattactaagacttaatgttttagtaattagattgtcagtctacctatgtaactgtttcctagagaaaaatcaggatagaagacagataaaatactagttacctaaaaatttaaataaatctattgttaggattttctggtaacaaattacttgggtatttatttctgtaagaaaagtttggaaggctttccacagcatttgctgtatttcttgaaggcagaagaaaaagtaagtaccatgctaacaatgtaaatttgtaaggcccttcataaatttgcacaatgcctt

SEQ ID NO: 66760 - DNA, 1050 bp, Homo sapiens
tttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgtaaagctgtgtgtttagttactttcattgtggtgaaaaaaagttaaaagtaataaaattatgccttatctttttataatggttgttttttgtagttctcttaaccagagaaagttttgtaatacagagattaagtataggctctagaactaaagtgaattcaaatcttggctctcctactacgtgaccttggataaacaacttctcaatgcttggttccttgtgtataaaacagggataataatacttgccttggggttattgtgaggatcaaatgattcgttatgtgtgagacagttagaacagtatttgacatataataagccctaaatgtattctgtgtttataattattggagattatagttcctatggttttatattttttaatgatttcttatgtaatagtttcataagtaatatttaaaattctacagagttagaacctc

SEQ ID NO: 66761 - DNA, 2122 bp, Homo sapiens
gttaaagattaatacttctgagacactgtgtagcagaaagaaacccggatttggattaggacttgaattcagcctccaacatttactgctgtgtaaagatttgaggctgatcactcctataaaatttggattataatacttacctcatagggtttttgtaaagatctagtgacgtgattattgtaaaagtgcaccgttaatctctcagatgtcacagaaacgttagaagcatctcttcccaggattgtacatggaaatgaaggatccacagattttgtggctataaaacacccggactaccgatcccagtgtgcaaagcctccaggcttaccttcccggaaactggcgcggtgccctctgggacttgttctgggacttgtagtcttgtactggcgctggcccgcctttcttccttagtggggaaaaccgggtgtaagccccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggtggcggggaggctggtgaggatgggaccgggtgatatcaggaaggggtcaggataccgagggcgaagccctacggcagggagggtgcgcaggcgctagggatgcggggaagcccacttattatattttgggtgggtatgtgaggatggagcgtgggaagctgggtgctctcctttgcccagctctattcagattctttcgaatagtagtcacagtataagttggcatttattaagtgtgcattttgtaccaagtactgggctaagtgcaatgcacgcctttggtcactcagccttatgtgtggcgcttatttggcactttgaacttaatcctcataactcgtgagatggtctttatctttgacattttgcagttacagaactaagttcaatcgccagtataaataccttctttattaacttgaggtagaggtgaatttgggattgaatttggtctatagcaaactgtttttcaaagattaaggtgctcagggaatgtatatcttttgggtccctttggaagaacccgagtaaaaataagcttaatttaattggaagttggctgaaacttaacgtgtgagccgtatctgagataaccagagaaggatgcgagtagtgtgtttccttatgggtcaaaatagataacttaccttgccaaattgttagagtaaatgagaacagcacctggaattctttaggaataatctggaaggtgaatcttgtttgtttccttagaaaccacacagacatcaattttcaggcctgattcctttcccctagaagtatttttccttcttttttctcctggctttttaaaatgttgcagtccctttgctgaattgtctttttttcccatcaagttttgataatgtattgtattctgtacatatacagttctaagaagccagaaagataagttggagatgactagcctcataaagtttgtctcttgaatgactgggagacccctgtggtgatggtggtaattcataatcctggtgagataattttgccctgctcttaatagggaaaaaggacaaacctggaatgattgtgtgactcagacgagtgagtgttattaatgaatgacattaaaattgtgtttcttaaagaataaaaagcctatttggaatccatgtatctctcacgttgtcaactaatttggaaggaaatttagttatggtaatacctgcctctatatattggggatacttggtcctttaattatggagtattaggacacatcaaagtgaaggacaaatagacctagtggcatctcaaaacttaactacacgactctgttataagaaaaatctacttatctaaacttatgaacccagtttttatttcttaagattttttttcttaaagagatacaccttttcttaatgtcaaaaattagagtgtgatgatacagatttgcagactgttcagtacctatacaaagt

SEQ ID NO: 66762 - DNA, 1241 bp, Homo sapiens
tttcttttcactttgagtatcctagagatgggaggatgcctaggaagagtttgttgagaagtggtaccatggtgtagcatggagagcattggaatgcactaggtttgaattttggcataatgtagctatgtgaccctgagcaaatttctctcatctgctcatctgtggaatgaggaaataggagttgaatttgatttttttccttaggtcccttctaggtcttaaatttgcagaagataaacaattactaaaatttcttatgatttgtgctctctgataaaagctaatcaaaactgccccgatatttaaattcctatgcttgctgtctttttataagaataattacatttccagattatctttttagattttttatagctttttagaaatgacatgtaaaattgttttggataagtcatttggcagttaatgaaagatcctattttaattttcttgtgaatgtaaatatatgtgttttcttttctaggtatgaaaactttcaaagacgactagcacagaaccctctcttttggaaaacataatttgaataaaataatttttaatggattctgaaatttgtcatgttttgaagataactgactccatctaaaagtatgaggtcaaaggatcacgaaacctaagtttaaaaactgcttagagactgaagcttaattaaaaatctttattaaaaattaaaaacattgaaaaatgaaaatatgttcatcattaaagacttttttccccttaagcttaaaataccattcaaaggcaagacattttgttttggctatgattcattttttttacttaaaaataaaacctataccaaacagtagtgtgccaagtaccattgcatgtgtaatcattcatttattgaaatgaaacaatggtttgctggagtagttaacttttcaattacctatttcaaaatttgggagacttgaaaaacatatgaagtatacatttttaaatatggagaaattattttcagagattatttcttaagattgtcagtttttccaattaatacaggttggctgtcactttttatatctgcagattcatataagtttaataaaattgccatattggtgagcttttatttaatactggtaggcatttatgtgtagaatataggattcttcttgttaatggatggttagtagttcattttttgttgattataacaatacccaaaactgggtaatttattgacttaaatgttttttttttttttaaga

SEQ ID NO: 66763 - DNA, 1035 bp, Homo sapiens
tttggtttgagccttatgcccatagtttgacatttccctttcttctttcctttttgtttttgtgtggttcttgagctctctgacatcaagatgcatgtaaagtcgattgtatgttttggaaggcaaagtcttggcttttgagactgaagttaagtgggcacaggtggcccctgctgctgtgcccagtctgagtaccttggctagactctaggtcaggctccaggagcatgagaattgatccccagaagaaccattttaactccatctgatactccattgcctatgaaatgtaaaatgtgaactccctgtgctgcttgtagacagttcccataactgtccacggccctggagcacgcacccaggggcagagcctgcccttactcacgctctgctctggtgtcttgggagttgtgcagggactctggcccaggcaggggaaggaagaccaggcggtaggggactggtcttgctgttagagtatagaggtttgtaatgcagttttcttcataatgtgtcagtgattgtgtgaccaaggcagcatctagcagaaagccaggcatggagtaggtgatcgatacttgtcaatgactaaataataacaataaaagagcacttgggtgaatctgggcacctgatttctgagttttgagttctggagctagtgttttgacaatgctttgggttttgacatgccttttccacaaatctcttgccttttcagggcaaagtgtatttgatcagaagtggccatttggattagtagccttagcaatgctacagggttataggcctctcctttcacattccagacaatggagagtgtttatggtttcaggaaaagaactttgtggctgaggggtcagttaccagtgaccttcaatcaactccatcacttcttaaatcggtatttgttaaaaaaatcagttattttatttattgagtgccgactgtagtaaagccctgaaatagataatctctgttcttctaactgatctaggatggggacgcacccaggtctgctgaactttactgttc

SEQ ID NO: 66764 - DNA, 1039 bp, Homo sapiens
atggttgggtgaagcctggaaaaggcagtgagactgtggtataaggctagtcagcctccatgctttcttcattttgaaggggggaatgccagcattttggaggaaattctactaaaagttttatgcagtgaatctcagtttgaacaaactagcaacaattaagtgacccccgtcaacccactgcctcccaccccgaccccagcatcaaaaaaccaatgattttgctgcagactttggaatgatccaaaatggaaaagccagttagaggctttcaaagctgtgaaaaatcaaaacgttgatcactttagcaggttgcagcttggagcgtggaggtcctgcctagattccaggaagtccagggcgatactgttttcccctgcagggtgggatttgagctgtgagttggtaactagcagggagaaatattaacttttttaaccctttaccattttaaatactaactgggtctttcagatagcaaagcaatctataaacactggaaacgctgggttcagaaaagtgttacaagagttttatagtttggctgatgtaacataaacatcttctgtggtgcgctgtctgctgtttagaactttgtggactgcactcccaagaagtggtgttagaatctttcagtgcctttgtcataaaacagttatttgaacaaacaaaagtactgtactcacacacataaggtatccagtggatttttcttctctgtcttcctctcttaaatttcaacatctctcttcttggctgctgctgttttcttcattttatgttaatgactcaaaaaaggtatttttatagaatttttgtactgcagcatgcttaaagaggggaaaaggaagggtgattcactttctgacaatcacttaattcagaggaaaatgagatttactaagttgacttacctgacggaccccagagacctattgcattgagcagtggggacttaatatattttacttgtgtgattgcatctatgcagacgccagtctggaagagctgaaatgttaagtttcttggcaactttgca

SEQ ID NO: 66765 - DNA, 1040 bp, Homo sapiens
gttccttgaaggaaaagattgggtcttattcatcattgttttgcctgtgtatgagagttgaatcgaagtaatagatggtcagtttcagaggcttgaagagggagggagtaacagaagaattgagaagatgccattagatttgttgatcactgactttcggaaaagtattatctctagaaagatggagaataaatggagagttttatagtctttctgttctgaagttagtttttctctttcttacaccctcttactccttccctattatgttctaacctttttggttatgttgtttcattatgatggagaagtactcttttctacgactagtgaggagtctattattcttcccagttcagctcatatcccgttctccatgaaattcctgccttcccctgtattaaactgactctgctaaaattctgtggtactttctattatattactaacacttaatcagtcctcagtatctatatatcttgcacatattatgatttatattgctttatttcctggaacgttaatagtctgctcaataaatacttagatttcatgtctatccatataattgctaaattatttcagggccttttttggttttaatctagaaatcttcctttcatattcagagttcaccaaaaaaaaaaaaaaaaaaaggttttcaatctaaatttaaaagctaagtcatgaagactgataggttgatattttttataaaacagtcctatgataaacttctgcagtcttttgtattgggacttattcgtgtttctgtgttctggtcacaggtgatacatacttgtgttgttactagattctttcttttttttttttttttgagacagagtctcactctgttgccaggctagagtgcagtggcacaatctgggctcactgcaacctccgcctcccgggttcaagcaattctcctgcctcagcctcccaagtagctgggactacaggcgcccaccaccacgcccgtctcattttttgtatttttaggagagacaaggtttcaccatgttggccagaatggtctt

SEQ ID NO: 66766 - DNA, 1018 bp, Homo sapiens
agggaatgcctgaatgaatgtggccggctgttactgaaaggagtgttacccattagttgttactgtagccgccttaatgagagttagtgagagacttaactaaggcaggggcagtaggttggagaggaatttgaaagataaattgcatctgtaataatttaagggaataatttaatatgtggggtaagggaaacaaagttgaggatgacgcctgtcaaacataagtggataggtggttgttgatgctattaacctaggaaaatagaggagagagaacaagttcatggggctaggggagacagataatgagtttgattttgaatatgtttattttgaggtagtgtggtacatttaaatagagtatggatggagaagggaaacttctattcataataactgaagtgaccaactaggaatttcatacaaaaattccaaatttgaatttcaggaagatacttggaaaattctactcatggactcctggctttggtgccgctctgccagcatcttatgtggccattctcattgaaagaaaaagcaggtaaaatttcatatatttatttaacggaactgattacctgtcccctaccccaactataatttttttttttttaattatcacttacagggatgagaaatatttctagatatattttttcggttctgcagatatttaattgaaaattaattttatattaatgtttatatgtattttatatttattgtctataaaaatataaaagtggacattatagagcagtaatagcctctgtttactaaaagattagagagttctataatgtgacctaactaaaatatggctatgcaaattctaggccaggcagctcattcctgtaatcccagcaccttgggaggctgaggcgggtggctcacttgagccttggaatttgagaccagcctggccagcattggaaaaccctgtctctacgaaaaaaaatacaaagaatattagctggatgtgatgatgtactcttgtagtccctgctactcaggaagc

SEQ ID NO: 66767 - DNA, 1042 bp, Homo sapiens
ttaatgagccactaggaatcaatgttctatacctaaaagcaactggaaagtaaattaatgaatatatcatgctaaacccaaactcaatatatcttgctaaactcaactctactagcaagctggattccaaaacctagtgctgttcatcacaaggtgaagtgtgacagagaaatcagaatgtaaaatgatagtaatcttaactatctatggttaaaataccttacttttgccaatgttaccaaagtgactatgtgaacagattttgtagggctcttttcgaggtttgcaagaagcctgtggttatgggggggtctttatgtttctctggcttccttttaccaccactgtctgcttcctcattctccacttcagccacactgccctctctggtgttgagtgagcatgacaagcatgctttctcttcaggactttgatacttgctgttcgctctgttttgagctcttatcgctagatatctgcatggcttgctgtttcatttcactgagactgctgaaatgtcactgttgtgaggccttccacatctatctcacatagtaacagtcacccttcatgtaacttatacccctgcagtcccaaacctctgtatctttttttcatggagttgatcaacatctaacatgtatcttttttgcttattattttattgtctgtcttcccaccttggaatttaagcttcatgaatgtagagtttttgtgtgttttatacattgctgtattaagcctagaacagtacctaaaatgtactttgtgccataatttgttaaatgaatcatagatgaatgtgtttattaacccatctatgctggaggttgcaaattttttttttttttgtgaaaaatcagaccttggcgatgaccttgagcagtaggaaaataataactcctgtaagcttagcgttccaataatggaacactaggcataaatgggttaaagagaaggatttataggagacataccagattaaacctagatgtttattttaaagcttgttttaaatattttaggttggtgcaaaagtaat

SEQ ID NO: 66768 - DNA, 1068 bp, Homo sapiens
cccatttatagatgagcaaaactgaatataaaaggatatatgacttctctaaactcagagtaataatatataaattaatattgaaaactcaggatttgatcctgggtttagtgcttttactctgctattgtagcctatctaaatgttattgattgatgaccttctagaacttgaggctttttaaatagtgataccaggaaacaaaccttatatgtggcaatagttgcaatatagagcatgattgttttatttatggttttttaattaatgttgaatctaaagggctggatataatagcaatgcttataaaaatttagcactactatgacagccttaggcagcctcagcatggatattgactcagtacacgtctgtgttaaatcattttatgtgactttggtctagaaggtaagcattacttgtacttttaggaattaaattattcaagtgtattgtacttttaaaaccaaaggaaaaataacttatttaatttacattcattcagttaactacttaagccctaaaaaatcgctcactgttttactgtgttctgtagctctctggtcatcaaccgtatttcacagagtttttatcatttgtatgtgtttcttttattgtgatatccatggctatggtttattataatatttagtaattttcaaaaacagaagcgaagaacggtgtctttccttgcatgatatttattgaactcattcttcttgtgagatacagtttaattgcaaggttaaatatcatctttacaatcttgtatgtaaaattattataatactaaaatgtaaatgtaagtggtaaaaacacatttacaaatttaagagtttaagtactttagttttaaaacaatacattatatgttaaattttttggaagaaaatcgtgtagggctgatgcctagcatgatacaggttcttatcatttgttaaattatatggctgaatggcatatgataagggtttttttttcttccaataatgaattacatcatttagtagtacctctcagcagattttcatgaaaataacataagtttaacactgaattgtactgctt

SEQ ID NO: 66769 - DNA, 1018 bp, Homo sapiens
cccaagatgacaacaagtttgattcatttgatttatagctaaggagtctgttatgtctggacagaatggtatgaaatgaggttggaaagatagacaaaagcagattatatttaggatattgtaggctgtggtaaagagttcggactttaagtgtaatagaaaaccattggagacttttaaaaagcaaaaagtgatgtgataggatttgcatttttaaaactgttactccagctgatttgggaagaagtaattgtaaaggggatggacagcagttttagaagatgggggtcagttctcagactactgcatcaaattataagagctctagaaaatttacatacaaatgttttacaaaattcatttaaacaatctttacagataatttacttaaatgaagataaattctgtttaactcctaaaatttatactgattttactgttttaacaaagcaaatttcgtactcattacctggaacatataccttttatttccctgccattctcactcaccccttcttgtttgttttcaacagtgatatcaaggaacaatattttattgtattgggatctgctttatggccaggctggtcttgaattcctgacctcaagtggtccacccgctttggcctcccaaagtgttgggttatgggcttgagccactatgcccggcctacaatacctgtattttaattcacaaaatcaacataaatctttattgatcattttgaaaaataattataataatatttatcagtaggctcttaaaacttaatttttgtggctgtctctttagaagttcatactattatgcctgtgtgcataaatgtatatttatatgtataaaatagtgtcaaaaacatttatattaaaattacttcacttttatcaaatattttataatttcattaaacatttactaataattattcatcctttcaataaaaaagtttaaaaatgactataattgaaacaattacattaactttctagcaaaaaatttagtatactgtgttctttt

SEQ ID NO: 66770 - DNA, 1046 bp, Homo sapiens
agaaataatgtactttgatctggttttgagaaattattgcatattttattttaagtgcttgctgcctctgcctttccccttttgctcctcaaatatataaagtaagtagcctgacctacaggaggactgttaaaaatcatatcactagattaaatagaattaaaaaagaaacaggaagattgaagatgtagtttaatatatgtatcattaataatagaataaatacaagaacataatgggtgagaaatttatttcttaataaaaatttctgagactagacctttcaacatttagttatacatactttaataaaaatctatcatagtaaatttataatttttgtttgagtatgtgaataatccttctgcgcattattggcctgttataaatctttcaatgaattgtgggttggagttaaattcatattgtgctgaatttacaaaatttaacagtttgctttaaacgttttaaaaattttctaacttagcaccaaatccccccatacctttgtgtgtgtgtgtgtgtgtgtgtgtgtgtgtgtatgcctgtggagaaaagttccagagattcttatttctcatttaaaaaaagttagaaaaaatttagctcttatgtataaattacatgctgtattttactaattaagtctatagccttgcttaactttgtcttgacaacttctaaactgaatctttctatttttctaatgccataactgtgtggatttgcaacaacaaagatctgtgtttttcaactttagctgggcttaagtactacttagcaattctatgttctatttacttatgtgttcctatactctcacccctgtccttaagctagtgtcttcgtcattctcagaggtttattcttctaattcagagagggagagggaaggggaagagaaaaggggaaaatttacacagtgggagagggtcagggaaagggagaggaagagagtttagttatatttgcacctgctttcttttaacacagacaacagattgctatgtatgttcttaatattgtcttaaacaggaatctttctc

SEQ ID NO: 66771 - DNA, 1038 bp, Homo sapiens
attgagtgtacctgatgaacaaatccattttaattcatagtcatgttggaaccagatcttagattgaaaacaaattactgtctttttacctttagttatcaaatatctttactcttaaaaaatgacattttattagtaacttctacaaatgtttgtaatgaaaaaaagaattccttagcttttgctttctttctattttgtgttatacagaactgatacttatttcttaagataaaataatcggaaatgttgaacatttactacacgtggagagaagggaaggaagagggagagggagagggagaaaaaagctggagaggattttgtctgcagatgctaagttttgactttttaaaatgctcctgtcaatcctttagaagatttttctatcacctcacatacattttcatgttaaaattattaccagcttgattaccactttgtctgctctttctttattttctcctttactaagacaaatttaggttgaggtcgaatgtaacaccaaattgttatgttcctttttctattctaatggcaaatacttaaggataaaatacagaaatccctatttttgaggagatggggtcttgctatgttgcttaggctggtcttgaactcctggcctcaagcgattatcctgcctttacctcacagagtgccggcattacaggcatgagccaccatgcctagcccttagaattccctattcttgaattaagtttgatgttatttaatgtaatatttataattcagaaacctaaatatttagtagtggaagtgagtatctaaggagttaaacagaattgtattacttcatgactataaatgtgttggttgatgtatttgctcattaggcagaaatgtgccaacatttgaaaagtatgtacactctaaatatttaattatatatttgcaaatcaccttggtataatttttttttttttttgagacagagtctcactctgtcacccaggctggagtgcagtgtcatgatcttggcttactacaagctctgcctcccaggtacatgccatt

SEQ ID NO: 66772 - DNA, 1024 bp, Homo sapiens
tggttaatttatttgtcctagggcatttaaaaaaatgtgctaggccagtactgcgaaaatatttgttaagcggggattcataggtagcctcatgacaagtgtatcaggtaagagaaaaaaagttggtatatccaaattacaaaaatatcagtctttcagtgaatttatccagatacatgatgacaataaactttgcatgtgtttcctcctccctgttctggctttaatgctgtattttgtgtacttactggacatttctgcttagatatttgaagaaattttgaaatgggagaagattttccgctctctgaaagtaagatagtctttgaaggtgtttgaaacttattttataggttatagtgtattataggaggtcttaagcagaggagtgatactttatcttttaaaaatcctccttttaactctccaagggagaaattacactggtcatcttatagatgaactgaggctcagagaagttaaacattttgcctgtggtcaaatagctaggaaattggagagctaggatttgaacccttgtctccaaagttcattgattctactatgcaatataattgccctgaatgtacagtaattcacttacttagactagagtttcctaatttttattagctgtaggtaattattattagtttgacagttgaaaaataacattgcagttaaagtttccaagataatcagcaatgacttttatgcattctaattattactattatcttttcatgttcacagaataatatatggcttaaaatgaataggaaaaaaatacccttcacaaatctattacctcattaaatgtttaactatggtgatgttctttataaagtcctgtataaggagtagctggacctttgtgcattaattgactcacataagctggaaaggagatcatttttctgtgttgaattttgtttttgagatggagtctcactctctcgcccagactggggtgcagtggtgcaatctaggctcactgcaacctctgcctcccaggttcaagtga

SEQ ID NO: 66773 - DNA, 1024 bp, Homo sapiens
tttatatattttaaaaattatctcttttctcatataacttgagactaaagcagaaattggtgttttttcatttggtttttcttaatctcaatttttgaaagagaacaaagtttaacaattctttaccataggaaggcaggatttcaaaccctgcttcttaattaaatcatttagtttctttttatcagctgataccatatatctttcttacagcagtgacagagagtcactgagaacatgtaatgaacaagctaagtgacttctgtagccagtgagttgatttgtctattgtggctctattgtttgaatttttaaaatttttaaaataccagacatatctattttcatttactcaggcatttaaaattttcatatatttgtgtttagcattatatttggagttttagagagattcatgaatggaaagagaaatatacctgcctgttaattcagcaagaatttattgaacagttctatattcctgacattgttttagatgcctgtgatgcatcaatgaataaaactggccggtatctctagccttggggagcttataatctagcctattaatagctcatgttctaattatgaaagaaaataaaaaacatgcacaacaattaggtagtaattgcagttactaaacttcaaaagaataagcaagtatatggattaaaagctcaggtaatttaaataataaagaaataaatgactaattaaagtggggttcaattaattcagaagatgtcttaaaggaggtatatcttttatttttttttggagagtttattaaataatttttttttattatactttaagttctgggatacatgtgcagaacgtgcaggtttgttgcataggtatacacgtgccatggtagtttgatgcacccatcaacccgtcatctacattagttatttcttctaatgctatccctcccctagccctccaacgcccgacaggccccagtgtttgatgtttccctccctgtgtccatgtgttctcattgttcaactcccatttatga

SEQ ID NO: 66774 - DNA, 2016 bp, Homo sapiens
gtagggatgtggcaggtcagaacagagaagatttgtatttaatgataaagagatgtcattaatttcaaataggagattgtacaaatttccatatacctttgaattttagaggattgaagtccatgggaaagattgttaaggtaggttgaagagttgaaggaatttgataaaagtctggtttagtgattttcactgtagtggttttagcctaatggctgggattgaagtcaggttatagtgggttagggagtgagtgaatgagaggggaggatgaataagattttacacatgtatacctcttttttcaggaaggtggtttcaagaagagaattaaaggacagtatcaagagggaaagctcaagggttaaaaaacagtgcatcccatgcatataacaactttcttttcttattgtttaaagtgtcccattagccagtgctgagtgcaaatctggctttaatattaatataatatacatgctagcagtccttttgatataattttcagtaatggattgtaaaatcatcaagtgaaagaacatttaataggcagaatcacagttgaccgtaaaatctctgagactaatgagagcacatagggcattggctaactccagattgccccaattgaaagcactttaccattgcctcgccctttcattttaaaatattttccacaaaatgtggacctaatccatcctacctacatcctacatcctacttgtgagatttttaacctcatttatcattgctaattttgatagagttctgtatatctaatggaatgctcttaagacagttgaaacccttcatttcttgttattttttcactgactgttgcatttaataagtatttggtgttcattatgagaatacagaatgaagaaatacatgattattataactttgaatgccttctataatcttggaaacttattagattttaaaaaccagttttattgtggtataatagccataagttatactcactgaaagtgtgtaattcagtaatttttaaatatatttatggagttatatagccataatcaaatctagtttttgaatatttctatcactctaaaaaatatttgttgctatcacttcccattgctactcccaggcccaggtaaccactaatctttttgtctctttttttccatttccgccctctgtgggtatattgtaatacagttctgacactaactgcccatcaattagtatcagactccacaggtttaagagtttagccctccagaagactgctctcaattcagatgccagccacaaatgcagaacattcatgcttctgacgactgactataaaattggagattcccaaatgtataggttcagtaattctctggaatgactcacagagctcactaaaaatgttatatagttttattataaagggtacacataagacaaggtttggaagggacctggacctaaagcttccatgccctctccctgtagagtcagggtacattaccctctctgcatgtcagtgtgtccaccaagcctcagtgttcagagcttttattggggtttcagtatatgggtgtgattgattaaattattggccatgtgattgaactgtctccagctcccctcctgtccttggaggtgctgttggcctagagttccaaccctctaatcatgtgtttggtttttttggtgaccagtccctagctggaagctatcaccatgagcaacctcatcagcatagcaaagacagtactgtcaccttgaaattccaagggtttttgaagccctgtgccaggaactaggaacaaagtccagatatatttttattatgccacaatctaaactctctttttctgaaaattttatatacatgtaattatacaatatatgcccttttgagtctgccttcctttccttaacataatgcgttttgtttttttgagatggagtctcactgtcttccccaggctggagtgatttcagctccctgcagcctctgcctcccaggttcaagggattctcctgcctgag

SEQ ID NO: 66775 - DNA, 1531 bp, Homo sapiens
ttctgttgttgttgttgttgttttctctgcccttttcccctttctttttctcccagcttggactccagggcatcttattcttggtctgcacaacagatgcagacagaagaatcctctttttctctgtttatggtcagaggactggaaagaagggcccctgtgcgaaggagtctgtgtggaacatcactgttttctttgtgttttgtattctggtttttgttttacttttctggtgggaccccaagtaagccttaatcatgaggccgttcccctgcaatggtagtggtggtggcaatggcaactatgcaggcatttaaaactctgaaagataatctttttctttgaccagataaacgggaaaaacgggcccctgtagcccaaagaatgaggggagaatatctgttagtttttgcttttttcccccctttcttgccacttctccccaaggcagatgcagttgcagaaagtatatgagtgtgtgtggaggcaaaaacaccagttttgtagccagagaattaagataaggggtctaggagacagatagtgttggggaaattatggagaggcagtaggtagagaaaaagatgacctaaatctgtgcatgaagacccagacatccctaagctgagcatgtgtggaactttttcaaggagatgaaataaaaagtttgataactgaactacattgtagaccaccatctttgtcctagattggcttttaggtgacacatatgaggatagagtaaatatcactaaaaagacttgggaaactgaattgactttgaagtcacagcccaccaggtaggttgggacttgtggtttgaagctaacagggttgattgtcaacaacaacaaaaatattaaaaacgaaaacaaaaacaaatccattctccagaggaccaaaagcctttagcatgaccaagagtgtcaaaatgcaatattcaaagtctccctcccctttctgggatacactccaacattattggacataaccacgactcagggaaatcatcaactgttgtaggaaaaacagcagctaacaaatgccattcctaagatgacctggatgctggaattatgacaaagttcttagagcagctattataactctgtcctgttgaagtcagagcaaacacttttgaagtgaacagaaagaatgaagttctcagcaaggaaagtagaaaaagaaccaacagaaacttttaggataggaagtagcaataatccaaatatattaaaatactaaaatacctaaaaatgttctagatgagttcaacagcagaatggaggggacagaaaaaagattaagtgaaattgaagaaagggcaatagaaattataatatctgaacaataaagataaaagacaataaaatgagcacagtgtagagatctatgggatgatagaaaaggtataacaattacgtcataagagacccagaggagaggacaaagaggttggtacagaaaaaatactgaagaaataatagctgaaaacgttcatctttggtgaaagacacatttacagattcat

SEQ ID NO: 66776 - DNA, 1022 bp, Homo sapiens
taccttccctcaataattttgaagcaaatttcagacatcatatcactctatgtaaatatttcagtatgtatccttagaagataaggactctccttttaaaaatataaacacaatgctattcatctcactgaaaaatttttccttattatcgtatttagtcagtgttcacattttcccagtcacctctctctcatttgttaaaatcagaatccagataagatctatatgttccagttagttaagatcttaaatttatttgaattggttggttcccccctcatccctctctctatggtttcctagaaatttattgaagaaaccagaccgtaaagcttctcacagtctgatttttgctgatccttgtggtattctttcttggttctctgtatttcctgcaaatcagtaatagatctagaggcttgattaaattcatatgtggtgtttttttttctcctctcagaaataaatcataattggttttgtgtacttccatgaagagacacataatatctggttggctttgtttgtatgtcttgttagcagtcattggtgacgattacctatcattacttgtgtttattaggcttgcaaaatggatatattcttttatcagttagaatacctgtgtaaagggaaacttgtattcttcaactatttggttgcctttcatatgggaaagataagataaagtcttgatttttctccctttatttaacattattcaaaatgatgcattagtttataaaaatcctcaaaagatgagtaatgatgttttataaatcattattaggaaatcatagatttaaacatattttgtgtgtttcaatctgttgtagttatccttcttttttttttgtgagacagaggttcattctgtcaccaggctagagttcagtggcgtgatcttggctcactgcaacatttgtctcccaggttcaagtgattctcctgcctcagcctcccgagtagctgggactacaggcatgtgccactacattcagctattttttgtatttttagtg

SEQ ID NO: 66777 - DNA, 1039 bp, Homo sapiens
acacctgtaatcctagcactttgggagaccaaagagggaggatgcttgagcccaagagtttgagactagcctgggctcaacatagtgagatcccgtctccacagaaaaaaaaaaaaaaaaattgaccgggcatgtgcctgtagtcccagctacttgggaggctgaggtgggaggatcatttgagcctgggaagtttaggtttcagtgagccttgatcatgctttgcattccaacctgggtgacagagcaagatcctgtctcataatgaatgaatgaatgaatgaataaataaataaataaaatacataaaataaaaaatcatttggaaaggccaaagacagaacagtagatacaaaatcagcacttttctttttaaatcagtcatgtagaaaaaggaactgctttatgatacttttgaatctgatttctaagagaactcttacaaaaatctcatatactttatttaataatcttgtgaaataggttctacttgtcaaattctttcttgcttctttatagattttcctccagacttcaaagctcttactactccctgataaacataatcagcatctctgtgaagtactgtcactgactacttccactttatttttggttgctgtctgtgaggattattgtagataatgccatggaaaacagaaaaccatctggttaaaagagaagtagtggtaatgatggtgttcggtgagagagagggagagagaaggagagagaattttaaacaagaatcaagcaaactttttcttagtttttttctttttcaatggtgttttaataattggaaaatttgaaacttctaaaatacttagaagtcttgaaatttctaagatatttttaaaaaggtaactctctgtaggtatttgttggcaatcactgtgagacaaagttgccttaaaaaaaaaactttaaagtgctaggtaaactatttgtcattaatgttaaggaagctagcattaatatgaaggagattcctgaaggctaccagtatcacagaatcagagcagaaggtccttggaga

SEQ ID NO: 66778 - DNA, 1060 bp, Homo sapiens
ctgctctcaagaggcttatattttaaatctatgcagtgctataatagaattatgtacaaaatgccatggaaatttacagaaaggagcatcttagctttagaaaatatttgttatactctgaattggaaacctagtacagacaccttgtattatgagtagttatcgctgtggctcacatctgtaatctcagcacttcgggaggccgaggcagacagatcatgaggtcaggagttccagaccagcctggccaacatggtgaaaccctgtcgctactaaaaatacaaaaattagctgggcatggtggaactcctgacctccttgtgcaatgcttttacaagtggttaatgtttctgaagagggtaggttagagggagtgttaagaggatggaaacctccttgtattgacctctccaagacggtgcgttcatgtcaaaaactaatcaagtgcagctgcaagattaattgtgtgaggaagctgtaaacatagaaaactatggcctctacccagagctctgttttatagacaagcattcactttagaactactgtcaatgaacctgactgagcaataatttgctcacttgagcctacagtggtagtatttaaaaattactgagcttgtaggggatgaggtagatacatatagatttctagttgaggcatttgaggaaactagagtaggtctgagtaaaggagaagatggaataaaataacttgggtttgtggctaggagcggtggctcatgcctgtaatcccagcactttgggaggccgaggcaggcgtatcacctgaggtcaggagttcgagaccagcctggccaacaaggtgaaactgcatctctactaaaaatacaaaaattagccaggcgtggtggcacgcgcctgtaatcccagctactagggaggctgaggcaggagaattgcttgaccctgggagacagaggtggcagtgaatcgagatcatgccactgcactccagcctgagcgacagagcaagactccatctcataaataaataaatacataacttgggtttgtaaagccattagagaaatttgcca

SEQ ID NO: 66779 - DNA, 1079 bp, Homo sapiens
gtctttgtaattggcctctttcacttagcataatgtattaatgtatttgaggttcatccatgttttagtatgactgatattaatttttgaatttaaaactttttttaaaaaaagtgaaaacagcaatttcagaattactcatccttctgaagtatattgccccatggctgtgaagtggtaatgaattatagagaaattttttcaagttaaaaattaccatgtattgagcatctatgatggtgctagtcacactattaggctttatgtatgttacattatatataaatccttatggcatatgtaataggtagtattatattgtttctacaagtgaacaaattaaatgatatgatcattgattttttgtgtcaatttacacatgaaagtgtaaagtatatatatgtgcagatgtatactttgcagctaaagttaaaatatgtaaagtgctaaaacattgctgtaatacacagtgaaaatgtcattcactgtctagagatgtccagtagaactttttgcagtgatgagaatgatctatatctgtcctgtctgttatggtatccactaccacatatggcttttgattacttgagatatggctagggtgaatgaggaaacaaattttaatattatttaatttaattaaaattaaattaatttaaatttaaataaccacactctgattccagtcatgatttgatacccgtgatagatttgctcttccagttggagagtggaagcaacttgatcaaaaacatgaacaaagtctatgaaaaaatggtatgcaagatcctggatattaagtattgaaggacagtgttccctgagatataggaaacaaatgtgctctacagttacccaagcttactgtctagagagaatttccaggcatggatcaaagaggcgtcactcagacaaaacctagaggactttctgagttgaggaaataaagctcaaagtgtaggcggaccatgctggatagagttcacagaacaggggactagagaggaaagtactcagctgattactgagtagggcttacatgtgaggaaactgctccaggccaaagaaggaacaatctg

SEQ ID NO: 66780 - DNA, 1061 bp, Homo sapiens
gggatgagccatcgcgcctggccaaggttttgttttttcttttttaatcaccaaataaagataacatctgtgagttgtgggtaacctattcatgtagttggagttcttgaagcagaggagaaaggagaagaaaaaataatgatgaaataatgactgaaaattactcaaatttaatagaaactgtaaacccacagatccaagtagcctaataattcctactacaggaaatattttgaagactaccccaggcacatcataacaaattgtgaaaagacaatggagtgacatttgtaaaccactgaaacagaatgatccatcaacccagaattctatacccagcaaaagtatctttcaaaacaaaatgaaaaaactttttgcagacctacatttttaagtcaaagtgattaaaatatgatgaatttagatgtatctgtacatacatgcactatggatgacaataatagcacaaaggtcgagggcagaaatggaaatacattattggaagatttgtattctatgtgttaagtagtataatgtcatttgaatatagacaatttagagatgtgtactataaaccataaaaccaacactaaaataaaccaacaaagggaataaaatggaattattgaaaaatactcagttactgggggcagtagcttatacctgtaatcccagcactttcagaggccaaggtgggcagatcacctgaggtcaggagtttgagaccagcctggctgacatggtgaaaccccatctctactaaaaatacaaaaattagctgggtgtggtgacacatgtctgtaatcccagctactggggaggctgaagcaggataattgcttgaacctgggaggtggaggttgcagtgagccgagattgcaccactgcactttagcctggtgacagagtgagagtccgtctcaaaaaacaaagcaaaacagaacaaaaactcagttaatctaaaaggggcaaaaaggaggggaaaaaacagtaagagacaagtagagaaataaatagcaagatgatagatttaaacataaggataccaataatcacattaa

SEQ ID NO: 66781 - DNA, 1903 bp, Homo sapiens
atgtctcttttgaggatttttacagtatgttattttggtatgtagagctctcggaaagttctttttttaaaatgtcttagtacattaaccatactctgaaagaatttagcctgtaagcttttaggctatagccgataagcctaggtcttctcatttttgaagctggaccattctgcctcgttatagcaattatcctgtctttcttccatcttattattgtttaaaaacctcttatatttattattctcagtgattttatttattccatccaaagctttggacctctttcttcactagggctaggatactgtagtagaaatagaatgtaggatttagattaaagacttagattctaaatctggtttctttttttattagctgagcaattctggacaagacactttgctaagcctccttttcatctgtaaatctgatgttgtgaggattaaataaaataccatacagatattgttattacctacccgtgtttatcagagatcttttcttttcagacttcttgacaatatttgacttcaaggatattatacttgtctagtatcctttattatttgccatttattctttttatcattttgatcttttctttcctttatccattgatattcttggttctaccaatctttagtccatcagactatggttataaagaaaaatagaagaaacatattgtattgctcacaaaatgaaaatcatcacttggaacctgcacctagatttgtaaaaactgaactaataaattcagaaaagaatctcaaacaccaagctggagaagggagaataagacaaattgttggaaaccagacccaagggaaagagagaaaggaactgaactacactgaatatatgtcatgttcctggcattgcttttgttagataattgatatattactttatattatgcacagcaaaatctttataataaatcttttaagggaaggtctcacctattttatagaggaggaaattgagtaacaggcatattaaataacattctcctaggctatttgggtccttattgtttatttgcatttttccccccaagatcattgttttggtaaacattgtttactttggacagttgagttatatgctaattatgtaggtagagttggtctcaagtatgctagcaaaaataaatgaaacttgagtgtttttaaacaaggataccagatatgagatttatgaaatatattttgcactgtttcggaaatgtatttctcctgaccatcctttagagtgggttgagtgggtagagtgggtagtagtaataattcaggaagccattccttcctaatctaggtatgtcgacaaaactttcaggtctgaaggctgctgaacactaaataattctaaataaatgaaataactaaataactctagctattctgccatctattccctttactggtaggcaaagctaaattggtaacttaaatctgtgaattatgccatgactttcaaggcgaaatccagacgtatttgaaatgtcttcacaaatgtggcttataacagtctctgccctcttccctcaaatgttttctctctgtctatacttttctgcttataagctccttactgccctattctcatacatgtctttcttgcgttctactagtacattcctcctttctgagattctttttcagaaagactaaaatatgctaaatatcttcttgtgctttaggagtcttacggcaaaaattctgtactgactcaaggatacaatacttagtaggagtgaatgaactcttgaaaaatatattttcaactccatgtcctcatattctcatattaaagaagattaaacaagataaatatcatttgagccaggtgtggtggctgatgcctgtaattccagcagctcaggagactgaggcagaag

SEQ ID NO: 66782 - DNA, 1020 bp, Homo sapiens
actcatgtactatgcactgtactaggcactggggacacatgcagacaaacacgtttatgtattcacatatagtgtaaaatactaattgatgtgttgtagactatcctatttctgaaaccagtaccagaaagattttaaatattatcacacttaaagtgaaaaaagttattgtgaaaaagactattgatagtattttatgaagaaaaagaaattgtgctttgaattttcttaaatataaacaaatacagttgatcttcaacaattatatacttggcgtgtatggtagactgtgttattgttcaaaaacctttgctgcccctccctggagaaactttatacttcccttccctattgacatcatgcctggagttacgacatgttttggctaaagaaatatgagtggaaatgatttatgtatacttatgagcaaaatctttaagtcagaacacagtttcctatgtttgttctttttctctgctgtgacaatcagcatttgcagataaagtttctctgttaccctaaggtacaaaatgaagatttcacgtagttgagccatagctaactcttgtttgacatgtagcgtgagcagaaaataaactttttttgttaaaaggcattgacattttgttactgcaacataacttagctcagtggttttcaagctttagcatttttaagaatcctgtggagattttgttaaaacacaagttgcagagattgttgggccccacacttagaatttctgaattcaggaggtctggagtggggaccaagaattatatttctaaagtgaaaagcttttatgaaggggaggtggataagagaagccagcatgaagtcttgaccaatggtacacactcaggcaaatcatgtttagataggagaacatgtggaagtgagcaactggacattggttcatttttttttttgccttttctttttgagttggagttttgctcttgttgcccagcctggagtgcaatgatgcaatctcggctcactgcaacctccgcctcccgg

SEQ ID NO: 66783 - DNA, 1247 bp, Homo sapiens
aacggaaatgctctcccctctactcactagtgtttctgatcagattaccaaattttacctctcggagaggctcttcttaaccatactgtgtaaagtaatgaagcctgactacgtcactgtttctccccttatcttggaggtttgttttttgttttgttttattttgtttttttaccatacctgttatcactatatgacatatttacttttttatgtatctctttcccaactagaatgccagctctatgaaaccagggattctttattgttcacagttatgtccttagaacctaaggcagtgcttatacatagtggccatttagttaatatttatcgaataagttggtgagccttaatacttaaatggagaatgtgatttgatttacactataataatcaaatccatagaataatgaggaaccttcaaatggagtctgctttgtttaaatctttatattgtattttcaacattgaacacggattacaattgtgtttcatagttaggttaatgctcatacaatactcttagtgtcaaaatgtgggatcatattactattttaaagattctttttatgggaataattacgtttttgttctttggacatagacatctgaccctcaattacattaacaaaccttatacacatgaatggaaagaagaatagcctcttttgaatccatgctaagactttatcaatatgaagtgcttcccacagagttctgctgaaagaactgaacttccatcataatgaaattgcaaattcatttgtatatgcccctcttatatttgaaagctactttttgatgttttggttggcaattaaatttattgtttaaggtcacaaatatgcaattctgactagaacaagttgtcagaattctttattcagcatagcacaaagataaatggctgtcttttaacaataacatatgaaagccaaaatttgttcccagttatacataatcttttaatcagtctactgctttctgttttccagtcaatagaccccttaacctgcttcctcaccatcttacctatctagattatgggtttttaaattactgcaaaacacttcatcagatggaaaaagataagtttaaacattttgatgctataattttcccatgcacattttatccttccatctgaattcttttgcctttacccctattctgtgtaaggtggaaaattatgtagtatgttagctaaattctatggttacatttctcactgttaacatgactag

SEQ ID NO: 66784 - DNA, 1051 bp, Homo sapiens
atttttctatgaaaataatccctactcatgctaatcattaagagcagttttctgttaacattttcaagagcatttggttttattaagtagtttttggaattttagtgcttttgtatgtaaaactcatttgtggtttaggaatttaaaatcctgattattgtcaacaaaatgtcaagaaatggaattttggtgcataggcaagcttggccagtgcttgtgagactttttaagtctttgtaaatcaaagaaagtaaactcattccaagatttcactcttatttttaaggtaattgttttaaaattattgtttgaggttttaaggctttattttgctgtgctataaacttagattaaatttgttttgtcttgtttctattttgagatggtaaaattcgtattctatcaaaaacttcaaaatttgtttgtaaatcaggtttttctccaaatttcctctagggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaaggtaaggcttttagaagaggaaagaaaaatgggaaataaataacattgctattgttagaatgagagatggccttagttcacttattttttaatgcttctttctggaatattcatacatatcttgacataaccaaatctatacaatatattgggaagtgagggtacagaaatttcttcttttaaaatattatttaatatactcgagtgtgtagacatgtttgcatttacatatggtattacacattgtcagactcattttctttttcaatatatagacactcagaaaatatgaattttttggatatttccaatatcaaaaatgatattaatatgcctggcttatttatttttttatcatatttactgcctggttattaatttaaatgtatttcagatctttctagctgaaataaacacttgatagaatc

SEQ ID NO: 66785 - DNA, 1048 bp, Homo sapiens
ctcaaaataatggccaatgtatatttatcttgtttccaaaatagattataacttggtatatatcttacaaattctcatatatcccagtctcttttacacattatgtacatttaatcctcagtatatacttttggattgatttgtatgtaaagtatccaccttatcatttcctttgttgctttgctctttggttatggtagcttatatagatcttgaggattctttttatggcaattcagttgggatataatttaaaaagagtcagatttacttagcaaatattttaatgccatgttctaggttaggtactgaagatcatgcaaagttgaagaagagaaggctgttgccacctgtcagtgacttcttttgagttctcatcctatttatattctttattttgtggagaatagtgcccggcgtgtagacaccattaaatgtttactgaataaattaataaaggatgaacagatctatcagggaagagaacacatgagcactgtacagaaagcattgaagagtaaatatcatttaaaaagcagaaataaaatgctactgaatttacagaaaagtactactacttgaagctgggatttggagcaaaactgtgagggaaagggaagggctgacccttaacatcattatgaaaaatgtgacatcgtttgagctctgaagggagtattaggattcagaaaggttgtaggcagggagcacaatgctcaactatgtttttaatgctgaggttttttctttataactcttgtcttatgcttgttttgcagacaatgtatttcaaaggcattgaagcagggaaggttccctattttcctcatgcagatactatcatctattccatctctacagcaatttgcttccaggcagtaagtataactttttgaaatgagaaattgaatgattcctgtttctaatgtacgttaatcaaatgggagagaaacaaactctgggaacatttctatttacagtattacattttaagcttcttttttgttttgttttgtttttttttcagcaagatagcttaccagcttct

SEQ ID NO: 66786 - DNA, 1128 bp, Homo sapiens
aaaatgtacaaaggggttagatagcttgccagagtcactcagttagtaaatgaaggagctggaacataaaccaggcagtctggcttcagaactttccctcttatccatgtcactgtagatcctttacattgttattgtttaatcattttttgtcatttagttttctgcacattaataagttttactaattgattattttggaagggaacttactttggaaaagtactgaaagtcacatttataggctgtcagaataatgctggccagtgattcaaaactaatttcattcagctgttttctccagaaaggaaatgcttgtgaataagcacagagacccagaaggtctatcctgtacattagctaaatttgtgtgtttaaaaaatgttatatatcttaggttaggtaatggataacgttagggtatatttttactgtgttgtgtctattaaacatttgaaaacctatatgctgtttgccttttagtcattaaatgtttgcacatttgaatgtgttttcatttgatggtgagacattatgatgtcaattatgagagaaattacatttaatgcttttgcctcattggtaatgttagctcatttattgtttagtttcctgtgaattcattcatcataaaaataataatgaacctaattttctatttgatacagtctagtggaaagaattctagaagggtttaaaataatggttgtaatctctgcggtttcagatctggggattatctctttaatccttaatcctaactggattatctctttaaataaaatatgagacagtgtatctcgaagaagagccttcatgtgacttgaatctgccattgaatttagatcctttgccacgttagccttttctgttttcccatcccacataagataagtcaactaaaatgaattattttattttataaactatattaatatttgtttactgtattctttgttttacagatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaa

SEQ ID NO: 66787 - DNA, 1050 bp, Homo sapiens
gggtaacatgcaaagaataatggagcaaagaagaaaaaatagaaaatgggataatcctttttctactaaggggtaaccatgtgtgttattcatcttcaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcattatggagtttatgtttacttcagggaattttta

SEQ ID NO: 66788 - DNA, 1051 bp, Homo sapiens
catataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatgagtttttctttcacatgtctgttgtttccattgccccctttccattttctacactctggcatgcagctttgtcctgtttcccccatgctatggattagcctcctgccggtaaccacctgaggggttcttcctgcctgctgcataaagaaaaaccatggcaatatagtagagaaagagcttaagagacactaggctggccatgccacgtgggggatggagttcatattcaaattatcttgtccaaagctcataggtag

SEQ ID NO: 66789 - DNA, 1114 bp, Homo sapiens
ttcttccatgccagtgacccagtgaaatctatggatattgcaaatcaagtcatcccagatccttgcttaaaggatttcttattcttcagaaaaaagtccagatcccttaccctggctctccatgatctgacctataactcaccttttagcctcatggtccatcccctcattctcccctcatgctgctgctgcacagaatgcttcatgggccctgaacatgatcccttacatggctatgtctttgcacatgccactccctttcttgccaatttcctcctcccttggtccatatcactaagcaactcctcctttggagtgctttttctgagggctactttctcctgccctgccaagagcaccagaagtccagggacttctctccaaaatagtacttaccattttcatctttacaagatggcatcaaatataaggcacatttcacataaatgtgaaaatatgaaaaaaaaatgggctaaccagaactgattaaatatggtattataattttctgtttacttccttctgccattagaccttttgccgacaagtgtttaatcactcacttctgtaacttagttcctaccacaatgtctggttcgtattaggctcctaggaatttttttccaattagcaaaagagatattatgggtgatgaaccaggtggtatctctagagtattcagatatgatccaatatagaattaggaaagcaagtctttactactcctaaaatcttgggagctggatatagaaaaagctaattttcctatataaattttaaataaatttagaaaaagtaaattatttactaaaccctgaatgtttgaggcttagtgtgggaggaacttttacatacattgtctaatgtgattgtcactaaatccctgctgtagatgtggtcttcaatgtttggagatggaaacaatctcagaaaaggaaaatactttgtaagatcaaactacatgttaagtgacagagacacaattcgaaaacaatactcatacctcaaagtctttagtctttatattatgttgctttgcttctttcctattcctctcaatatttcccaaaatgtgagatgtctacaagagatttatgaaaagaaaaagcactaa

SEQ ID NO: 66790 - DNA, 1033 bp, Homo sapiens
aaactatagatgagattgcttcattttaaaataatcttattttttgactgtaaaaggaaatcatatatattttaaaacttaaacattccagaaatatgcaaaatgatcagagaaagtttaccctaatcttattctgccagaacaaccactgatgacaatttgtggtaagtgcctgcagatacgttaacatctaatgccattagtgttgatcaatataagatcacagtgcagtttttttgtaactttttttttaacctaacaatgtgtcttgaacatctttctatatcaataatatggacttctcacatatattttttaatggtttaggtgtcccattaactagatagatcataattcatctcaccaatttttgattaataggcttccgccatattttaaaaattttgacataatgaacaatgctatactgaaaaacttttatcacatttgttgcattatttttaccatattaaatgatttttgtttaggttccaagcaggagaaccaggagattgttggataaaagcagaacattccatattacctgtggtgttactatctgtattttctcaggtgagaaagccacaagatattaaataatttgttagaattacacatttaaatgtaaacattccagacatacacagaatgatcagagaaagttttccctaatcttattcttccagaacaaccactgatgacaatttggggtaattgcctgcagatatattaacatataatgtcattaatggtgaacaatgtaagattgtcgtgtggtttgtgttttaaaccacacgtaaaattacacatggaaaatgtgtgattttattgttctgtacattatctgctgtcagcaacttaggattttcttattaaatagcttagtagttcttttccatgtttttgaaaagggttgtctacagggaattacagaaaatggatgtgtcttgtgatttttacattatgatatccaaaagttggcccccaagctgataatgactatttcctgaaagtaagtaatttcattccagta

SEQ ID NO: 66791 - DNA, 1012 bp, Homo sapiens
gttattattctcgtaataaaattaaagagtaaaaaaaatacatacgaattgatagaaaaaataagatcttaattgctagaagataaaatataacattgggattaatatgttttattgggggttctcatcatgattatccttccccagactggtctgatccagagtggaggcaacgtggtcatggctggtttatgcctgagttaatgtgctaatcagactgtgcacttcctaggagatgtttaattgtgacatgtcatgagttttggaatcttaaaattagctaagaggaaaaaaaaatctattgagagaagccaaaatgaacaccgaaacaagcaaaccaacaaaccaaacaatagcctgctccactcccccatggcaaccttttaaataagtcacttcattgattgcttaagattaaatccattttcatttatttattttcaagaatggaaaatgtagttgcctgaactttatagaaattagtaacaggttgtgttcaactctcagaaatgtagttttcttttctttttttggaaatattggagcagtttaactcaaaacaccatttataggagctcttgaattcatgtttacctgttttgagttgcgttttttacattttaataattaaagaatatcatgtaattcccataaacattttaacttgaaaagagaatgattttatgatatcagattcaatgtgtcttagttatatatatatattcaatgtgtcttagttatatatattatatttttccctccaaactattcaatttcaaactagttattcacatggtgtcaggataagattttaatttttattttgcttttattcacaaatattgttttagatctgctgcatgatcttgaagctttttttaaacttttattgaaatatctatgctcttgagcattcagattctttctagtgaaacactgggattatctttctttagtcaatcattatccattagaaacattaactaatttaccctctcaagagtcctagaag

SEQ ID NO: 66792 - DNA, 1052 bp, Homo sapiens
ataatgaagtgttgaatatctcatgtaatttattgaatactacactgaatatgaaaaccagagtggttgcatgggtacttgaagtatggtttctacttaatgtgtattgcctttgcaccatcataacgccgaaaaatgaaatctaaccatcgttgagaaccatctcaaaaacctaaaatactatatggaaatagagctaaacttattttatttgactttaacagaacaaactcaaagagaaaaatattacaggaaaatagatgttaaatctttatgaagaaaactttctaataattagacctttcataaagtgaaatgagcctcctcatgaagtagtaagcttctcatcactaaaagattctgagactggataactatttatctgagattctataaaaaggattatgtagaaggttgaactagataagctctaaaattccctttaagattctacagtttgaagattttgttagaaagagttcttttttaactagcctttaccattttccctcacagcaaagcaataaacaatatgaaatttatttttctaatatgtattatacctattattaaatgtacaatcttacccaaattccctagagtgtacatatttgcctttcacccatctaatggcattagtttaaagccaactttaggtatgctggttttggtcacagtgatgtatttggcgcctgttgtttccttacctatagaacagctttcctggtaaaccaagaggatcgatgaatgctctttccaggagcatcagttggtcattcatcattctcactgcaatgggacttcgagaagaacatatacataattataacgcaaaccgcagaatcatgcttcaaaaataatattaaataaaaacaaggcttgggaaaatatatttctaaaattgatcaatttttaacaaaatgaatattaacacagtaatgctttacatggtgagccacaaacagcagagtcatctttctaatatttacagtcagcagagagacctattggaaaatcgtttgttatatttttttacatcacacaccaatcaa

SEQ ID NO: 66793 - DNA, 2881 bp, Homo sapiens
agaaaatccaaaaatcatttgttctttattaaaatgggaagaaagtaataactggtcagatttttttcttagattctgatttgtagaaaataaataaggtttctagtgcatgaggttaaggtgttgtctgatttatcccagtaaacaaatgtctttcatttcagtcttcaaagaatgttttgatgacagtacttagtaggttacagaatgttaaattggattaaatttagtaggagttcttaaattgtctttttagctgtgtatcaatattatggccctgaaagaaaaaaacaaagggaaggagtaagtgtgttctgaaatcataaaatttatgaagaatctttgtaccatgatatattttcttgtttaagcctcttgggaaatatagaagttttttgcccttaaacattaagtgcttagttgttgtgcatggtagttttttctcagatgggtcaaattcctctttttaagaaattaattatgtggcacttttttaacttacagagtttctcttacattacaggggaaaaaagttgttccatgtagacatgactggcatcagactggaggtgaagttaccatttcagtatatgctaaaaactcacttccagaacttagccgagtagaagcaaatagcacattggtaagtacatcttataattttgggtaaaagttcttttctatacatcattctttatgttactgtattttaaagtattgtttatatctcagctgatttgggggtaagattttataatgactcccattaaaaaaaattaaattacttctatgaaactattttaaatgaaaatttctgtatagtagacttactgctgaaccattctggagatactgtagtagatttatcaagtaatatagtacttagttctcaatatgaaacttgaagccagttattcttttttgtcagtggcttttctcatatgaaacaatacagtattggcagtttcttaaaatagcttaattcatttttgtcagtcttatttttataatcagtgtttgatagcataaatcttcagtttgaattagatcaattaactgtgtatatctttttcagttaaatgtgcatattgtatttgaaggagagaaggaatttgatcaaaatgtgaaattatggggtgtaagtattacaaatttataagaattttttttctgataacttagatcatttgtagaataaaagacaattcttcagtaaacattgatgcaaagtatagatgtataacttaacagtgtatcctaccaaaaagtttaagactagatataaaagaggcctttagaagcttggatttgggattattggcataagcaagtctgatgttttcctctgagactaataaaactactgaggtttcctgtaattctctttgatatgttacaggtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattcttacaaagaaaaatttgcagaagtactattttcgtgaataaaacatatgtatcattctactaccattagcaaataacttagttgtagtta

SEQ ID NO: 66794 - DNA, 1032 bp, Homo sapiens
gtcattgtgatataaactgcctgtttttcttcatattctgtatttaaaagtgatgctatttgggctaaatgttttgtttgaaggactgtcctacacattgcagggcatttagaattttgggccctggggcactaagacaacattatcccaagacgacccatatttttccgcatcctgcagttgagagcctctcttctgtattatgctctagtttatagaaatgcagcactgtgtaaaaatcttccactctgtttccacattcttcctgatatactgtacattcatttttagtaacttagacacttgtaaaatgctagagtttgtacacttactggcttattaaaaatcagatttatccctaaaatacttgtggatttaattggttgtgagattttatttctgaagtttttctgtgataatttaaaggatgaaatactggagctgttgtagaagaaaaacttctgattttaatacattcttagcccaagagggctgtacaaaagggaaacacatgtggactaaaaaagatgctgtaagtaactcttccaaaaatagcacactgggtttatattcatctgagtcattttttaaagatttgaaattattctgtctttagattttaaaaaaaagttttcttttttgcaccatagagctttgatgtgactacgaaataaaatgaatctgagtcaagctgccagtgtactgccttttgagcaaaatagccattgtctgttttgatgcaagcatgtgaggttttgtgaaatacttaagcctgacaaaattgaagaatttttgtcttctttaattaataaaattagctccatggcctcttcctactttttgttttttaaaaattacttttctatgaatttgatgacgttaaacgtttagacctctgttattcttttggccacttaaaacttcaatcatttacagatgcacaaacactccatctagtggccagagaggaggattgcagtcttgtttcagtggaattgttttgaatgcctctgcttgctaatgggatattta

SEQ ID NO: 66795 - DNA, 1005 bp, Homo sapiens
taattaatctttgttgttctgaaaatagaatgcttattgtgaaattaaaattaactaaagatagttactatctttaacttaatagattttaaaagtaaaatacctatacttattttgaatattctttaaatatgatagttttaggaattataacatgtttttcttctaaaaaaaaagcagacacgattgttgaaaagagaaacagtttttgttttataaaggtgcttcccttgatgatagggcatagcacaaatcactttaacattggttaattggctttttaaaaatcaaagattaatattcattttacttgattaggtgaattatatgcaacactgaaattttgcactctatacgcaagttactgcaggattcaagtagataagtgcaagtagagtgttttagtgggtcgtgtttctcatgcaaatagagtttttagtttccttctcttgtttttcatagggttggtcttgctgtaagagaagaacaactgatttttctgatttcttaagcattgtagtaagtactaattattttttctagattatcttcctaaaaatacatgttatagaaagcttcagatttgaggagtctgatttctgatatagattgattggtcttcatcaacttgcagataacacctttcaaaaagcagctcatctcccttccacagcttgtaaaataaagaatctgttttggaaattaacgttttaaggtatcagttacctgcttatcattttaggtttgttctttctgttatgttgaaagaacatcaaggagaaagtggtaagcaacaatttaaagccttttcagttaggaacgataaagttttatctaagatgctgttgaaatattttacataccacttttatataaaaccactttatataccactaagaaaactaaagctactaacaaactgataatgctattgattgtatcatttcagaggtgttaaagagtatgtataattcagtagaatgtagtagaaaagtagctaacgtt

SEQ ID NO: 66796 - DNA, 2352 bp, Homo sapiens
ataatattttaggtttcccagtgcatgtaaaagtcataacctattaagtgtgcaatagcatgatatttaaaaaatcatatatatcatatttacaaatactgtattgctaaaaatgttaatgattatttgagcctttactgatggaaaggcttgcctcaatgttgatggctactgattgatcagggtggtgattgctgaaggttggagtggctgtggcaatttttaacaagacaacagtgaagtttgcctcattgactgattcttcctttcatgaaaaatttctctgttgcatgtaatgctgttcgatagcattttacctaagtaggcctttttttttttttttttcaaaattggagtcaatcctctcaaactctgctgctgctttatcaactaagtttatggaacattcccagtgtgttacttacctcaactcttagcttgttggggacggtaaccgggacccagtgtctgctcctgtcaccttcgcctcctaatccctagccactatgcgtgaatgcgtctccatccacgttggccaggctggtgtccagattggcaatgtctgctgggagctctactgcctggaacatggcatccagcccgatggccagatgccaagtgacaagaccattgggggaggagatgactccttcaacaccttcagtgagacgggtgctggcaagcatgtgccccgggctgtgtttgtagacttggaacccatggtcattgatgaagtttgcactggcacctaccgccagctcttccaccctgagcagctcatcacaggcaaggaagatgctgccaataactatgcccgagggcactacaccattggcaaggagatcattgaccttgtgttggaccgaattcgcaagctggctaaccagtgcactggttttcagggcttcttggttttccacagctttggtgggggaactggttctgggttcacctccctgctcatagaacgtctcttagttgattatggcaagaagtccaagctggagttctccaattacccagcgccccaggtttccacagctgtagttgagccctacaactccatcctcaccacccacaccaccctggagcactctgattgtgccttcatggtagacaatgaggccatctgtgacatctgttgtagaaacctcaatatcgagcgcccaacctacactaaccttaaccaccttattagccagattgtgtcctctatcactgcttccctgagatttgatggagccctgaatgttgacctgacagaattccagaccaacctggtaccctactcccacatccacttccctctggcgacatatgcccctgtcatttctgctgagaaagcctaccatgaacagctttctgtagcagagatcaccaatgcttcctttgagccagccaaccagatggtgaaatgtgaccctcgccatggtaaatacatggcttgctgcctattgtgccatggtgatgtggttcccaaagatgccaatgctgccattgccaccatcaagaccaagcgtagcatccagtttgtagattggtgccccactggcttcaaggttggcatcaactaccagtctcccactgtggtgcctggtggagacctggccatggtacagagtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagacatggctgcccttgagaaggattatgaggaggttggtgtggattctgttgaaggagagggtgaggaagaaagagaggaatactaatccattccttttggccctgcagcatgtcgtgctcccagaatttcagcttcagcttagctgacagacattaaagctttctggttagattttcatttggtgatcatgtcttttccatgtgtacctgtaatgtttttccatcatgtctcaaagtacagtcattaacataaaaaaaaaagtttatgttatattttagatcatttgttggcatttcaacaatgttcacagcatcttcactaagagtcgattttgtctcaagaaaccacttttttttcccatccagaggaagaagcttctcatccattcaagtttcattatgagattgcagcaattcagtcacatcttcaggctccacttctaattgtagttcacttgctatttccacatctgcagttacttcctctaataatgtcttgaatactcaaagtcatcaacttcttcaaactcctgttatggttgacattttgaccttctctcataaatcactaatgctcttaatgaca

SEQ ID NO: 66797 - DNA, 1086 bp, Homo sapiens
gtagcatgttatattttcaaaagggcttgatgaatactgtttatctctttatttatgtgagaaaaaaatttcaaactctaaagagcagtttcagcaactctacaagaggctattgtagtaaggagcagtgctaaagatgcttgttagaaaaacaaattataatcagtgcaaaaacttaatggagtgggaaataaatagagcaaaaagcatttcctcaaaaatatctttagataatttttaaaggaatcaggatttcagtagaatttttttccggtacagacactaaacaggcttttaatgacagttgcaatattcaatgatgatcctaaacatgctgtgaagataaattccttatcccataaaaagttcaattctccctgtgctggagcttttctgatgatattacactacaacccaacatctatgcacagagttcagtagctcgaatatgaatactattgcacttattaaaaaatagtgacagttattacaaaggaatatgttttaaacaatactttggatgttgcctatagggtattcagaacaatttcctgctggtttctggtttcaggacaatttcctggaggcttcaattgttttagcactttccagattccatttctttgggcaaagggagaaatgggggagaaaaatggtacttattacaagagcaatcttgaatgctcagctgcaattgaaaagcctagtatgaaacaagactctatgactgtttcaaagtaaggtaagatttatgtgttgttgaagctcttggttaagtactagatgagtattatgatatatttcagtctcttgtaaattacatgatctaccacacgagctttctgtcagcacttttatttattgaccgcaatgtaagaaccgtcacatgaagcaaaaagtcatccacaacagataatgattacatttttctgaaatgatacaaatattaactcttggttgaaccatgatgctaggtttcttctcattccagtttttcttccctttttaaatagataactaaggtcaatttcattctttcttccttctgctgcaacagctaggataattgcttatttcactcattcc

SEQ ID NO: 66798 - DNA, 1104 bp, Homo sapiens
ctaaatatgttaagtcagaggttcttaagaatatccaaaaacattaaccaattacttattcacttcctgacaacttaaaaacttctcatcctggcttctttcaagtcttctttcttctcaatgtatgctacacaacatgtgctaaaattccagcacattagacatgttccaaacttctccccctgctttacgggaaacaaattccttatgttatggaatttaagatattctctaatatgatctttaatgtaaattccagacttatcaccgcctttaccattgcacaagtccaagatggatttttgtgcattccttccttttccctgcttcttttttaagtaattctctagcttcaaacttaattctaacatataatcaagtaatatccctctcctcctgactttgccttcagtaacgcctcgaatatacttagtgcagtaatttttcataaaattaaagaagcaatttatcaagttcccaaaataaaaattgttaaaatttgtttggaattttattaaatttaaaagttggtcttttgatgattaatatctgtaaaatattaattcctgttatccacgatggtacatgtccctatttgttttctttaatatctcatcataaaatgttttatttcttcctgcagaagtcttatagtttattaaatatgtttttggatattatgttactactgtacaaaatattttttctttaatattcagcagttggtgtaaaaaatatgctgttactgtataaaaatgtatcatttttatattttaatcttatatccagccagcttgctaaatgctcttattacatttaataatatacgtatggattcttttaaattttctaattgagaggtcataacatctatagctacataagcttctgtttccttctaatacttatgtttttaatcatagtctaggactgctcacacaatgttgactagaatagtgataacatctgtcttaaccagggttaatccagaacaaaacaaggattttaattgcggaaaaaatttcagggaagataggcagaaagctaatgagagtaaaatatgtaaggagaggaaggcaatacagagggtacttccgatttttg

SEQ ID NO: 66799 - DNA, 1026 bp, Homo sapiens
ggtgagcgcgaggattccgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcgagctaagagagccgcttgggttgctcgggatgagaggaacaggggtgctcccggggtgtgggtgtgctggcggtgacatcctgaggctgcagctcgctggaataatgggctcaaaccaggcggtggagaggggtccccggaatggacgtcgggggcggggaggctgcggagaccctgcgaggtctccgtgaaggactaggaggggctcccgggagggagtggcgcctgcggcccggagcgtgggcggccggtggctctggcacgcggaatctggtggactcctagcgcctcggccgggagctccagctccatcccgccgccgccgcgcgcccaatgggactcagcttcgggtttgggcgaacctgcagcagccgcggcgggagggagggacgctgggaccgcggtaatgattgaagtctttttcccccctctcccctcctcccgctcctctccgcccccagactctggcgcgtttgttttccaagttggatcccacttccatttacaagtgtcagacaaacccgcgagaacctcccccaacccgccccggccccagccagactagggagggcgcccagggggagggggcgagctgtctgggcagtgcctggggaggtgcgacgcgcccacccggggcttgagcggctggggttcctgtgcgtgggtccttaatgtttaaaagatacacatgaacagcaacaaaacccaaaccactcgtggccacttgttttctg

SEQ ID NO: 66800 - DNA, 1078 bp, Homo sapiens
ttcacagttggaggaaagatcctctaggcataaatacacatgctctttattggctgatctgctcaagctctggatctttcctgtatgttctaagcaagtgttgggaacacatcaagagggcatgttggatgcatccaggtgtccagccgcctttcagtagcatcactttgtcttcaaggaatgtatgataagggtgttatgtacctaatagtacatttgcatggcgtttgatgttcacagtcgaaggtaaaatagactgggaggtaggagcatatctcagtgctgagttctttgtgtctcaagaaagcatagaacacataagtaagaatgttattattataagaatccttggagcctttctcaattctatttaaaaattaaattattcataaacacctgtgctgtaactattattacactaagttacagtcaacacacctcataagggattgagtctttccagtatattctgaggcccagatgcccactggggtatgggtcactccatagtgaccattgtgggcaagaagatctttctttaaaagttggaggtacagtttctggtacataataatgcttgtctatgtaaagcgaatgtatgaagtaatgtgacagttcataatggaatagataaaaatgcaagtcttgtaaaatttaaatccccctctcctttttttttgttcaattacactgcactatattcattatttgaggggcaggctggtgaaatcaacacgtgagcaggtgcgtgtcttgggaatgtcctactacaaaaaatattcaatgactatttcctgaatgaatagaaattggaaaaggctgtgtctgtcttttagacactttgttattctgtgagtttaacaaacaaaatctcattaacaccaaatccacaggagcatgagaaatgtgtaatgctcttaatttcttattaagtgatctgtgtttattaaaaattggctcggaggtacactgcacataattcataatattggagtctatatccctgaatctttcttgtacttaaaatttgctcacagttcagtgttgggatcttgggtaggaaaagggatatcttatt

SEQ ID NO: 66801 - DNA, 1047 bp, Homo sapiens
taagtaggcagctaggctagactgacatgattgtggaaaaggtagagattctaaggaaattgatgaaggtttggagtagacaatgtggcagcaagtatgccaaatgtaagtacaaggcttaccaggcagcaccaggggctgtgttggggttagagctcatatattagaacacatacatcacactgttatatggaacttcctgtagtccacagcaacctgggtactacagaaaacaaaacatagaggttactgagagttgcaggttgtcaagagatgtgagtcagaagaacatgaaatgatgtaatttaagatgctcatgaataggaatattaaggaaaactaggtggagaaagaaatgaaactaagactgatacatttgtcacaggtcaaaggactagaactcttggtgaaagtgaaccagtttagagggagctctaagggaattggagagacagaaggattggaaattactagagaggttgggatgtctcagtgattccagcgacgtggcagttccaaggaatgacaagggtctggggtgtggctgtggaattaggctcctaatgtggagctgaatgagtgtagtcaggaatataggtgagtgtgttgggtaggttagcagggtggaccttgagctcacacacagtggcaaaatatagaaggctcttgccttacctgaacctgtatctgccttaactttgggtacatggctgagccttgaaaccatgtcttttttttttttttacttttgtagggctcccgaatccctgctcctttttgtcctcttttgctcttgcttggtgtgacatgcctcttctgcaactgctgaagtaattcaccgcacgttttcactctttcctcattttttccacctggcagaagcgtgaagaaagattacagacacatgggatacctctgtgttggtaacttaaacttctgtgactatcccttccaaatcagaagggagtcatttttcaatttcctctataaaagagagagcaagtctgtcttcctaccaagcattaccagttgttaggcattgacgaa

SEQ ID NO: 66802 - DNA, 1986 bp, Homo sapiens
tttctctctctctttcttccctccaggatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaacagccagagtagaatgggcatcaccttaatagatctatcctgggatatcaaatacagaatagtgtccggagacgaggaaggctttttcaaagcagaggaagtcatcattgcagatttctgttttctcagaataagaactaaaggtggcaattctgccatattaaatagggaaatccaggataattatttattgatagtaaaaggttctgtcagaggagaggatttggaagcatggaccaaagtgaatatacaggttttagatatgaatgatctgagacctttgttttcacccacaacatactctgttaccatagcagaaagcacacctctaaggactagtgttgcccaggtgactgcaacagacgcagatattggttccaatggagaattctactactactttaaaaataaagttgatctcttttcagttcaccccacgagtggtgtcatctccttaagtggtcgattaaattatgatgaaaagaataggtatgatctggaaattttggctgtggaccggggaatgaaactgtatgggaacaatggagtgagcagtactgcaaagctttatgttcacattgagcgcataaatgaacatgccccaacaatccatgtagtcactcatgttcctttctcgttggaaaaagagccaacatatgcagtggtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactgttaagaaggaggtttataaactggaggtgacaaacaaggaaggagatttaaaagcacaggtcaccatcagcatagaagatgcaaatgaccacaccccagaatttcagcaaccactgtatgatgcttatgtgaatgaaagtgtcccagtgggaaccagcgttctaacagtttcagcttctgataaggataaaggagaaaatgggtacatcacctatagtatcgctagcctgaatttgttaccatttgtcattaatcagtttacaggtgttattagcacaactgaagaactggattttgaatcctccccagaaatttacagattcattgttagagcctctgactggggttcaccataccgccatgaaagtgaggtcaatgtgactattcgaataggaaatgtcaacgacaacagccctctctttgaaaaagtggcttgccagggagttatttcatatgactttccagttggtggtcacatcacagcagtctcagcgatcgatatcgatgaacttgaacttgtaaagtacaaaatcatttctggaaatgaacttggcttcttttatttaaacccagattctggtgttttacagcttaaaaaatcactgacaaattctggcattaaaaatggcaa

SEQ ID NO: 66803 - DNA, 1076 bp, Homo sapiens
tgttttcagttgtcactcttaaagtttttttagatgatgtcaatgactgctccccagctttcattcccagtagctatagtgtgaaggttcttgaagatctccctgttggcactgtcattgcttggcttgagacccatgatccagatcttggactggggggtcaagtgcgctattctttggtcaatgactataatgggagatttgaaatagataaagcaagtggtgccatccgcttgagcaaagagcttgattatgagaaacagcagttctataaccttactgtgcgggccaaagacaaagggcggcctgtctctctgtcatctgtttcctttgttgaggtggaagtggtggatgtcaatgaaaacctccacactccctatttcccagactttgctgttgttggatctgtaaaggaaaactcacgcattggaacaagcgtgctgcaggtgactgctcgagatgaagactccggaagggatggagagatccagtactccatcagggatggcagtggtcttggaaggttcagtatagacgacgagagtggtaagtgtaatattttgtgccaagagtgttgtttcacctcttttaaatggtcaacagtggaaaagtaaagggatgttaggacactaaaatagaatgacaaatgaggttgcatttggtgcagagacgacgcacatagatgctttttcttaggatgttctggtttgttagaagatctgtttataaactaacagctgtggtttccagtgggagtcctggtttgttttgttttgttattttcttgctcagcactattgctaccaggtcatcttttgataagcctaagtaattgtcacttctgttgattgtactcctgaccctctctaaatgaaggactctgataaagtaaattacatttgaattggctttaagttagaagtgtgaaatggattttcaaatggatcttatataggaatctttccctttacagtaaggctttgcagaagtgatattgcattagttgcttggtcttttatctttcatgggttcatctggtccttgaatgatgggcatttgcactctgtagctccatt

SEQ ID NO: 66804 - DNA, 1049 bp, Homo sapiens
tcacccctctccctccttagaaatgaatagaatgggtcaagtgttggggagaggccaggagtgcatttagggaacatacatcctcatgaaaatcagtgtaggttgttcagatgaggaaactgaagcatggagaagttcagtaacttgcaaaggttacacacatccttagcagtggagctcaaagtttaatacagtctttgtacttatgtaccttatgctgaattggggcttttctcagaattgaaaaaattggaattatgacataggaaagaactgtggaaagtcattcagcctccagaattcaaaacgatattttatataaattatccaagaacaataggtgggtattttctcccttagattggcttcatctttactttcactgttaactttctgttgaaagttctggctgcttccccttccacaacatgggccacttccttttcttgaagttaccatggccaaccattgaacttgctttttctgaaagtgactctgacttggtacactgaagctcatgtgtcctttccccatgccttgtcttgtctaactctaactacctccttagccagaggccaatgctgcccctgcaccaatcggctttgacaactgtgtatacggcccctgcctgacctgcctgtactcagcgttggcagcctcgttgaggtttcattcattgccttcaggccctgcttctaaaaatttctccttcttttaaatgtggttaacatgatgtttaatatttaaaattaacaattttgcatttttaaccttgacattggatggctgaactgcatcctcttcaaggacagcttgcacagccttcttgaagggtaggaccctacttcaaattgtgttcaaggtcaggtgtctgctttcctgtggctgtggggggttgggtagggtagggatttatgggtatgattcccattaggaggcttcttggaagatctttatgaatgagctagagagagggattgaaggagacataatgtcacagcctctggttcctacaaggccttggttccaacacaagactggaaacaatt

SEQ ID NO: 66805 - DNA, 1047 bp, Homo sapiens
ctatgcctggaagaagaggtgtttggaagtatttgatgatagaatgaaaagtattgcacagataattttggtcaaaccttttcaattttggagcagatggggtctcattcacttcctgctcattggagggtagtgcaaatgcctcaattgcttaattgagggaacagccaactgtggtttgatgtcatgatacattctattgtgccagtcatcaaacccacatttccttggggcccaaaataggaatccggttgttgtaggacatgtatttttgcattgtttcaaatgctagttgatctttaactttgcatgccttatatacattcctggagctctttcaaagtataatattaagcaagagaagctatggtttgtgtatggcacaaaaaaaaaataagaaaaaagaaaatgttttcctttgttttgtctttggcccagggtttattgctgccagggacctatttattagccagctttaaaaagcagctgttctctgtcttcttttttcctccaatgatgcctgccttggatatttgggcatggcttaatgttaggcgatgctctgtaaagcgagttctgggaaatggatttcatacctctttcagagggtagagaaattgaagcataaatattgaatccacgtattaaagagaaggtagataattaagctcttgtctggtccctggcagcttgttgatgtgtttttattttctagtgaatgagtgatattcttcaaagagaggtgccatctgggaaatcaggtctctgctgaagcatagccatgatccctgcattgccatgttctgcacaggtccagctctaacccacaggcgaacggcagggctggactaattacgcagctgtcagaatcacacaaatgaatggactgggagttctgcttccttgtctgtgacagtgtgtattggtttggatttcacttttctaacagtggtattttaacaggcaagagagcatttgtatgaaattgaaaactttctaaaaacagtattaagaagtgtatctgtgcatgcttgcagcccagtgata

SEQ ID NO: 66806 - DNA, 1392 bp, Homo sapiens
caggagatggaggttgcagtgagccgaggtcgcacaccactgcactccagcctggatgaccgagtaagactgtgtctcaaaaaccaaagcatacactacaaggcatgcgtgtggtagggaggtagtctgactaggaggaggggattgatgaaggacataaagttggaggtagaggcataaatgtgtggaattttagaatggaacctattatatacagaataagctttgtagctcagaggtctacttctccgtttgtccttctgcaccagagtttagggttgaaataaacatcattcgttccaaggcttgattccctctgaaagttcacattaaaaaaaatagcagtgcagccaggtcctgatttcaaaatggctagtacttaacatttactgccgtgtgccttttgtgtatttggggctttggaagactgatgttccagccaggtgtttagaacatacttgaatctgcctctccctccgtaagaggaaggtgacatttattgattttacattgtgggcacggcatagtcctaactacttacgtgtattaccttaattaatttttttttttttgagatggagtttagctcttgtcatccaggccagagtgcaatggcgcaatctcggctcactgcaacctccgcctccagggttcaagcagttctcctgcctcagcctcctgagtagctgggattacaggtgtctgccaccacgcccggctaatttttgtatttttagtagaaggtttagggttttcagtagagggtttacttcagagtttcaccatgttggccaggctggtcttgaacttctgacctcaggtgatccgcccacctgggcctaccagagtgctgggattacaggtgtgagccacatcacctggcctaccttatttaatttttacatctatttttgtcccaattttgctgatggggagacaggaacagattggccggttagcctgttcaagatgacagatgatgagaagtggtgccagaatttgaacccaggcagtttgacttttgagtctatgctactaagtgttctatctccctgcagcttcattggctgatgccatgttcctgaaagaatctttagggatacaaatgtggctgaagcatgcagcaggtcacagaggcactgatgatccacctactcagtgcttcctgaaaggacttacccttctgcctgtttgctttgttgttaaacagctactgtaatccactccagcctgaaagtggctgcttcattgatatctagatagtagatgtgtattacgtattaggtttattccaagaagaataaagtagggcaagctttttgtgtcctgtgaacaaagaatttggtggaatcaggattggtaaatttttatttcatgtatttgttaggccta

SEQ ID NO: 66807 - DNA, 1128 bp, Homo sapiens
ttggaagacttgaaaaggagaattggtaaagccaggggttcctatacctttcaggccttaagaaagtaatagtaggtgtttttttttttctctctgttccttatttcatgaaggaaattatacatttgcccaaatggcgcttcccttaatatttgctgaaccttaatgtttgcttttgattggcattatgccatcctagcacaataatatttgtcatctcataccttaggaaactctgcctgattttgaatgatacaaaaaaggttttggggtctaaatggagtgagaggaatggtaagagattaagtatccctcataaaaacaggatggtgtcagtaagacctttcccaactctgagttcacattctaccacctcggtcacttaggtgtaaatgtcatcttcctcctcaagatgatgacaggccacccactaccctgggacaaaacagggcagacagtatacagcataggtccctctgctagaggaacattggtattcagtgctcttctgcttccaagaacccctcactccatgctactctccgagaatattgtaatggacatctgcctttgatatagccctgatacccaaccccactccgtcactgtgtttgaaaagtactcttcctgctgtacaaattggaaggctaggctgtgggcatatgggccggggcttggctagtcacacatgcatggaagctggtgatgcagaatgctggggggtggcgagttcatctggagactgtgccagcagccacatctagtttttgggggtggtcatggtggctcggcacctcctgctccagtgcccatgtccagtgctgacggtggtgatgcaggctctggcatcctcacactgggagtgtgagttgggctccagttatggcagcacagcataatgtcctgcccattttctgagcctggttctttggcttttctgggaatcagtgagatgccaaaggcctttaagtaaactcgatttaaatcagctgaagtctgcttcatctgcttaaagctaagaagccgacttttatagagatgttcctctgtagttatccaaacatttgtattcattcttctggcccctgaaagttctacttcacctgttaggcacctccgtgagctaca

SEQ ID NO: 66808 - DNA, 1002 bp, Homo sapiens
acttgctggcccctgcgtgcttctcagacatgcaagggatgccccgcctgagggtctgtgcatgggtcctgccctgcctggaagatcttccccctgcacaggtcccttcaagtctctggtccagtgtcactttctcatgaagccttccctgatcagttactctaaatttacagcctctgcgcctccagcagcacatagcatcatctgacacatgctctatccatttgttagttgtctgtctctccacattccctgtgaatgaagacagcttcattacctgaaggcaacatttttgcttgttttgttcatagctgcatcctcaacattgtcccctgacatacagggtatgcttaaaaaatatttgaatgatagatacttttatctttgtttgacaacatagtaattgaaggtcttaagaggttaagttacttgcccaggatcacagaccctagaattgccaggatgggactgaaaccctgacatgcacttaatttaccgtgtgctgctttttcttgttgactaaggacaataatacataacacagttactttgaggatgaaatgaataatgcacagaaaagcactttattaatccaagtgtgccaaaaaaatgtgacttatctgatttattgagaatgctagctttcatgtctctgtcattcggcaacccactcaaagattcttttgtgtttctggatttttatttgggagtagtcagtgctgctgccactgctgccaaataacattttcttattttttctgcccttggtatgagaagtgtgtgtgtgtatcttttatctgtctgtagctatgatccctcctcccctccatacacccactggccttcaggtcaagagctttcctgacccctgtggcctgtcggcagcagggagctagtggagctggcacctgtgtggctgtcattgtttgttcatgtatatgttcctggggcagacgcttatgttatcagcaggtgctttgcgggtgtccggagtcccatctt

SEQ ID NO: 66809 - DNA, 2041 bp, Homo sapiens
tcaccttacactcttttgtctttcttcatagcactttgttccttgacatattacacttttatttgtttattttttatctccctcaattggactgtgaattccatgagaccaggaactttgttttcattattctgtcctgtcaccaggacattacccagcacatcgagtctgccttgtatttggtgaatcaatgaatgatcagatggaccagtcaatcagtttgtatattcacaacagttaatcagcttgtggcacgtggtaggtgctcaggaagtgtttgaaagaatgaattggtgagtgagtaaatgaatctgtgcatggttagttgccaacactggtgctcagcaactgttagctggataaatgaacggttgctggagcttactcgcctgtctctggggctagtccctagcttctttattgggggaaggcccggatgcacaatctttgatgtgtgctattgtttctgtttgataaattcagttagtccctcattctttccgtttgtctgccatcagccaggctctgtaattaacttactgtaatttagctgagaggtgaattttccattttaaagatgttataaacaactggtgcttgtgcatcttggttgttgatgaagttcatgcctaaaagaacatgagggctgtgttacgtgtctaggggagaaggggctgttagcccacacctggccataaaaacatggggacaggctggcaagttctggcgaagttgtgtttctctagctccagtgcaccagcatgccagcatgggggccaaggatcagggtcagtgtggtcatcttcctcaagggtcacatttaacccaaagatttgggagaaataacattttaaaattttacaaccaatactgatatttgttaaaggagaattcaatatcacttagtagttaagagcaggctgtggaaccagactgcctaggtttgactgtgtctcaccacttacttgcctagtggtcctgagcaagttacataatctcaaaactcatttctcacttctaaggtgggagcctgtgatgcagtagagccaacagcacggggatgtcagggatcagtgagagccacggaaggctttatcacagtgtgtgcacattgtaagtaaacaacaaggcagatgtttcatgtgatcacttgatgttttaagataacagaggagccaaaggaaattttattcttaccctggccatgccctaacatggcctccagggataggcattcacttacttctgcatatttcagatgggcaagttaggagaagcactgccttaacaaaacccagtgcacaccattggatggcttgcatgctttctcaggaattcttccccagccttgccttggagttgagctgccgttaaggaagtgatgaattagccatgcttacttttagtacctgctgttttaaagtacctatttgaatagcaaatgaagtcgagggaacctacaggtttggataaagaactgccatctaaggaatgacggtatatagaggagcttgtaatttgagcattttcacacacattgcttgcatttcattcttataaccacttattcatcaaggtagcgaagactgtcagaatggaaagagacttcagtaactcttgggtccatctgtttgatatgatttctgaagtcccttcttcagcatcctattcgtctttcagaccctgcttggtttctccgggagatagagcgttccctgccccaaaggcagttcagtctggctccccataatttctacgcattggtttaggttctgtcttttagagccgcagctaaatctagcacttcttcaacctgtaatttatgcccttttaatatacagacctctggaggtagtgtttccacaacctcacctgggccatttaaccattgcgatttaaccattaaatatatgaagtctgcgagaggcagccttgactggtaggtcggcttagtctggtggacttcagctacaggtctcaactcattgactgattgtgaaatctcttttgtggatctcaaccagcatttttttaatgaaat

SEQ ID NO: 66810 - DNA, 1034 bp, Homo sapiens
gtgtggcatgccagagaacactgaggagggtcgctgctgtggtggagggcacggtggggtgggagttgagtgcaaaaggtaggcaggagccagatcatgcaggtccttccttggggaccaggttaggcaagggatttggattttattctaaaggcagtggaatgccactgtagaattaaatactagggagttactggaccgggtttgtcttttacaatagggattctgtaggcatggtctgtactaagacttctcctgaaagtcagtgatctgattcagatatgcaagtccttttattagttctaatgggtgtgagacttaaaattccagagacttgcacattttaggtatgacggtaggctggatgttgctaagtgactgacatgtgattggtgttaagttagtgccctgctggagtttctggatgattgtactcccctgggttgccatgctcagcagtggtgcattccaggtgcctgctgagcatggacacaggcggttggattcctgcgggtttggaaatggcactctgacagtgcaacgtcagtgaggtcttgaatttgtgacagcaacttaaagttgctgggaatctagaggtctaattatactgttaacttggctttcttgttatttggttaacattttttggttggtggttaaccctgcactctgaagtgatgcatatttatgctaggaatgtgttttggcttcaaagtttatgataactagactttaaaacaggtatgaaatttagatgcatcgtctatatccctttgcaaaagatgtctctgtctcccacatttgcttctctggtgattcttcagtgttactaccatattattttttcctgctaaggggaaaatatgtgagatgagcaagggtggcatcccttgccttgcctccatggacagtggtttcgaaaggactcaggagtgtttgcattacttaaggcttgacaaagcagtaaggtgaaggcagagaaacagtggaggaggctatcacaatttcctcatcaataaagatgagggctgtgg

SEQ ID NO: 66811 - DNA, 1039 bp, Homo sapiens
attttacttttagttgtggcatgatgcaagcaccattttactgttaaggttattgttttcttaaccccaaagctggatctgcattagtgaggatcctcatagaggctaccctcatgtgtcctggctgagtggggttccaggtgctcctcagtggttgtgcccaccttgaattggcacagtggcaggacctccgacaccatgagaggatagacaggggtcacctctgaggctggccccaggactcctctgtgttctatagcattcttacaccctttatggcagttagcaaacttggtatctcatgggcacctcaagcttactgtgtccagattttaactcttggtctacttctaccatagtccctttctaggcctcctcccttcccccatcttattaaggtacgtagttgttaactcactttgtcaggccagaaactggtacttcatttgttaatactcatctttttcttcccccaaatcaccaaatcctaatgatgcctctcctaaagtacatcttgaattcatccatggccttcctgtatccgccccccaagtccaagccaacatcgtcctttgccaggtgactgccaaagcctcttaactgactgccctgcctgcttccccttttcttctattcctctcatcaatttggacccagagcaatctttaaaaattcttgtcaaatcatgtaattcccttgcttgaaacctgttggtgacctcatcctgcacttgatgaaacacataagcccagtgcagcccatggagtggactgcactgtctgggccccaggcctggctacagaggcacagcattgttggcaccatgttgttgtagcttgtgagacattctccccttcactcttgacttcctaggaagattgcagtgacttcaattttccaaacgcaataaaataactcaggctctcaaaggtgtacttagaatgaatattgtgttctgggaaatggaacaaggagtgatttgttcctccaaacaccagaataacaactcctagaacacagaggtggaccactatttcat

SEQ ID NO: 66812 - DNA, 1084 bp, Homo sapiens
agggcagtatgcaaaggaggtctggggaataaagagattgatgaaaccaggtggtccctgccctgaagcagcttggttagtagaggaaacagatgggcaaatggactctaattaaatgtgattagtgctttatgttggtcagataaggaaagacatttggcgggagccccacatcccagagtcctccctcagtcacttactgctgtgcttggttcagaaaggctgtccccctcacggagcagtctgggaaaatgcattccttattaataactacgattctgatgtgaaatctctctatatagtatcttggttgggaaagtgtataagtgaagattccttttgtcacctccacccaaatcctcttccactgaggagtccagtcttccttcctctcacagacaaacctgctcttcctcctgggccctccatctcaaaattggcactgtcatcaatccagaggcttgagagcatctttgatacctccgtctccctcatcacctctatctgatcatccaccaagtcctggcacctctattgccctctcttccattgctatcacccaagtctaacccatctccagctgcaggtcatgacctatgttacctcattctgaaattaatttaggggttcccccccatcatttaacaaaataaaaaaatagtagaatgggagacattagagtaaattacatgtagtttaagtttgagttttattttgtcaaacttgtgtttgtgtataatagtttcacatacaaaaaaaggctaacattgctaaggtcttcacatatattgacttatttatctcccacaacaacctgtatagtaggtaccattatgcttatccttattttacaaaagagggaactgaaactcagagaatttgagaagctggcccagggtcacagagaatattagtgttccagcccccacactgcagccacaataggcttataaaatgcaagttggatgattcttcactattgatgggtcccatgctcttaggatagtataaagtctggtcataaggccctgtgtaatctggtttccccacacctctcgggcctgccgaccatcctcttgcccca

SEQ ID NO: 66813 - DNA, 1061 bp, Homo sapiens
agttttatattttgcacatgcatctttgttagcccctacttttgcaaaagatggagctgtggagttaatctctggtctgccattgatgttttaggtttatcttgttctcttggacaggcatgcacaatgaattaattgagttgttttcagcccacttcctgcctaattgaacacctgcccagtgaatgctgccaagtcacttgcctattacctgatttgccagccattcctgtcatgtcagtgtcttgcttgtatgcaaagactcagtcttgtcatttgtagttcactttctgtgttcttcagataacttttctttttttcatgtaatttaaaggcactcgtgcatcctcctttgttacagtccctctgcattcccatcttgccactgtcctcctggttaagatcattactgactaggcctcataaaaatgctgaaacaccagatgcaggacaagggcatatgtgcaccctgggttggttctgatgctttcgtatctttcccttggtcccaggctaaatttccagcaagccattcttaagtagtgctgacagtttagaactaattagaaatagtcttttaagggttgggacacaagatggtttttaaaagagtgctgtcattttttgacattagagacttgtatctttccaaagagaagagtggtcttactaaaaatgagaaccagggcgggaattcagccttctctgatcacagaaggccgcccctgttaatggcctatgcttgtcctcttgactgttttctttggttgaaaagtcttatagccagtcacatggctcctactggagccctggcttaggtgtgatttttttgttaaaaatatcctggagatacagcaaccccttcttagttatttggtagaattacatatcttttctcttagcctttcaaaaacatagaagtgtactgtttggatttcttctgcccagatttgaacttattcaaatgagatgagactggttatctcctttgatttcattgaggtttgcattttgttttcagtttccttctggcttttctttgcagaatttcaaattttaaa

SEQ ID NO: 66814 - DNA, 1200 bp, Homo sapiens
gttttaaagtttgtgccaaaaaggggctagagttggggcttttcaaactgttaatcacaatccacagtcagagaattgatttagtgggttgatacatttttaaatgaaatagaacagtgaaaaataacaatgtgtgacacacagtaaggctgtgtgtaggtgcatccctcccaggccataatagaaatacacttctgactgtggatcaatgatcaaaatatctgagagagattatagcttcgattggtattggctagattgcgaagtccttggcggcagggatgttctctcttttatgttcccttcatccttagtccagtactgagtacttagctgattggttggtctgtctgggagaatttgtaacagttcacccctcagactggaagaatagtcagaatgatgttaaggacaatttgcagaatactgtctctgcaaggaaatgacaggtattcttacccttgctttatgaatgaggaaagcagaaagacaccgagtgtgatagttaagagcttggggtctaaagtctgagaaacctgtgtttgaattctgtttgtgcagtgtcatggttgtgtgactttgggtaacttttttaagcctgactttgtccatctttaggcagggtatgatgagggtacctacctcaggtattatgacagttagatgagttagctcgagtttagtggctttagcacagtgcctggcatctgataagcagttagtaagcattatctgctgcccttcgttttatgattaagagagattaagtgactcatgttgggtcccagggcaccagctggagccaggcccactgcaggagccccttctagagttgcagatctgtgatggttattgatcttgatctaaacttgtagctctaatctgtggtttggctgtggcagtgaaaggaagtgaatgttgcaacagagcaggtgtgtgcatacaaagagatgtcctggttttgccagttagagaaaacagcatcttccagagatatggctgcatgtggaatctgagaatataaatgacatttcttaggaaagccaggtgctttgtattttcatcaaaaacaacagtttcctaaaactgaatatagcaatgtataggcttaaactggtggttttgtgtcgacacagtgataattttagtggaaactccaagatttggtaaatactgatttctgaaatcactcactgagcc

SEQ ID NO: 66815 - DNA, 1040 bp, Homo sapiens
agggtctcactctgtaacccaggctggagtgcagtggcgtgatcacagctcatctcctgagctcaggaaattctcctgagtagctgggacaggcaatcctcctacctcggccctcccaaagtgctgggattacaggcatgagccaccgtgcttggccagctcttacatttttggtcacctagtgacagaccttttttcccttctcctctctctcctttccacattagtttttatgtttgagcctagacaagtataggggaaattccagaggaaccagcaaagtgacctgcaatttttgatctttggggtttccaattttgtgtatttgctgtgtgatcttgagcaattctcttacttcaggtctcaaggaacttagcatctcgtaggggagatagaactggagttgatagccctcttattgctgtggctacagacaaggattcttgtcctcagtgtggtggtagtggtttttaagtctttatgtgttataaattagaagtttgcaaggtgtggtttttgacactaagggaattgcaaatgggatcaaggactagacttccctgcatgagacactctctcatcagacactctctcatcagactcccagacttatgttataccacctggtgcggtcagttacagttacctgtttacctggccacctgcctagattaacagcaagctctacaatggcggagacttggcctatgccctgttatatcttaggcatcttatttattgtacttccatgtggaatacaacggatgcctgcataaaagatttgaaggatttcgaatcacttaacatggtagcaggccgaggggtggaattggctaccacaggtcttgtgttgcgtaaactggtcgtgccacatgaccagacttgtctcccttcctcccatgcccacagcccctctgctgagaaagacagaaccagtaccaggtaggtcccttgtaaaaagccagaggggtgagtggaattatcttctgttttatagaccaagatctggagaagtcacatagctaacatgccagagagtc

SEQ ID NO: 66816 - DNA, 1011 bp, Homo sapiens
ttgtgggttgagtgcaaccttcctctgagtagaggccagctgtgggtgttggggatgtgggccgcccagcccagggaagcatctgtctttgtggaactggagttatgttttatgatgtcactctggtgtgactggatcacagaattctgagtttataccctttgttggatttttttcctgtttcactatttttctgtgggtccttgcccaagaccttggatgagtgcagtgagcaggcgagatctgtgagttaacataggtggggaacgcattggatgcaccacctcctctgtgtgcactggctgttgacccaccattcctcatcatcagtactccgtgccttccctgcattttggaggactaagcacttttgtagcggggagtgtgtgttttgcctttctcttcagtttgtccccataagctacttccaggggcctggcagtaatgctgctgctccaggtcatttgtgtttgtggagtgtcagagttttcaggactttgcccagaaagtcttgtccagtgctcccagggagtggtcgtcatcatctccattttacagatggggattcttaagggaagtcactcttaggtagcatacttctataccatagcttcccctgtaagtttcataaaacacaaccgagaagatgcctgtttaaaatcagcttgtattccgaaagtgaaagaatgccctcttcaaatgccctggggatcgtgtacacagtagggttctcttctccctcaggaatgtgtggtcccatcctaggttccctcccggccgtttcctggctttgtgagcctgagctggttactgaacctttctgagtctgtgtcctataaattggtgatgatagtacaatctaaaagaggctgtggtaagatatatatgagatagtgtatgtgagatcacccaggctcaatgtgttgtaatcgcttgtttttatttttcaaccaggatggcttgaagaaaatacagatctcagctacagaggttgaggcctgagaaactccc

SEQ ID NO: 66817 - DNA, 1049 bp, Homo sapiens
acgtggtcataaacttgcttttgggcttccgtttttccaaattgtgcaacatccctgcccttctgagagtttgtgctggctctggtcaggccggaggtcaggtggtcagattctggctttatttgggctgtgttctcgctgcgaggaggaagccaggttacctctgttggacctgcctgctcccagcatctccagcaacaagctgtctctgccggtgagtcactccgtgcaagagtctgctcacccactttctgcttgatgtttacacttttccctcaaagagggaacctcttcttgttctgagggcacttctcggcagtcccctagagtgtccagttgtttcttttgtggggtaagaacccgtgccagacaggtacatgttttaatgggagaagagcatttctgcctgtggatatgagctgtcatgcctacctcttgaacattatgtcctgagcaaagcccttttctcgttctttttgcttcgtgtttaggtgcgtgtttgggtgtgtttgctttaattattactgggaagcaaaaaagatatttatcaaaggtttaaatctatagcagtgcccctgcaagcagaaagaagaagtatatatttagccaggatatcattgatttatcacccttttttccattttgttcctgttttgttggcaggaccatctgatttgtatactggttcagtttggatttcagtagtgagtgtgaaaagattcctgggctgtttgccgaagtggagggactcaaatgcgtgggcttcagggctgccagtcttggctgtccctgcaatcccaggagcctggcacatggtgcctttgtcaggaaggtggagtttggccaggccgtttctttggctttgcctgggagcagctctgctggtgacagtggaggcctccctctgccgtgggaaagggaattctctcttgattccggttttggcttatttctcatcctatagggatgagagggaggaaggccccagaactagtgagttttggtgatgagcaggttcagggtaggactggtttgcagcttccacagag

SEQ ID NO: 66818 - DNA, 2047 bp, Homo sapiens
cctttacaaataaactttgtattcaagacaccagtatgcctggtcatttgcagcagtgatacggcaagagacccatagtgggcttcttgagcccttattctcgtcctagatgtgttagcaagaagtttgaccttggatgagtcacttgctctctctggacttctgttttcttatctgtcacatggggtataaagagagagctcgacagtgtgatgtagacaggagtaggtttctgagggacacagtgaaatcttttttcttgtaaggctggatcagccacagaaaataagccttagcctgttcttataaagaaattagcttagatttaaaataaaatatgagaagaaatattgcaaaaagcaaaacaacaaaaaactaatagtagttggtactcgatttacaacatgaatactgttcttatgcttgcagttagtgtacttggttgtccagctatctactataaagttgctcattgtgcttagaaagtgtgtatttcacctgtggacccgaattttttcttattgtttaatcttcaagcttggagtggacgctcaagcttggagttggattggtcctgctggggtttgtctgaagaacatcctcagggtctctcattgcataatattataggtttccttctgtctgactgatgctggggtccttgtacaactatgcttctgccatcttttccattctggcttgagaagtggtgagctggttcctcttgcctctggcatgcccagacttctcatttcttttcagatgagtgtagtaaaaggcaagcagtgagttagaggcagcacattaaaaattgctccaggcaatcatctgtgtcccctccaccccgctcctgtcccctagaccccctgggcaacttctcactagagcttcctggtcataagctggccttgacattttgggtgctgagggccatcacagcattgaagtgacttggccagggtcacaccacacattaatgatcaagccatggtgctggaagaagaggaattttttttgtgtgtgtattttgtcataactgaatgttcctgttcttgtccattagtagctttcaaaatccatattgggtttgaccacatcattttcagtaatccttttttgtcagctttttggaagctgcagttagtggttctctctgagtttgaggtagtggtattttattattaaacaattttttccaaatattttttaaactactttccttttcagaccagatgaggtagtgttaaaaatgatatcttctccaacaagtaaaggcttgattaattaggttgagtctttaaaatatctagtgtttgtgtgtgtataaattttactttaattgagaagtattgataaaaatcataatcgtcaccatttgagcccctgccattgagcaggcattgtgaggtaggagtgagcatcattttacaggagagaaaacaaagccaagagatggcacgactctggtacagctgtcgtgcataagttactgatgatctttcaatccatgtaccattttgttaacagtggaaaaggaattctcagctatcctacagggttgtgctagttaaatgagatactgtatgtgaagagcaacaagtaaactcttaacgggctccctaacccagcacattttaacataaacacttgtagactctggaagcagtgtggtgaagtggttaagttcaagcgtcttgggagtctggcaggcctgggtgtaaatactgaacctgctgcctgacctctctgagcctggtttccacatgtgtaaaatcaggataatactgtctgtcttatattcaagaaatgtacccactaattgcagtgggtgctgagtaaagattggcatccactcctttcccttgcacacaggtacttgggtcaatgggattgagtaagtctttcagcagttgtcctcagggggaaaaggcttaaagtactttttgtacttatcaatgattcttctagcctttttgccttcccaccctaagccccagcacgcgcaatgaatattccagggcctgtgattgtcttgtccaagggaatt

SEQ ID NO: 66819 - DNA, 3485 bp, Homo sapiens
ttttccttgcatgtatataaccctttaaatatcaaaagtattaacacgaattttaaaaattttctgagcaggcatggtggctcatgcctgtaatcccagcactttggaaagctgaggtaggtggatcacttgaggccaagagttcgagaccagcctggccaacatggtgaaaccccatctctactaaaaatacataagttagctgggcgtggtggcatgcacctgtaatcccagctaccctggaggctgaggcatgagaatcgcttgaacacgggaagcagaggttacagtaagctgagatcgcaccactgccctccagcctgggtgacagagcaagactctgtctcaaaaaaaaacaaacaaaattattctaatctttgctgccctattttaatgttacattatttttatagacattttcctttttgaattcagaactgtcatacataaagtacacagaaatgaagagaaaagtcgtgaatactcacaagctgagattgagtcctaatgaggaagccttcattttgaaggaagattatgaaagaaggcgaaaactaagattgctacaggtatgacttatttgtaataaagttttaaattcctttcttcctcaaattacttgtattcttttacattagagtgttctaaatgttgtatttaaaaacctcttctgggtatacgagagccctggttatttggtattaactagttttggaacacttgaaaaataggctgagatggttaagtacattgtagaagagttggaagataggtattatttgactcgaatattgaaaatagctctttatcttttttaaaaatggtctgtaattggtaacaggaagcttagatgactttgaagaatgctaattggaaagattattagctgctgaaacaaatttatcaggaaattgcagataacccttttctagaagtgtttttaaagtaagtttttgtgaagtatgtttcaggcaccattctgtctagaatcagaaatgatgtacaacagaaatggagttctcatctggctctgtctgtactctgggctatagattttgttgaatcatatttatcgctttagcttttataggttattagagtgataatggcagtccttttgggagtgggcgctgaataaaagctatcagtttggagacattagatatagtcttgagatttttactttttgtacattcactcagattttctgctttaaatagtctttatctaatacaagatgagtatcaaagagagttgacagacttaagagaattcatttgagttcctctttccaaatagcttttcaaaaaagtttaagtaaacctcctttcatataacctgttaaatatgcattctttaggttcgagaacaagaaagagatatcgccttacagataagagaagacataaaacagaggagaaatcaacaatttacacgtttggcagaggagctaagggcagaatgggaagaatcacaaactcagaaaatacagaacttggaaaaactgtatttggcaagtttaagaagtatgggagagggacatcgacaggccaaagaaaatgtgagtgagatcttatttgactaccctgttgtggcagtaatattagtaaaaagtaaattatagttgttgaatgcttttctgataacattttcatgcattgaatttctttggggcagcttgaacttttttataaatttaatgtaatttgtgaataataggctcatttcttactaagagttatttcaagtaaaatccatgtcaaataaaattggtcttcctatgatgttcaagttagcattattctcttccagtactcctctatctggggaaataataatcttctgaatcagaagttgttgtccatctcaggcattttttgacagatttggtggggtgaattcaaccccccaacaaacattttttgatgactttcagaaagtcacagtaagtctgccccattattttgatttattgtgatttatgatgtggaaatactacagtcccagaatcagtcacatacagtaaacaagctagttacaaagaaggtaaatctttgataacaactagtgagaaagaaaatatcttaagactgtggcaatctgtttcatggtccttggttttagtctgtgtttttagtaatagccgtaagttctgactcaggtttttgtggttttatgcatgccacattaagtttgtgcctaatgcaatgtttcccaaacctctgttatttgaataccatgttcacaatttttgccctgactgggaaactacccatatcactatatattttacgtactttaaccatgtcctaagtagttcgatatcctatttatatttttgtaataatgttaattgattgcattaactttacattaaaatgtttgtgtttgtcccccctaatatggcatatcatcagtggtactgttgtcatgctctgggaaacactgctatagtatgtagaaagaagatgacaaaattgataaatcacttctgatatcatatgagacacatttctattattcttgtttaacatgacattttaagtaatatatatttttaggaacctgatttggatgctttggcacagcgggcagcagaaaggaaaagaaaagcagatttgaggcataaagaagccttgaaagtacagaaaaatcaaaaagaaatattactgaaacaaaaaacctggtaaagtaataatttttactataatctcaactgaaactaacatggttgaaagtagaggatacataggatactgtgtaagcaaatattaaataaacatagtagcatattcattgcatttgttaaacttgatttaaaaataatgttggggacagggaatgatttgcttaggtgaacatagtaactaatgagctttcttttctagttgtagtttgagttgagtttagcagcagttactaagtttctgaaaaaatatatggctacttcagaatgcatgtcaaccaatgtctgtttccgatgtaaacatgaaataaaaattgatgtgattaagaacattaaaagaggttgtagactctggaagtcattagtattttttgcatgttgtaaaaattaaagggccattcacaggaaacgtgagtgaagcaaagtaaaaaattaagggccctgttactagttagcaacagccatttttaacaacatttctgtttttttttttttcactctaaagaacattataagtttcttgggttggtccccaccatagagctttctgtctttagataggcctctctcaatttgtaaacattttcttaacatatgtatagactctttacacatgtaaagcttactgagcctgtggaatcagactagaggatttcttgagcctatgacttacatatttttaaccctgttgtactataatattatcactgagagattaattgatgacatctcttgtttcttaaggcatataaaagctcgaaaggaagcactgcttgtggaaaaagagagatcagccaaa

SEQ ID NO: 66820 - DNA, 1055 bp, Homo sapiens
taaaatttgaagtaatttaactcaaaaaatttgatttcattatgagcagatatttagcatgttttggatgcggagaactcattaaaatacaaaattactttttttgcattggattcagctttaagtgaaaattaatgcttttaacctatttttttatgttctcttttccagaacatcgaagtaaaaagaatttctgcagtcaaaaccaatagttctacctaccatcatcttcacacttttgtgaatagagagacagacacaaaacgggtgattgacttattgtttcttcatgccctcgctttattatttctgtgtgcattgaattgaattatatcttagttatatgtatggtgttcccagatttcaaaatttggacaattgataataataatcaaaaccttttaaatgctttgaattttcatgtcaggcatatgatggtttaatatgaattaaagaaactagttggctatttaaatggttattttaaaatagcagattttaaagctttttttatcataaaatattacatgctatttgtggaaaatttggaactgtacatataagtgtaaactattgggaaaacaccaattctgtcaccaaagtggaatatagttaatgttttaataaattcattataacctttatttaaatataaacatatacacacacttttcaaaacatgatttttagtggccacttaatatttcatggtagcatttatttaaccattattttattttttgcttctgtaagtaatgtaagcattatcttgcacgtttttatccacatctctgattatatataaattcctgaaagagaaagtattggctccaaactgtgtaacatttgatacagatcattaaattgctttttaaaagcatcagcaacataggagaatgaccaccttaccatagccttttctgcactgaatattatgttttaaaaattattgccagtcttaagagtaacaaatgatatattgttattataattgctatttctctgtgtcagtgggggttttaatttttttcatgttgaatatatttctctactag

SEQ ID NO: 66821 - DNA, 2013 bp, Homo sapiens
ttttccatgctctattatatctaaaaagatttctgtccaaatatctgatgtacaagattcagaaatgtatttaataatagcatttatcattcatatatctttgatcttcacatactgaaaatagaatctaacattatttcaaccagatttatggttatgtttttaattgcattgacacaaatctataggggattgtcttcctaaagctgtattataaatcttgttttgaagtatgatcaataagaacaaaatttgtttgtggtccctaactttttctctaaccctttattcatatcctttatatgcttttttatatctggactgatatttatcattcatgttgtatgctattttgaaatttttcctttctttaaaattttggtttaccaaaattgacatactgcttttaatttatcttcaagagatgtgaagaattcataaacaacttttttcttgaaaacctcatggctgaaatggattgaaatattgttctcagaggttatattatttaatatcatacatattgatatactaaatactcctacagattataattttgatttaatctaactttttttgtcttacctgatgttatttagttttgcatgaatatttagtggctcaaagcggttatattcttgataaatttgtttggccagtgtactctttgttaatttaataactgtcaatctctctacctatttatctcaccatgtgagaatttttaataatcttacacttgaagttaacagcttttttggtcatcattaattgtttcaactggctggcagaatttcaacatacaaaagacagaaaaagacttttactgctggttacatttagaatatttacctatacttgaaagtgaatgttcagataataaaagtaaatccaggctggatgtggtagcttacgcctgtaatctcagcgctttgggaggccgagatgggaggattgcttgagaccagcctggtcaacatagcaagacccatctctttaaaaaaaaaagtaaatccagactctgtgcctctttctcttttttgtgttatttatgttaatgagatttgtgggtatttacctttcaatactgtcattttaatgaagtttccttttttttatttttgagatggagtcttgttctgtcacccaggctggagtgcagtggcacagtcttagtttactggaacttccgcctcccgggctcaagtgattttcctgtctcagcctcacgagtagctgggattataggtgcccgccaccatgcctggctaatttttatatttttagtaaagacagagtttcaccgtgttggacaggctgacctcaggtgatccacccacctcggcctcccaaagtgctggaattacaggcatgcgccaccacgcccagcaagagatttctttgcttacaaagtgatggataaatgtgtttggaggagtataacctcatctggtttaaaatgagtaactcgtaaagctttatactaacaatttgatccctttcataggtacatgccgttgataattgtggacattttaaaatataactcttcttatattttatatatgtagaaaacatgattttaaggttgttttgttttttagttactgcttgtctcacactttaaaaattttgcctacaatttttgattgactgctagccagatgctcgtttggctgctgaagaggaagctaaacgattggaagaactacaaaaacaggcagcacaagagagaatggaacggtttgaaaaggcacatgtacggggattccaagcaatgaagaagatccatttggctcaagtaagacttatattctacccatgaccattactcatggacttactaatagcattgcaggactgattagtgaatgagctcaaagaaaggtaggaagggtgggtgttcaatatagtctctgattcatatgatttcaagtttcccaactttctttgccctccaatttcaagttctgattgggttaagctattctcccagtgtattgctattctaaa

SEQ ID NO: 66822 - DNA, 1088 bp, Homo sapiens
aataatggaaattcataagagtgtgaggtaacaagaaatattctatgttaagccacagtcaccctgggtcttggtgcttacctgagataggtatatggagaactggaacaaagtacatcacaggagccatggcaacttatatagacattaacttcatgactttcctcagaaaggaaaactgtagctggcagacactttttgcagctttatggcctaaccagtaccactctttcattgtacttactaacataacactacttatttgttggtcttactactagggtagggttgagattgtgtccctagcacttaatgtggtatctggtattcagcaaataattgttgaatgaataaatgtctgtcttttggctgaacaaataatagaggagaggagagaagcttagaccctgatcctcatttcccctacctgcaacattgttaatattaccatacaaagtttgtgactcagtttttgttaattctctttattcttgaagaatcaggagaaactaatgaaagaactcaaacagctacagcaagaggacctggcacgtaggagacagactgtagcacaaatgccaccacaactagttgaacttccatacaaacgcagtgaaatgaaagaagactggcagagagaattggaatttgcctttgaagatatgtacaatgcagacaggagtaagatattttcagtagggctttcaatagtgattttatacgttttggtgggaaaatatgtttgtaatgataaagcagtttttatcttgaaatgagttctctgtttgaaggaggccccccatattttagattgagacattaccgtggcctttgcatttttgtgatccagttatttttaatcattttggaatggaaacgtgtctctatttttcttttttaagaggtgaaagggaatctgattctgcaccttgaaccagagcccttgcccactgtgactaatcagatccaagatgaagagctggacctttcaatggaacaagaaaatttgggtgcagctgaagaccttccagtgacagaagctgaaatatgttctagtgaaacagatggtaaaaacccttctgagctaa

SEQ ID NO: 66823 - DNA, 1500 bp, Homo sapiens
tattggcttggtgttgccaagttgtttgtttgtttgtttgaagctagaaatctcattgtttttaaaaatccttacttttaaatattggcaatgaatttacttcttaaaaatgagtgggttgtggactaatggtaaatgaaagaagccaggcagaaaataatacctaaatgtgtgattccatgtttatatgaaggttttaaaaaaacaggcaaaactaatctgtgatcttggggttaaagtaggggctgtttttaggggtgtattgactgggaagggacatgaaggaaccttagtcctggtaatgttccacatgatctgaaaggtggtacattgacatatgtgaaattcagtaagctatacacttaggtttttgtgcaccttgttctttgtgaattataactcaattggaattttttttaatataagttagacaaaactacaatctgcctattttcaacctcttaaagatattcttaaattttattccttgactaagccagagaaatatgtacttgcatcacacttttgtcctcttagagaactgttcgtattatactgagttttggcattaaactatcagcccacatgggaaaatgtttgaagaaatacttgtgttgtttttttgtttttgtttttaactgaagggatctctgtgtgaagatgggtgggagacatttttcccagatagtgccaagaataatttgggagcagttgatttgcttttatggctatgatgttttcctctgtagctcactaagaaatacagagccatatttgggaccattctctagtgtagactatagaacctcacagcatatattttcaatactaatcttaccagcaaattaattagaagttacacattcatttatcatttagcaagcaaaataaacatcttcctgataagttttttaggcttgatatttgtgttgcatacatgtttttggaaaatacttgaattttggcacttttactattttcagttgaaaaaattatttctagttataatgattggagtcagatagcattgttgtatatactgttaaatcgtaaatatgaggaaaataaaactgtgcttttaactagtggttatagcagtaaccgaatataagatggaacaatttgcctggtaatacaatagatgctaaataagttttttccctttttctttcttttagttcccttggtaatgaagacccaacagattccttcaaaagttctttttaaaaaattattaaataagatccgaagccaaaaatctctctggacaattaaatctatgtctgaggatgaaagtgaaatgattacgactgttagtgaaattgagagtaaagcaccaacggttgagtcaggaacaattgccagcaaagagagaacgttatcctctgggcaggaacaaggtatttctctccaagagtctcattttctataaacccttttaagttgttcaaaagtaggttcgtttctgaaaaatcaaagaatagaggttaaaaggaacaa

SEQ ID NO: 66824 - DNA, 1023 bp, Homo sapiens
tcacaaaaaaaaaaaaaaaaaaaaagtgagccaggcgtggtggcgggcacctgtagtcccagctactcgggagcatgaggcaggagaatggtgtaaaccagaggcagagcttgcagtgagctgagatcgcaccactgcattccagcctgggcgacaaaatgagactccgtctcaaaaaaaaaaaaaaaaaaaaaaaagataaagggccaatatgagcaggctttcaccattctcatcttgctttattctcccccttgcctgactaaaaccatgcacactgatctctcagtttcttgaatgggccaaggtttgtttctttatcctcacggggccttttatacccattggtctgtctggaaaggtctcctatacatcttcatgttgtttacctggctggttcttccttacctttcaagtgtctgcttaaatgtcgtttcctcagagaaatttcatcttgcccagatttattatactctattgtataacccttcacttttcttatatagtacttattacaatttctaattttataatttttttctgggataattataagatggttctgccacctactctgtaaagcctccttgaggcattttctcatttactgtggtatccccagcatctgccacataagtaggtaccaaatgaattaatgagtgaatgaacggatagctccatgcagactatctggctacccaaatatgatcagaacaaattgctttaacttccttctctgctctggtttcacaaattattttttaaaaacctagtatccaaatatatcaaagatacattgacattttgttagcttctcctttttaactttgataccttgttgtttccgctctttttatgcctttctcctatgtttgaaatcctatcagcgtatctattaaatcagttcttcacgttttcacaatttcagtctttcatctctgttgttattattaggcttgggtttaatgagaaatatatctgatcatcaggaaggttactggatcttaactagatgagacattc

SEQ ID NO: 66825 - DNA, 1032 bp, Homo sapiens
aattgagtctggaccacttgctagtgaagataaaccactttcgtgtggtacaaactctggaaaagaacaaggtatttctttttatcacatcctcaaattaaatttgactccttgcatcttttttttaaataaaattacatgtgatatattaagaaagggcattatagtggtgtcaaaattctaaattattgaaactaatttttgtttggggcattcccctagaaataaatgagactctgcctatcacaactgtagctcagagttcagttctacttcatcctcaagaagcagcagccaggattagaatgtcagcaaggcagaaacaggtaatttgaaattttatttttaaaggtttatttttcccctaggtactattatataattttgtttggccaatgaaatttgtcttaatgtctggctaattttgatatcatgtttttgacattgtcttacacaaacattcagctgataaaatgcgtgttgtctttgcccatactgctcattcaacccttattgtgtctgctttatattttatatatttgtatagatcttccctataaaatttattagcttttaaaaagcagagactatcttctttaaaaaattcaatttatcctacacagtttctgatacaatgctttgtacatagcaagtatacaataaataattgttgaattaacaagtccttgtcataatattagacactcagatgggctttgtaatcccacaagttttttgaaaaataatacttcagaggaaaaacttttaatatacagcgccctttttttgctccgtcgcccaggctggagtacagtgacacgatcatcgctcactgcagccttgacctcctcagttcaatcctctgacctcagcttcctgagtagctaggactacaggtataggccaccatgcccagctaattttttttttttcctagtagagatgacgtcttgctatgttgcccaagctaaactttaacttctttaggctgggcatagtgactcatgcctgaaatcccagcactttgggagg

SEQ ID NO: 66826 - DNA, 5103 bp, Homo sapiens
ccatgcctgacaaaaaagacacagaatgttgttcattgcttctagataactatccctcttaatgagcatggttaagaagtcaaagtattttaggaggccttgatatttaatttctttagtcattatttatactattaaatgtgtgaacatagaatttggctgtacatcatttgctacttcaaggtagttcttcagtggtgatcagggtttcactgtgctctcagaaagtagaaatagttaatgtatttattctttcttttccttctgcctttttttacttctatccctttttctctttttcccatttcccatcttttactcccatcctcagtctgtcagtgataacaacagagataaagcatcaacacttacttctttgaaaattggtacccttggtgaagaaacctaatttcttttaaatggaacgtgtgttatctttgcctttgtatgagtttgttgttaatagatcaatagtattttgttacctagataatggaaatagaagagcagaagcaaaagcaattggaattacttgaacaaattgaacagcagaaattaagattagaaactgactgcttcagggctcagctggaagaagaaaaaagaaaaaaaactcaaccgactggggtaggatgcagaaaatctcatcactacataaatcatttggtaaggggggcaagaaaatatgagcacttgtagcgtttagaaaagtaaaatggatggctgggcgcggtggctcatgcctgtaatctcagcactttgggtggccgagacaggcagatcacttcaggtcaggagttcgagaccagcctggccaatgtggtgaaaccccatctctactaaaaatacaaaaattagctgggcatggtggcacgtgcctgtaatcccagctactccagaggttgaggcaggagaatcgcttgaacctgggaggtggaggttgcagagtgagattccatctcaaaaaaataataataataaaagtaaaatgcctttgtaattcttatttggtctttttttgatataatgtatgtatatatgaataaatttgcatcagttacggctttcatctttcagtttctataggatactaatagatacgaccatggtttgtaggtaatgcgtatgttgagcttttggacctgcactgaaggagaatgacagattagttcatttcttactaatggaaatgccagtcattttataaaaaataaagctgtatggaagtttacaattatagaactgtatgtaaaaatacttcaatacttacttctaaatttgctttttaattagtaactttgtcttttattaggttggcattgctccagcatcatgccctgtaatttctgatgaagatagtcataggcagatgattcgtaactatcaacatcagcttttacaacaaaacaggtattagctagggtataatttatatgtgatcgtatgtggctacatttttaggatttattgtttcatttatatgaggatctaatttggatttccttagaattatggcatttagaactgccattcttaaaggacaatgtgagtgtaatttcttttcaccatgagtattgccaaccctagattgctgtttgttaaatttaatgtatagacatggggctttttatttttcattaaaaaacaataattgtttgcttttgtttttggtaggttacacaggcagtctgttgaaacagccaggaaacaattacttgaatatcaaactatgttaaaaggaaggtgcccatcggtgtcagctccatcattgataactgattctgttatatcagtgccatcatggaaatctgagagaccgactgctatatcagagcattgggatcaaggtcagagactcaagttgagtcctaacaaataccaacccatacaacctatacagacctccaaattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttgaagttgctccaagaacagttgactaaacagagggatactcttcaggctaggcatgaagctcaggtggaattacttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcaggcacttcaacagcagttagatacacagaagaaagccattcgatctatacaggaagtccaagaagaattgcttttgcaaagattaagtgaattggagaaaagggtatcatctgaacaagtttgctcctcttcatttgtatcccaggtgcctgttgctgactctgaaagaacccagaagtctttcccaaccaaaagtaatgatactcttccctcaagtcatcgtgagattccaagattacaggatagacttttgagtttatcaaagcctattctgcctcagcaagataatatgacagcacaattggatgcacaaagggaagtgatgtattcttatgagaaaccccaggaagaactgtctttaaacaaacaaagaaagttgaacaaaagtgaatctgctgagcatactatcccctctttgtttctacccaaggaaacagagcattcgtttattccactaccttttgcagaagctaaacctaaaagcacttgtgaattgtattcatcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgt

SEQ ID NO: 66827 - DNA, 1051 bp, Homo sapiens
ccgcgcctggccgaatggttgtattttcaatggaaatatccttttggcattagaagcatatcttattttttatatatagataaaattttgtgattgatggaactatttatttggtttacgttctaatttaagaagggagatataaatctaatgaataatgcttcacatgatcccccaacttgtgcttccccaccctcatctccactttttcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtaagataattgtgtttgattgtaattatttcactgattattccttgttttcgtcccctgtagcttgctagttgaagaaaagttagaagtatgttaatagattttgtattgtatccaactttgtcattgacttaataggtgagcatctggagaaagatctggggagaagatcctcaaagccacctgtagcaaaagtcaaatgtggtttggacttaaaccagcatgaacttagtgctatacaagaagtagagtcaccagcaattggcagaacttctatactaggtaaatagatgctttgataaaacaagatttttaaataatttgccagttttctactttttttttagatggagccttgctctgttgcccaggctggaatgcaatggtgtgatctcagctcactgaaacctctgccttctgggttcaagcaaatctcctgcctcagcctcccgagtagctgggattacaggcgcccgccaccacacccagctaatttttgtatttttagtagagacagggtttcaccatattggccaggccggtcttgaactgctgacctcaggtgatctgcctgcttcagcctcccgacgtgctaggattacaggcgtgagctaccgcacctggtctacattttttcagagtgctaaatgttttttgtta

SEQ ID NO: 66828 - DNA, 1048 bp, Homo sapiens
agaggcagttacttttcaagtattttaagtatttcttcttgtatttacttccatagttgcagtgggtttaagcaaaaattaagctaaattgtcattatggtgatacatagaccttttttgctgcggagtccattagtatattatgttattatattttatttttctaaactttttttcatgtagtaaattgtcttatttatttaatttgcttaaagtttttagagtgtctgtctttccactctctactacttcagttaaatacctctcaatataatgtagtttgtactattttctctttttgtggaacaccttttagttggaagttgtatgggccgtgctatgcattcttaacaagggtgttttttcccccagagggataaaaattggttcttggggaggtgaaaaaaaacttttactatttatatgtacaaagcacaaatatgcataaatagatatacagtatatttgtggttattaaaactgaacgggggtagaggcagtttaaaaaggaaaagtctaaaaagactccttaagggatgataaaaataaggttgagaaatactgatctatattgatctttccattttttcttctctttctttttctttgggttttgttttgtgggctaattttcttaattttgtgttctgacttttcttttgaacttttgatgatcaaattgtagtttctaaaaggttactctttttctctgattattttctttttttatagcatcctgctattgtttcatggatgcagaatgttgtctactttaaatatttacagtggattttttggtttgggtttttacattttttagttctttcatttttttgttgtctctgtcttatactttagaacctttcctctaatgtcttcatatttgaacgggatgctaaaaggccaattggaggttctcttggggtgaggggctatatgtgctgttggactttattggaaaaagtatggctttgtagtgaggacgctcaccttagtatctgtagttccattccttgagagaagtttagtttcttcaaagaaatacctt

SEQ ID NO: 66829 - DNA, 1365 bp, Homo sapiens
atcacactggttcttttctaggttttagacctaatattcaaatttcttaaagcattttattcataaaataacaatagctacagttttccaggaaaaagtatattgtgctgactagtgaatgtttttaacaaatacggtgaattttttctttgatctaagacaagacaactttaagaagcaaaatgagaaagtagattgtaggaaagcagggaatggtgtcctgtggtgctaagaatttgatttgtcttatcccaactatatttttctcccatcttgaactccaaaatccatttttcagttaagctgaaggaatctgttgttgaaaatcatgcagtgttaagttatgctgtggaggaagaacatgcatatttgggtccaactgtgaagccagatgataaggttagtaatgtcttaatgttcactcgatttttagagctgtttggcttcgtattctcttttgtttagtttacagaagctatgttataacattaaagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagaagtgacaactgctggggttggtgatttggggttttcttacatactacttgctacattgtggtatgatattccccttaatttctaggctaaaacactgtcttatgaaccattatcttcagcaactgtttccactgggagccttttaagttatgaaaacacagatttgagccttacagatccaggtaataaggtcaaaatgtttataaataagttgaaagaccggcaccagttgagttgcaatacagtgatggaaggaagcattgggttttcatgatacaccatggggaactatttctctaaatctcacaagtaaagtatggccaggcgtggtgcctcacgcctgtaatcccagcaccttgaggtgggaggatcgcttgagcccaaaagtttgagaccatcctgggcaacgtggtagaaccctatctctacaaaaaaatacaaaagttagccaggtgtggtggtaagtgcctgtagtcccagctactcaggaggctgaggtgaggggatcgc

SEQ ID NO: 66830 - DNA, 1051 bp, Homo sapiens
ccaacaatacttttgagaagcagttgctgatatatttttccattcagtggaaacctatccgagcaaatttcatggttgcactgatctcttaacaatatgtattaccatgcttctccactaaaatatgtctgtaaggaagtacccagtacagtatgtctgtaaggaatattccattaaaaggaatatagtgtcgctgtcaattacatttttttttcttttgagatggagtcttgctctgttgccaggctggagtgcaatggtgcaatctcggctctcccgagtagctgggactacaggtgtgcgccaccacgcccagctgatttttgtatttttagtagagatggggtttcaccatgttggcgagatggtctccatctcttgacctcgtgatccacccacctcggcctcccaaagtgctggtattacaggcgtgagccatcacgcctggcctatttacatattttcattaaactcaattttcagagtcattttcagagcacatggatgatagcaagcaagaatctaccaccagtaaagaagaggaaacaaatattataagttccatagttccttcaacacaagatatttatcagcggcagaactcttcagacgttcataaatctctgttgcctgcagtggatgaaactacatgtggtcacacacactttcagcaaatgatagacaagtacattaatgaagcaaatttgatacctgaaaaaacagatttgcaaggtaaaattattttaaagcaatacttttatgtaaattaagttttaaattttcacctttcatcattttaaattttatgcagtgattgtttgagcttcatgttcttatggcctgctacaacaccgttttaccacagaatatattgagggcatttagtgagaaaggggatctggaaccaattagactcactgaggcacatttataggagattaattagcaaatcttcctttgccattgcagagttagctattacggctgaggcggtattactgataaataagagcaggagctcagaaatcatacagttctggatttgagtcat

SEQ ID NO: 66831 - DNA, 1071 bp, Homo sapiens
ggaagctgcggcaggaggatccctggagcccaggagttcaagaccagcctgggcaacatagaaaacaagtattcttgagcctttggtacaaatgattatatatacacacaaacatacatgagatacacaaggatgtacaaattatatatacacacatggataattgagatacacatggatgctttattctcttttctgttattaaagtcatattcagttcttatagaggaaaacatcctcagtttatagccatattgtccttattaaatattaatagaaaaagaaaaaatacttggtgtgagctgtagtttgagaaatcactgtgaccatccttatctttgtattcatgtttatacacatcaacttttatgcctaaaattgtaggttacttgcaattggatgataaactattagagactgtcagtatccaacttttacaacatgtaacgatgattaactgatttttgaatttcttaatgcaggatctgaacaatgttttgaacagcttcagccagaatattcttcacaggaggagagccagcatgctgatctaccaagtatttttagcattgaagcaagagattcttcccaaggcatgaaaaatcagaactatccctctgaagaacatactgaaatattacaaaacaagaaaaaaattgttcatttccagctttctataggaaacttaagttcagtctacagttcatctgatgaagctaatgtatttgatcagttaaatgtacagcatagcactccatgtggttctaactctagtgagtgctcaacaaaacaccaactagaaagcagaaaggaaagtatgggctttgaagaactatcaaaaagaggggttgttacaatgttacaaagtcaaggactcattgaagataataaaaatgaaacctgtagggttttagacataaatccacaggtagaggaaactgactctcgattatgtgtaagaacagtggagatgggaacttcaattcaggcaccatattccttaactactcaaaatgaaaaatattttgagaattcagctgaaacagacattccaaaaatcaccaaaaaact

SEQ ID NO: 66832 - DNA, 1039 bp, Homo sapiens
agaccagcctgggcaacaaggcaaaacccaatccctacaaaaaatacaaaaatcaggcatggtggcgggtctctgtagacccagctaagattgaggctgcagtgaggtgtgatcatgccgctgcactctaatctgacagcagagcaagacccgcttaaagcgtttaaaaagagtaaaacatgcaactttcttgccattaggtgagtgagtttctgcctcttgtatcagcaacagaagcctcagattatccagctgtatcagaactttccatagaaaaaccaaggacagcatctacaggtaagccttggacggcctccacacttctaatggaaagtagatactttgcctatttctgtcataaatttcttttcccccagcagaaacccctcgcaggcttacacctgtaccagggagcttacaagaagcatttataaagaggaaaaaatcatttatggagagatcccaccagaggcagaaagaaataaggaataaaattcatgtctctgaaaattctcaaatcaaaacagttaaagagaaaccatctataagtatgttgaatttttaaaatcttcaaccaactccctgaaatgtttaaagccttgtgtttacaacttgatttcacttttctttcctcaggttcatctgtgagtcgtctaaagggcgtgaataaagtcagagcatcttttcctgaagacagaaagactacacaggctctaaggcaccaaaggggtctaaggtagggttaattttttttttttttttagtgattcactttttgcagtgtttgtctctaattctatataaattctttacaggttatacaatcaactagctgaagtgaaacaacaaaaggaagaaaaaacaaaacaagaagcttatgcccaaaacagagcaagggcaaaagaattccataaggtgagtataactgagggagaaggacttaatttttcaagcatgaagtacacaactgaaactcaaatttttattccttccacagaaaacactagagaaacttcgagccaaaaatacatgctgactt

SEQ ID NO: 66833 - DNA, 4509 bp, Homo sapiens
tgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctattgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgccttagagcctgtgtagtctttctgtcttcaggaaaagatgctctgactttattcacgccctttagacgactcacagatgaacctgaggaaagaaaagtgaaatcaagttgtaaacacaaggctttaaacatttcagggagttggttgaagattttaaaaattcaacatacttatagatggtttctctttaactgttttgatttgagaattttcagagacatgaattttattccttatttctttctgcctctggtgggatctctccataaatgattttttcctctttataaatgcttcttgtaagctccctggtacaggtgtaagcctgcgaggggtttctgctgggggaaaagaaatttatgac

SEQ ID NO: 66834 - DNA, 1136 bp, Homo sapiens
tagcctccagagtagctggggaccacaggcaccactgtgtccagctagtatttatacacataaataacaaagtctaacactccataggaaagaaattatgagcagaaactgcaatatgctcttacaatattgccaactgcagaaacttcctactacgttaatcacaaaaacaataatttcacaatcacgttgtgcttaggagccagaggaatgataaataaaaagtaacatcaagtagctcctttacatgaaccaaaggaaaaagatttaaacttaagatttaagtttaaagtctaactgttgttatgaacttcagtattgcaacagaggatgttgttttcccaattcgaagatttcagcaaattttaattcttggctcaaaattaattgtcatccattataaaatacaggaatataatgtgcctgtaagttacgactttggcattatataacttttaatcaaactctacatcattcaaatttatgaattcttatgacctgtgtaatcatcttttattatactatattttgcattaaaccataaaatcctctgcctcattttagattgtgcattaattcaaaataatgctgtaggcttcaagtaggaaatccaaagttctgattattgctacaaactaacaaattcaggaccctctaatgcttgcaactaaaatgaatctgacacatcactataaaatgtgtgaatctaggattcttcttttcagaaatcagtataaatgggaattaaaagcatggtagaaatgtccctgaataaaatgaaacttgctctgacaacatactgtttcctacacataaacaaatatgatgtgaaaactcaaattgagacatacctttaactccagacaccatgttctcaagataaaagcctttaaaacaaaaagccattgtgtatatcatcaacatgaaattggaatgcaaaattaatactgctgaggatttccctcatatcccatgctgtttatctattctacaggcctggaatcaacctttttttcttaagagacagggtctgtctttgttactcaggctggagtacagtggtgccatcaaagctcagtgcagcctccaactctgcctcagcctcccccctttctgagtaactccaactacaggca

SEQ ID NO: 66835 - DNA, 4296 bp, Homo sapiens
gcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcatccctggagtttccaggagtttgaggttgcagtgagctgtgattgcaccactgcactccagtctgggtgacagcaagacgatgtctacaaaactctttaataagagctgtagcattatgggctatttaaataggatgatcagtagaaaggctagctggttctgagcccatcctttaaaaaatttttaattctgggcatgttttctgagttggtcttggaagaaatgtacatttaggactgggtattaatggtaataagcagtaagaaaagaagatgaaattaatttttttcccatttttctagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgaggtgagtcagcattttacatacatggctacacataactcaagatgcccaaaatgatttgttggccaatttagaattgtctcagatatactgggaacagactgtctgcaattttgatactcttctatactgacttacccctaaagtccaccctatccttcaactgaatcttgacttgtatctcttaatataactacactttgccatatttaaaagatagtgctccaaggctctttgtataaaatcctttgatcttatcccatctcaggtctttaaacacaaccctaaaactcagtggggataataaaagctcacataacttgaaattacttttgcagtaacctaaactaaaaccacacatgccttatgttcagtggatatattcttaaggcctagatgtttctaagccaattatctgaaaaatacgctaatacttaggagtagacttttttaaatatttgagagttgtatgttgaatgaattcagaattaatttatgatcccttgccagaacctgaaattttatttgggaggattaatacatgttaatctcttcagttaatctcttaagtttaaggtgattatagtaaacattagaaatcttattcctgtttttacattttaaaatgcctttagtaagtcccagacatgacaagatatgtacttcacttttccatgttaccagcttaggtaaattcataattgtaatgtgaattttaataatcagcatttgataagtccacaagtggggagtagttaagatagcaaattcagagtctttgctaagggggggcattgccctttttgaacataggcacctgctgggtcttaaaaataaaatctcgacatacttatggtgtttttaatatatagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgtaagtggaatcatatgaaatactttggtaataggttataaattaaatttctatgttaattgcttcatattttgcctttaatatagttatacttaaataatgaacaaagatacagagtatgacaattgggattattacagttgagccaagcttggcacaccgttcatctagaattctccagaacacaaaattctcaaattttgtgtttcctttgactagtattgcagtttcagttatatttcagagtggaatatacaactaattaggtcatcgaagattctgtcatctcgatgataaattttaatattacagagcagaggatgaggatgcaacacatcttgaagataacgaatgtgatatcaaattggcagtaagtgacttatttttttcctattccattttgggaaggcaggagttggttgatacagaaggaattatatttagtttttctcttacacttcatttaacttttgaaaagctctataagtttactgcaggaaatgcaagaaggaaaataattttttagagacttgataaagaacatggggttttcagtactatttttaataagtagcattctgatacatattattgctagttaggatgtcaaatgaaaaaataagcaatgttaatttggatttttaacatctacatgtagtctctaggttatctgaagtaatccagggcattcagctatatgtaattactaaactatttgagttattgcttaatccatgattttttgtttgttttatgcagggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaa

SEQ ID NO: 66836 - DNA, 1839 bp, Homo sapiens
tgattgtgcaaaaaatctctagcttctcttgaatatgattataatttcattacagtaatgggtctagatgtgggtgtgtcccaagtcatttgttaccagggatcaagtactgacatttatgaatgatttatattaggtttataccgtagaatatcgaatatccttctcactcatttcctgataagcttttctgagtggaagaaaatgaatagagttaaagggaataaacccatcatgaatcatgataatcaggggtgtgtgatgagagtgtattgtaatgtcaagctgagaacctacacattcaagcagtatgaaagggttcttagagctacctctgcctttatttaaagtctgcctacacatagtggtagtttaaaaaagtagttagttttaaaattttcataaaattttcgaatcatttatattcctatcattttgtatggtgacttaaaaagttttttaacttcttgtatttaaaagagctgctgcaaccattgacagcttagcaagccgaattgaggatcctcagatacaggctcattggtcaaatatcaatgatgtttatgaatctagtgtgaaagttttaatcacatcacaaggctatgaacaaatatgcaagtaagtggccaaaataaaagttttgtatttaatatgttaatttgctattgatgtttgctgagtaattatattaagcatttggtttttatttgctagggtggcataatatttctgtaaattatataagctgtagagtgtttttttttttaataggtggagtctcactcttttacccaggttggagtgcagtgatgatcatatctgactacagccttgagctccggggttcaaggaattcttttgcctcaacctcctgagtagctgggactataggcatgtgcccccatgcccagctaattaaaaaaattttttttaagaaacatgtctatgttgcccatgctggtcttgaactcctggactccagcaatcctgctgtcttggcctcccaaagtgctgggattacaggcatgagccaccactcccggcccttgtttttttgtttttttgatggcaattagttcttaggagaaaattcataaagtctgtttttaaacattgtaagaatgagaggtaacaatgtctaaaaactagtctttattaagtaaatgtcacatatttgagctggggtaaacaatgaaccccggcactgagcagaaggctgccttaccttttgagattccaggtctgcttcagttcttgcctaatggttatggcaggtctagtatatttgaagtgaatagggccatttgtattctagcctatactctccatgttatgcctaaaataacccaagttttatagttctcatgacctggtgttgatcctgggtctaatcaagttcatgattatgccctaaaaactgggttgataactgtgtgtctgtgaaggaggtaagatggtttttgtccccaggcttcataggaatgcagtctacttgatttacattcacaaatcacaagttaatgcaattggccagtagcctttaaggactttttggcctaccttttgagcctttttgaaatttaacacctgacatttgtcagggtctgtgactacattttatttttaaagtgttagttgctttatttcctttttgtctcagtttgtgtttttgagatggcgtctcacaatgctgttgtccaggctgatctcaaactcttgggctcaagcagtcctcctgcttcaccctcctgtgtagctgggactacaggtgtgcactacgatacccttagttgctttatttcagcagacgtaactagccacagtaaagcaaagcatact

SEQ ID NO: 66837 - DNA, 1083 bp, Homo sapiens
tgctatatagacagttgcatggtctgctggcaagctgtggtcgcttcaaatgcttctgggtagactggtactcagtgtggtctatggtattctggggtgagtctgtttagttgaacctaagaagacacctgcatctcctccatggatgttggtgtgggttattaaaacttttttttttggccgggtgcagtggctcaggcctgtaatcccagcactttgggaggccgaggcaggtagatcacttcaggtcaggagtttgagaccagcctggccaacatggtgaaattccgtctctactaaaaataacaaaaattagccgggcatgatggcaggtgcctgtaatcccagctacttgggaggctgaggcaggagactctcttgaactcaggaagcggaggttgcagtgagctgagatcacgccactgcactccagcctgggcaacaggctttgagactttgtctaaaaaataataatattttctaatttgatgttaacgtttattatttatgaaattgtataagataattttgaacatctctgatttttagtatgtgtgtctataaaggtccattcaactgcaattgaatattggagttgagcagattcgagttgtacatagagatggaagagtaattacactgtcttatcaggagcaggagctacaggattttcttctgtctcaggtaacagttgcagattttgtcttaagcccccttcttcgcatagctacttaaagaacaaattggttaaaaagtagttaaaatgtaataaattgtgtaagaagaaaaaaaatttttttccagtagaaattaaattctgtttaatttctaatgcacattttacaacctgttggttaactggaagtactgataagctgtcctaggttttcacatagtttatgttaagatgaaggaccagttctgagactagcaagttttttttcccacatgtcatatttgtgaaggtttacaaaatctctagggtttacaacatctccagagttgttgtagaaagtgaagaaaactagagaaagggagatcatataaaaaactataatgaccattatccataataaatgaagt

SEQ ID NO: 66838 - DNA, 1049 bp, Homo sapiens
aaagctttgtgtttttcagtgctgcatgtggaaacaaacaaaaagatgatttcctgaaattatagaggacatttgacattcctaggtcaaaactcaccttgcttaatctttgtggtacaaataataattcatgaatatttataccatcctcttatatagaagttagagtttttctcttgcatgttgaaactgaaaaagcacttttttacaagaatatttaagttggtagacaaagtttttgtattcacagtagaatggagttgtgggatttatccttgttatttctagtttggtaaactagagtgtattgatattttggtttttctccacagttcgtaatggacctgaaagtggcagcaagattatggttcagtttcctcgtaaccaatgtaaagaccttccaaaaagtgatgttttacaagataacaaatggagtcatcttcgtgggccattcaaagaagttcagtggaataaaatggaaggtcgaaattttgtttataaaatggagctgcttatgtctgcacttagcccttgtctactatgattttttccagatgtttcctaaagaagtttccagaaactttgacttgaaatgtttgcagatcaactataagcacaaagaagagataacttccaaaagagtgctgtttttaaaaataataattaggaaatgtttatttagcactttcaaacttttcactttataaatgacaagtgctttgaaatgcagaagtttatgtacagttgtatatacagtatgacaagatgtaaaataatatgtttttcatgcagtttaaaatattactaacttaagggtttctatgtgctttttaaaatattccttctttgatgttgacatcaaataaagtatgtggtttaaaaaaatctccaaatacctttttttccccccaaatactttctaaactttttttttttgagatggtatctcactctgtagcccagtctggagtgcagtggtgtgatcatggttcactgcagtcttgacctcccaggcttaggtgatccttctgtctcagccttccgagtag

SEQ ID NO: 66839 - DNA, 1007 bp, Homo sapiens
attctccccaaagacaaccacagcttctggtttttagaataacttagagatgttctatgcatttatatggataactgtatgtctatctgtgtatgtgtgactgtgtgtgtatacacatataattactttatttaagtggaatcattctctatacactgttctgccctctacttttttcattatttttgagatcatctaatgtcaacacatatagatttgcctcattcttttgaacatttttgtaatatcccaaaacatgaatactgatattttatttaactggttccttaccagtgaacacacaggtgcatctccagtcttttgctgctacaattgactgtactgtgctttatgacaacagtgacacatatatctctgcatctatgtgcccatcttatctgtaggataaattattagaagtggaatttctgggtcaaaaggtatgtgctatttaaatatttttacagattgcatcatatgccatccaagcaggttccacccatttacaatcaccacactaatgtttgagagtaacttccatgcactcctgacaacataatgttatcaaacttcttcatctttgccagtctgataacggcccaggtcagtcaactttcccagcattggtttcactgggctgtgataatattgtataatataacatctgatatctaacaggtgttaactgacagaaatggtgactgttgccattttcgagtgattttcctggtttgggtacaaattctgaaacctgatgaaggggaacagcctggtagcctccacctaaacctgcatctgtttacgttgtttgggtttggctgacatctgggtgacttcccaaggccattaaacagaaagatcatggtgagccctctccaagatgagctgagctttggtttctgagcaatcaggcactgagagggggaattaccacctgagctcacaggaggtatgggtacctgtgaactgtgtgcccagggcagctatcagcactgttcttcaccact

SEQ ID NO: 66840 - DNA, 1014 bp, Homo sapiens
cttggtttccccgcatggttccggaagagcgcggcgcagctggctgtgagcgcagggctatcccggcggccgcttcggcagccagggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtaagcctcgcccaggacggaggggagtggccgccccggtctggcccggtgagctgcgattttacggctcacaggcccgagtctgggtacgcccagctgtgatggtcgtgagcgtcaggaagggcagtggccccagttttatggtccaaagcgttctttgcccaggtgtttcattggtaccctggtctactctgctcgcatccctactcctcagttcttttgttcctcatgcccctctgatcggactgtggcttatagtttatgttccacccttagaactggcaccttgccaccagatttgccaagaatagctgtgtccccgtttttcacccctgtctcctacatatttgtccagccgcctaaa

SEQ ID NO: 66841 - DNA, 1061 bp, Homo sapiens
gaagttgccaaattcattgtggaaaatagtttttagttttcctgctctttgcgcaggcatagtcatcgggatgttctttaagtttccatttgacagtggattgaggcttccagctgaaagcaaaaccaccaagtagcatgagtcctggagataatctctccctttggtcaattcctccttcagtactggctgtgtgctgaactcggtgctgacctccaaggacccgggagtaaaagaggcatgatccctgtcttggaggtgcaagtcttgggtacctggttgggacagaaaggcaggaggaaggagttagtcaccctctgtgaccaatctccacctctagcacatgtactagagggactcctaaggcacctgtacctgtaatgccttagatacgtctaaattggtgggctgtctgagaggtatttttggggtattgggagtggttttaactagcaagagtttgagctcatgctgtgtgcatagcactgttgtgtgctgagggagatgggaaaggattttgagaccttgttcttgccctgccctctccctgccctgtggcagtttactatgcagttgggcactagaaggtatctgttagcaggtaagtcattcagctgtgtgtaattcagcacccagccaggtgttgagctatgagctccaggctggtgaaggttggcaggcacttgggtgaggagctgtcaagcagactcccatgttttctgaagtgttttcaggagttccaggggaggacagacatgtgggatgaagctaacaggaccagggaagacctattagattaggtatacatttagataaaaccagaagaagggcttttgagaagaggggagaggtacatagattaatacatggagttggtacagtgggagggatcatgtcatgcagcatttaattttgtgtagttagtagtatgcactcagccaaaaacaaaccaaaaaaaagaacagcaataaagggagaatgaagtaattgaaatggagctggcactttgcccaccatattggccagtgaactcaggccccgggaagacactgagataaggc

SEQ ID NO: 66842 - DNA, 1075 bp, Homo sapiens
taaggggaaaagcattttattattccttttcttcctcctcttttaaacggattttatttttgactactgacgttgtaggtaaagaagtatgggtgtttgaaatttttagtgtgacattgttgaatgtgtatctgcctttaatatttgatggtcttgatgagtgcctaagttatttttgtttcctttattttttagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtagggtttgcttttggcagaggctacgggagtctaccgagagcctttgcagcagccttgtgggaatattgacagtctttaccctgcccatcatttaaaccatttccaagcattaaaaaccttaataccaaggtgcggggtagggggagtgggaacccctcagtataaggagagagaggaaaagaattggtgctgctctacatttccaaagaagaataacttct

SEQ ID NO: 66843 - DNA, 1121 bp, Homo sapiens
ttgtgattagatgcaatgatgcttatgaagtgattagcacagtcccggcatataaaaccttcgatgattccattggctgctagctgcatcttcaactgtaattgctagaatttcttttatcatagcatgaactttatgaaatagaagtcagtgtaaaattaatatgaaaaaagacttctttttctgatgctcaaaattaatgacctcaagtggtaattcaaagaaataaaaaaaatcctattaaagcattttcaaaagagcctaagatcaatgatagctgttgcttacatcctgtgaaaatgagttactggtcctgtgatgctttctagaaatatccttaacaatttttttacttggtattgctattttttaaaaaaacactttaatcatcattctccctctgtaagatgcaatatcaatcaaatagcttaaatatggctaattatcctctttctcgttctgaggatcggattcaaaacaaagcacacaacagaaatgaaaaagaagtagaaaaaaatagcccaatagcaattaagagcatagaatgagagctgatgttaagaaatgtgactcaacctatagaattgtagaaaatccccttgaaacatttaattgcacggctctactctttagaggaactgtatcttccttttgtcccctctgagagctaatgaagaaattctcattttatgagaacacttggacacagggcggggaacatcacaccccgaggcctgtcgtggggtggtggggaagggatagcattaggagaaatacctaatgtaaatgacgagttgatgggtgcagcaaaccaacatggtacacgtatacctatgtaacgaacctgcacgttgtgcgctagaacttaaagtataattaaaaaaaaaacctcattttaagtggttatccagcaacagaaccagaaaattgttacttttacagaaggtaggttttattgcatatacaaaatggatattgttattttaaattagatatgtccaaggtaaacgatcgtatcagcaaacaagaacagtttgacttcctctttactgatttggatgctctttctcttttgtctgattgctctggctaggacttctggcactatgttgaagaggagt

SEQ ID NO: 66844 - DNA, 1168 bp, Homo sapiens
atcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgcctgtaatcccaactactcaggaggctgaggcaggagaattgcttgaacctgggagttggaggtcacggtgagctgatatcacgccattgcactccagcctgggcaacagagcaagactctgtctcaatcaatctatccatcaatcgataagaaccccagattgtatagctacatgttttagcccccttttcaaagtatatgttctccttggtacttattttgacattctgacttttctacatatgctttatcaacctcttaattaaaccatcattgtctattttgagagataactgcgctgcttcccgttgtgtgttttaaatgttattgttcagtttgagtcaaataaaaggatatttaatctgtggtgccttgacattaaaagtggtaaagtgatttttaaagggctcttggctggcttttgcacattatggctgattaacaaaagaggtttaatggatattaggctggttggcccatgcaaactttgttctgcctctgagccactgtgtagtcaagatggttcatgtacaaatacccaaaactagtgcataagtacccttgatcacagtgcctgttcaatatcagtaccaagtgtttcgtgtttatattttatgtaaaaatcagaattttctacatagaagcttataactgcagtctacctgttagtgcatttgaactgatgggatggtatatctgactttgagtacattttgctagaggcaaaaggccattgcttaataggctgagaggcccaactgcatttccgttggttcttgggtagtctggaaatgaaggcatccattttacactcattaaagtgttttaccataaacgatgagataaataaataaacccatcataggtatcctgaaagtttctagtggtttgtcattccagtactgatttctgaggtttttagtagttttaagtccagatcatatttttaaaacttgaaagagtatcaactttacagaaagttgcaagaataatggataactttt

SEQ ID NO: 66845 - DNA, 1048 bp, Homo sapiens
gtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagtta

SEQ ID NO: 66846 - DNA, 1009 bp, Homo sapiens
ttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttat

SEQ ID NO: 66847 - DNA, 1023 bp, Homo sapiens
aaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgc

SEQ ID NO: 66848 - DNA, 1342 bp, Homo sapiens
ggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggaccttaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtgtttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttca

SEQ ID NO: 66849 - DNA, 1073 bp, Homo sapiens
gcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcactcagtgactttctcacacattatgtcagttcatctctaaagattttttaaaattgtttttattaaatatgcatccataggaattttaagctggtgaaatgaatattaatttggtttaaa

SEQ ID NO: 66850 - DNA, 1106 bp, Homo sapiens
ttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatagatgtgagcttctacacctgtagtgctagtattagagatgtgagcctctacgcccgtccctcttatttctaatgatgtatatttgtgttttct

SEQ ID NO: 66851 - DNA, 1072 bp, Homo sapiens
tggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggt

SEQ ID NO: 66852 - DNA, 1051 bp, Homo sapiens
atttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaatta

SEQ ID NO: 66853 - DNA, 1784 bp, Homo sapiens
ttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggcgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctg

SEQ ID NO: 66854 - DNA, 2103 bp, Homo sapiens
gccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggattt

SEQ ID NO: 66855 - DNA, 1032 bp, Homo sapiens
tttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttg

SEQ ID NO: 66856 - DNA, 1054 bp, Homo sapiens
tcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatg

SEQ ID NO: 66857 - DNA, 2845 bp, Homo sapiens
gtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagctgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatcca

SEQ ID NO: 66858 - DNA, 1050 bp, Homo sapiens
gtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcttaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcccatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttct

SEQ ID NO: 66859 - DNA, 1070 bp, Homo sapiens
tgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcaggtgggttgttattccctgtcccggacctcgctttttgatggaccggcgccatctaagaactcctgagcccgtgggggtgggtagcctgtggacacaggccgagccctgcaggtcaggccgcttcgtggtccccaggtaggaccgaagccgcttctccgctcttggctgtttggaaggccgcaggcggagctcacgggcctgtgagctcccggctggtggcagagtgccggagctggatcccctctccctccctcccagtcgccagaccctctacaggtgtcgcccctaggtccttgagttcagcacatctgcactgctttgtgctgagagcagtaagatgtatagtgcagcgaaaaataatgtagaacttttgaattagaacgtctgccctttcagttccattgaagggtccttgatctagggcaagttgttttaatctatctgaacctccttcaccagtaaggtttatagccccgcctatcactgagttgtttgtaaggagttgacatagttcggatctctctcaaaataggatatgccctttaagttaggaaacataccctgacattcctgatggaatatcaggaatatcatcatcaagtcatcagttttgtttcttaactgtaagtcgggtagatgcgcctaggcttggctttttaaactaaatataccagtaaaattttgtacataattttttgtatctggatctgtaaactcaaaatttatataaagggagtttttattgaaaggaaaagcatgttgggggagagggtaagatctgtggtataaggttactatatttgatataattacaagtgaacttttatttattagcatctgttaagtgtttaatgaattgatgtatggtcatttttgtgttgcaaggttcaggaattagtttgagaatcaaag

SEQ ID NO: 66860 - DNA, 1128 bp, Homo sapiens
cctgattcttcgaaatagtatttttaggaattagaagtttttatttctgctctatattatctgtgtgtctagtttataaaaatcttgaatgcacctgtcttcattgtattagttatacttcaaaacctttaagcattcatcactgttagcataacaccatcatacctaaaccagtagattaaaaataatagttataataatataattgacttagaagaaaacaacaaaagtaagaagcattagaccactattagatcatagtttgttgttttctgtcagcatcagtatttagtgtatgtaagggatatcatgagaaaaacaagagtttagacagggtttaattgtatatgtttgcaagacttatctatgcagttgataaagcctgaattattgttttactaataacttttgtatttgtgttttcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctaggtattatttgggggtttaaggataattatctataaagatagcaagcaatcatctatattttaaaatcatttatataaagtcattaggatcatttaggaaagagaggatggaaactaacatttattaaaaactaactataccaggtaccttattacattattttatttaatcatcatgtatccctata

SEQ ID NO: 66861 - DNA, 1012 bp, Homo sapiens
aaagtgtagttaacactaacttgttcattcttaaatcagtagtcctctcctccccaaaaagagatcttaaattattttcattttaaagtcatctactaacaagtaagtttttattcaacttaattaaatctaacaccacaagacaattttgttttagttattgttttggtttgagttgagttgaaagatttcttttttttcttctcagcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttg

SEQ ID NO: 66862 - DNA, 1055 bp, Homo sapiens
caatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacacaaaaggcatgaattcattttttacctgtgtatgtctttcttggatccagaacattattcatccagcacgcacttagttatttaacatctactcactcagtctctccagcagcaattttgcattgtctatctagcccccctgtgattgttcccaaagttttgtcttctcaacaccacaacactccaggggaagggaactaaaccagttgctctttacttcagttaaatttttaagatgtccaccaaggcttatctctttcaagccatcctacgtaacccagtcaccctagactaagtaataatgttatttaatcaaagattaaatatttatttttgcttagaacttattagatcatctcagaaaagtcagagataatatatgaactgaatcatcgtgacaacaggatcttgagagttagtgctttagtttatgttgtgatctcttcctagggagatgctttgtggcagaggttgctttctgtttaatctggcctaagttagtggcaccaaatgacagatacagctgacaggcagtgatgatagaataagaccttatttatccaagcagactgctgaatgaggttgcttagcctgaaagtcacagagctgatggctcctttctcacttgagaatggattgtacccatg

SEQ ID NO: 66863 - DNA, 1034 bp, Homo sapiens
caaatctcctttgagagctttatgagatctaatacctaggtagagtcttcacccacactgggcatttattcatccattcaatcaaccaatatttatgaagtgccaattatgtattcatagtattccagtattccatagaccccaatgtccatctatgcaggtagcttagttctaaaaaagtgattctcaaagccagaattacatctgtaagtttttgatggtctttcccattcacccaccccaacttatcaggcatattagtatttgtgctgtcattagaaagtatttcttcacttcctgtttccatggttgcattatgtttttcattaaattctcaaggttgcattacattttagtttcttcttcatggactttgtctatggcagggtttagacttggatggaggttaaatacccaatagaaattctttagtaagttattttatatggcctgaggcctgaaaactcttttctaggctccagaatctcctgagcaactctggggcttcctgtggctaaagggaggtgttggaatttcagtaacaggtgtgatggatcaaaaccttcctcaaaatacatgtgtttgatgccatttcattttacatttagtgcttggttttcccaagctgaagtgaaattcaagcatcagagaaaccagcaggggttgcaggttgaagttaataaaacactcaccatgggcctatgtagttcagattaataaaataaaatcatggatgtgagagcctaacctcacacatccatatcatcttgcaaatctgtttcctggaagccagagggtacctaggccactgggccaagagagatgggaatcttctttgaaaaccactctttggttaatcactaaagcctatttttgtcaaacaaagctcttggagtctctacttcacttcccaaagatactgcaaagattaatgaagtgattttgaattacctgttgtaaataagtgttgctttttaaggatgtagtattattgttaatactatttaataatcagcaaagatataaaatgttgg

SEQ ID NO: 66864 - DNA, 1045 bp, Homo sapiens
agatattgttatttgtttggtgcatctcccataagtatcatatttttccaggcagatagccaaaaagcaacaagtcaatctaccatgtctgcagtctggcaggcaatgcaggaacccgcagggcaactctgaacagcattctagagaccaaattaagccagctgggctgactacagcaaatgatgattggtgcctatcctaattaggctgacaggacttctactgtgtggatgtcccacttgctgcattcacagatgtgatgaatcagtcatgttcaattactcaatcactttcatttgagaacctgctacatgcagagcgttatcaagatctctttgtaatatgggcaagagtttggccatgagttgtaatcagcccaggtacagtttgcatatagagagattcttcaggctggccttctcagtggtggccaatggagtgggaatgatctttttacgaaagccaagagcccttgtaactgtgcctttctattatagttttcaaaaggaaaaggaaaattggtctccatggtccctcttggctctgaagtgttcttttaaaataatatttattgcatacctttttgagattacaaaagcaatacatgttcattgttgaaaatgcagaaaattacaaggaagataaaaagtagtcataattctaatacaatgaaaactgcttctaacttattagttcaagtttttttagtcattttttaggcaaatagaagagtgtgtatcttttaaataaaattgagatcccactatatcctgccctgaaattctaggagtctataaactatgcacaactaaatagtaaatttcttgctcaaagcctggcatacaatagtcattccacaaatatttgttaactgaatggtgaggaaaacctggtttgtgggcttgagcaacttcacactcaggccatacccaaatctagacaacgagctttgtgtgccaaaggaatgaaatgagctagaaactgaccactttccttcaagaaagcttctcttcacaaagagaacatcagtggtaattcaaatccc

SEQ ID NO: 66865 - DNA, 1075 bp, Homo sapiens
cacaggaggcaggaggaggtgggtctgcattcagaaggctagttcagagtttatggtgcttggtactgtaggtgcagtaagtcagggctgatgtcaccaggccgtgtctcaaatttcataactggcagctctgtttccttcttgatgaccaagttgtttacttctcagaggaaattaattgggtcttagatgtacaattccaggacagttgttctcaaatgtgattgagcatcagaataccccagagggtttattgaaacatggattgctgggccgcacccctagagtttctgtttccttggttgattgaggatagggcctaagactttgcatttctaacacgtttccaagcaatgctgatgctgctggtactggaaacacatgttaagaatgaccattttaaaacatagcccctttaaattgggcctggactgagatgcttaccctttggaatggagtttgttcatctataagtaattgagtttgaaacagatctatttctaaggttattagttgatatagctatatttcttcctctaatcactcttcttttgtgcctcactttcctgaccatgactttttcttctatcatttgtctctcactccttggaagacatgccacaactgggtatatggctaccatattgccttggtaaatcacttaggctctataaagtaagtgtatttactaaatatttatcttctaaggttattgtgtggcttaaatgacatagtgaatgtgaaagagcttcataagaagtgaaattttgtgtaaaatagttttcttaaaattattttctgcatcatcagtatctttttggagcagtgtctctgactgacggtaagtttcattgctacttgggggacttggtaacgattgcatagacatatgcagggaccatggacatactcagggacatcatgaagaaggttcctgcagtggatggatggttaagctagggtctgagtgccttccaaatggaaatgttttggaggctgattgataaatagttgtagtaaggaccaaaggagagcccagtgctggaaaattgcttgagcagatgttgaaatatta

SEQ ID NO: 66866 - DNA, 1022 bp, Homo sapiens
agagcaaagaaaatgccttctgaaatcacagtaagcttcaattaagacacctgggaaagtaattttaaaagcatcacacaaccatttatacaaacattgaagataatggcggtgtcaggtttgtttaaactagtaggtttgttaaaggacataatcctgtcaggcttatcttcccgtggtattgactggcctggcagatcaaaaatgagtggtaagtggcataaaaatggtgaataaatataccttagctgacttttagagttgatcctgtatgatagtcatcaaaaaactgaagaatagagtctaaaaagtctactttgagatatatattagcttaaccctgagttgaggcattacatttccccaaattctaacatttcttactttcaaatttctccaaaataaattccaggagtttggagaaaaaaattgaaataaagacaaatatttacattttaatgacatttattaagtgactaaaataactttattagtttaggaacaaaaaatgggttatgtgtaattgtttgttcataaaataaaatactgaatttcttgtattaaatttagtaatttatttaggcagtagtcacaattatgctaattgaatttactttgaatattttcaatttctcttatagaagagacattagggagcatgacatttcttattttggacagaatataaattaggcagaaatttggatacagaatcactcactccttaaatatctgttgagtgaataactctgctttgtacaagtcaatactgaggtggagaatttgatggggttacaataaaaggatatatagttcatccatctgatatttgagggtctgtcatgtgccaggaactgggctaggtgtgggatatatatcctttgctccccatggaattcatattctataaaaggaatgtaatgtattaagatgttagaaaacaaaagacaaatgaactgggttcgttctgctctaagaagagaagaaaggattcataactgtctttcaagtatttattttat

SEQ ID NO: 66867 - DNA, 1049 bp, Homo sapiens
tgatttagacatttttttcaaataattattgtaaatccattttgagacccttgatttggaaaaattatccagttatctgttgcataggatactaaagaaaatattacacattatataccttgaagtgaggttggcctttttaaaaaaaaaaattatcgtttgattggctaggccattaaaagactcaccgttttgaggatgaaaataggctttaaattgccatgtatgttatgatcctgaaggaatagactttttctgcatttttggtagtaaagagtttttcctatgttgtcagtgaaaggaacagatcactgcaaagaagagatttgaagttcatgttttgatctctgtcctattatatcagagatgaaatgaaagaaaaattatggaacaaaggtgctagggagaggaaaattcttttcctcttgtttgtaatgctcagtacagaggacaaatccatcactccctccctcagtaactaccctattgtcactgtctctgaagatggagcctcttaggcagctgagggtattcaggctagtctagtttctgataccttctccagggccacttagcccttgacttgcatgccaaggtggccaggtaaggagactttgaagaaccttttgacaataccatgtagccttttgttttgttctttgatagaactggacattttaagcttattttctgagtaatggtgtattattggtcttccctcatcccaaattcttggaaagttgaaaatgtaattttagcatagtttgttagctgaatagtctgacctaaacaaaactctaaaagctttcatctcttatctgcctgagcatcttgctgctgttctattttaaagagctcactgatttgatcatctcttgaaagtgaactttacgggggtgattcctgttatcttttcctgtcttcatgaacagaaactaaaatttaccgagcacttcctatgtgcttggaacactgttaatagccctttctgttgtctcaattaatcttcgtaacagccctatgtagtaggccctattattattctcact

SEQ ID NO: 66868 - DNA, 1050 bp, Homo sapiens
gttttgctttccttcagtggcctccctgcttccctcctttctgtcctcaaccttgaccattcagaactttgtgacacattcagtcccgcagaggacttgactttcgctggtgctgctgcaacccttggaaccgggttgtgtgagaacattagagcatttgcgccttcactcagtgtgtcttgaggactgttatgttgacctcacgggtcattttggtgggtggctggacttgtgataattctgaatagtaactttggaattttatgaatcaaaaagaaagagctccctctgccaagttgaaacactgtgggagaatgcctggtgggttcttgtgagtcacacaggaaggaaggaggacttgatgggcactcatattcacttcgctttctttcccccagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttggtaagtccttttaccggcacttgtgttggaaaagcaaaatgatcttacgtttctcatctttagctcttttgcataattcagatgtttattctctaatcttgttttttaaatcatcatattggattattgattgtctgttcatagatgccttatttttaatcatgttttgctatggtgttaatagactgctttactctaatatgtgactctgtctgagagcatcatacctaaacatgtaggaacttcagaattataccacttattttcagtttttctctgattcctaaatacttttttctcccctttctcagaatctcatttcttttttccttctctgcttttgtttttatctctttttgcaaataatttagaagttaaaagaagtaattcagaactatagcaaggaaggagctgtctcctttgtaaaaacttcctatctctttttgagggcttttgagactggttaaactgtgagggaatctttaaaccactttagggaagg

SEQ ID NO: 66869 - DNA, 1737 bp, Homo sapiens
cctcttagtgttatatttggaatgaatgaaataacacatggagagaatttagtacaatacctggcacatcatatacatgtttaaagtagttcttatgcttgtattgaagttattaatgatgaacttggagattggcacgggaataagaaagagggttggcagagatgttgagaaggttgaattgacaggcagtggctgtctggatgttggggtaaagggagaggaaggaattttggaaaaccttcagttttctggcttgacagaaagtagatgaggcagggaatacaggggttggcatgggtggttaagtattttgggcgaggaagacatgttgagttagaaggactcagggccatcgtctggcagttgtagatgtatgggtcatgagtcagtagttgacgacgaggggtaggtgtggtgtcactgggagacgcataaaggtggaagagcactcaggacagagctgtaggaaacaccagaatttaagggacaggtggagagaagggagccagagatggtgcatagagagaggcaggagccaggaccaagaggaggggtgacctggaggccgaattaggagagcattgcaggaagagggtaaccaaccatgtcaaatgcttcagaaaagttaggtgtataatatgagggctggaaaattctcattggatttgcttactggtcagagcagtggggaggttagtggatggagcatttgggaaggggagacagcaagtgtagggtacttaccaaagacaactagatgagaaggaaaagtgagatacagggtggtagttagaggtatatgggagggccaagaaaaggtggtttcttttggtttgattttggttttctcttgtatttttttttaaatgggaaagacttgggtatatttatgtgatgaagagaaaggaccggtggggagattagagaaaagggaggggttgaaggatggaacaatgtttaagaggaagcagaggagagggagtgcagaatagtagactcgctttgaattggagaagaaaattccatgagacattgccaggtaaatggaggtgatgatgcatttgaaatcttatttttaaatgttgctgtagttagaatgttaattatgtaccacatagtcacagacatatatctcctgtggagctgcctgatatcttttttcctatgtttatcttttagttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccacgcagcctcagcagaacaacgaggaactgcccacttacgaggaggccaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaagg

SEQ ID NO: 66870 - DNA, 1075 bp, Homo sapiens
cttgaagaattaagtgcttaggagcttgatgcccttgaggaatttttttcccctgtcacttcatggtattgtaacattctctttggaggaattcagctttttgtttgtctgtgaattctctggtcttgcttgtttgtttttccaaatgtttttgtagcttataggatggtgatgtcaaagccaaattgctcctgaaaaccagggcctctagccaactcctgtttggtctggctgtgagaaactcgggcttctttgtccctcaacttaactaaggttctcatttttcccatttgtttgtcacatacacacatgcataccagaggcaggttactgtctgctaaaggcagaacccctggaaatacctcttaccattcttagctgtgtcttctcagtcacggaaactttttaaaactgtttctttcgaaaatggatagcgctgcagaattcccatcagctctaggccagaaagccaaaaataaaatattagatgtgaagaaaatgaactggtggaaatgaaatttcattttattggggtttttaaatagttatgttggagctttgttgtattcttgaattgagtgggacctgattagctctggcatgtttgcgttattttgggataaacccaaatcatgtttaaaggttgcacaagagcctatctccaccgctttgggatttgctaggcactgcaggttcaacatatctggttaaactcaagtttgtgttaagattctggctgttaaatgatgtgcctctctaaaaacagaagatttcttggacattcaatgatttgtttaaaacaacatattgatgagtcatgggtgtaaatgagtcagaactatatgcatttgatttcccttaaaattcttgcaggtctaaaaattaacagaaaaaaatgtgttggaccatattgttttaaaaataataatttgctgttttcaatgtagctggctggcaatcatcatcttacccttgaatcttattttagctattttcgttttctgtctcttatagaacttaaaggagactaaaatcatttcctaaaagaaaatgcctcctggtttttttatttcta

SEQ ID NO: 66871 - DNA, 1055 bp, Homo sapiens
taggtgcccattttacatattcataacatgccatgtagctacatacataatgtagtcagaagggggaggggacttgatttttgaattttattttgttttccttagatgctgcttaattctatctagttaaggaagagaattggacagaattcaggagaggaaaagtgggtgaaggagtttgtggagttttagcacggcaccctgtgatcacctctccacaagcatttacacctttctctgtatgggcatcagatgagattgataactgagctggggaaattgggagggaaaggcttcatgagccaatgcgagatgcagagctgatctctgttccagcatgaacaccagcctctccattctgtgtctgtttgcattgagacaaagcaagaaggtttcctatgatcaaacgcatatccttgtgttgccagggacaccacgatcatcaaccactcacggaatggcagctacggagagagctcgctggaggcccacatctggcaagaggaggaggaggtggtgcaggccaacagaaggtgtcaggacatggaatacacgtaagggacgactatgtgtgacgtgtggggcccgctgcattcacactccaggccttccagaacagattgcttctctgtcctgttctgaaaggctgtgagcatgaggtctccaaaaactctcctcccccatgctgtgccatggagagaaggaaaaggttccaacctaagcacgtggttccactcagcaatggatctggtgccggagttctctgggggaaattgcgtgtcacctgccggttttaagatgcaggctgagtctagtgacagaagaatttagatgtctgtgttatttcttggtgtctatctctatgacattatgagctgaaagggggaaacattatatcccaaagattcagagtttttgagccagaatttatatattccagtccaaaataaagaacatatttagctaatgcactcttctgatgggctacacaaaatttccagcagactttttgacataataaaactagcctgtcccccttcactacctaagggctt

SEQ ID NO: 66872 - DNA, 2083 bp, Homo sapiens
tggtttgtatttgtgtctgaatcctggcccagtcattctgcatgttcccactgtgggctggatcatctcacatgccctgtggtgagaatcctgggtgtgcagtggtatcggacgtgggtccattttagagaacctggaaagcctatgcccctcctgaggaatgggcagctgatgtttcccctctatttggcagagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaa

SEQ ID NO: 66873 - DNA, 1093 bp, Homo sapiens
agtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactc

SEQ ID NO: 66874 - DNA, 1121 bp, Homo sapiens
tatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtac

SEQ ID NO: 66875 - DNA, 1091 bp, Homo sapiens
tgaattataattaagtgaaataagtcaggcacagaaagataaatatagtatgttctcactcatgtggcggctaaaaaaggtcaagctcattgaagtagagaacagaattgcagttattagaggctaggaaggggaaggggaaaagaaaggctagaaagaggttggtaaacgaatacaaaatcacaggaataaattctagtgttctatagcactgtatggtgaatgtagttatcaataatttattgtatattttcaaaaagctagaaaagaggattttgattgttcccaacacaaatgagaagtgtctgaagtgatggatgtactaattactgttttgatcattacatgttgtatacaagaatcaaaatatatctcttctgtaaatatttgcaattagtacatgtcaactaaaaaggaaagaaaacacaagcaagcaatcaaatgtgagagaggcaaaaatgcccatatttggatatactgagcaaaatgctagtgaagttcaaaggagataagaaaaaggagtgacagattttcagaacacaaaattgatgagctctttgaaagttttgggtaaacagagtcttttaaaactcctacttgaaatgcactgtaggaagtaaaggatcattccttgtcaccagatctcaggaagcatgtggccacctgttaggaaggctgagtttttaagccaggcatgtctatattctttattgttgttgttttgtttttgtttttttttcttttcagaaaggaaaggaagggatgggaataggagaagaaagggaaggaacaaaaagtagatgtagttgaacagaaagcctgaggagttgctgatacataaggaggggatgggtatcccacctttggagcctttggagtgctacttcagcaggtcttccaacaggaagtccactgtgattacacatgatggactggtgttgaagtgtttggaagggaggttttatggaagcctgaggggcaaggacatataatgtatcttctaattaccctttatcgtgagcccttgatatggtttgactgtgtccccacccaaatctcatcttgaattgtagctctcacaattccctcat

SEQ ID NO: 66876 - DNA, 1108 bp, Homo sapiens
ttagaatatgcttattgatatatgcttaaaatttaaagcaattaatttgacatgtacttcaagaaagaaaatagatttaaatatggatctgtagcatttcacagttggaagagactaattactgtatgatatcaaccatgaaatatttataataaaaatgctaaattattttattttgatgagggagacttttctagtatgcctcaaaaaccaaaaaaaaaaaaaaaaagcctgccttgatgcttttgttgccataaaatcctaatgatcagttttgttttttttttcagtgagctaatataaaaaaaattgaacccagagttaaaataagtaagtgttaatcttcctttatcattgacaggaacaagaacaaaaagctgaagaagagaggattcgtatggaaaacattctgagcggaaaccctctccttatctcactggcccatcccagcctcaggccaacttcaaagttaaaagaaggtactatacagtaacggagtaatggagtgtgtgtgtgtgtgtgtgtgtgtgtgtgtgtgtgtgtgtgtatatgtgtatgtgtatacacacaggcatgcagattataagttggatagcaaggtgcattgtaaaaagcttctaaaagtccaccgtccattcactgatactcttctctgttcaattaggaataatggaagaagccaaatgaaagaaaataaacttattttcaatagatagttgcaataaccagctgtgtactagataatgatgtaagcactagggacagagtaataaactgaggcccttacattttaggtgtgcatatcaagggtcctcaagatggcctctcacattcagacactcactagaagaactcaggggacttggtgtatagttaatatgcttggctaaggtaataaagacacacagctagattataaagggaaaagacacacacagagaatagaggaatccatgtgcaggtgtcactatgctctgtcccttccatgagtggtcacacagcacattgtttcccccagcaaggacagtgcagcaacgtgtgcagtgcttctgcccagggaagcccattaaagatcccgcgcccaaggtttttactgggagtggctagt

SEQ ID NO: 66877 - DNA, 1782 bp, Homo sapiens
ttagggagggaagtaatctaagcagaaggtttttaaggattagcacatcagttaatgttaaaattctgtgggaccctagagcctataatcaatttgcagttttctacatacaggacagtgaaaaacctgagtggcatccaatgagtaatatctaactatgtatacatatcagcagttaattctagagttaattgatggagttactcataatagttaaaacaggaaacctaatttcaactgaaatttaatgattattcatttgaaattattttcttctgagaatttagcacacttttttgcacttttgagtatctttgctgctagcttaaagttgttttgagctacataaaattgttttgactttcttagggtgatacgttgtacatatgtactgtgttttggtagtgtgtattttccctccaatcttctgggctctcactgttcttttaggaggaagatgaagattttgaagaagaaagtgatgatgatgatactgcagctcttcttgcagaactggaaaaaattaaaaaagaaagagctgaagagcaggccaggaaggtaaaaccaaagtattaaatatttacatctatcttctcacatacactaaggtagaaatttttttgaatataagtaatatcttcttatattagaaatctcctttaccgtgtctaaatattatagcacttgtagatctataaatgattatttttatgacatcctaggtatcctggttatgtaagaaattctttccaaatagttcagatgcactgagtaatattcacaggcttgctagtcatttacttgtttattcatttgttcaacatttagtcgatatctgttaattgacaggagaatcaaagatgatcaagatatagttgtggtctacaaagattatctctctgcttgtctactgcctaggtactattaaggcaatcagtcagtagatattatataacctaggtcaagctacctaacttctctgagcccccacagtctctctgtttacacaatatgaggaaaaaatataaaactcaaagatagttaaaattctgaataaattacccagagtgataataagaggtgaaactgaggaggcaagtgcaagtcagagcattagaggtttgcaaaacaatactgaaggagtctagattttttctaaaggacatgaagagctggttgatttcagcaggagattgataaaactggatacgcattttagaaagattactctggcaaaatatggaggatggattggaaaaaaactgagttaggaggctgttccagtaatcctcccaattaagagactcttagcttgtatgataggagttggaattgaggtaagtaattagatgctgataaagctgattatcaaggaggtcaaagtgggaaggggagcaggaaaaaataaaaaaggaggttgagttgacagatagtgactgattgattgtagcagcagagaggaccctcactttctaggtaaatgttggtgccatcaatacagggaatgcaaaagaattgccatatttaggcagagagaagaggtagttgatgagttctgttttgaacatgttaaatttgacacattgtgagacattcaggtagggttgtctgcccctgttttcaaccagagcagcacagctttttcatagatttctgtgtaaaattttatttgaggcaagaattgttctgtttttaaaaaagaaagtaagaaaatatactgcatggtcaataccaggaatctagggaagtagacttcatgtgaatcaggagggccagggaaga

SEQ ID NO: 66878 - DNA, 1032 bp, Homo sapiens
taacactaaaattctgctgtgattttaaaatgtgaaattcctactaaccaggaattttcatatgtagatagaacaataaataatagaaataataatgcctcagagtatgcactatgagcaccagtcagtatattaaaagtattactgttaagttctgagttgatataatcctaataaaaattaaagacattttaatcactgtaaagccttattataggaaaatatgtgattgaatttggacttcttgaaatattgggaacatcacaagagtggctgttagtaaccttcagattaaattatgatcttgtctacttcccttttttctgcttgaaggacaaagtctcattcctgaattgtcttccattactacagtctctgtgtgtgtgtgtgtgtgtgtttaagtaacatttttgccctggtttgtttctactttagacagactactcaggatgcccctgaagaggttcgtaaccgtgacttcaggagagagttggaagaaagagagagagctgctgcaagagagaaaaatagggatcgtccaacccgaggtaccaacactatccaagacatttgtctcataaaattatgttgttgatagtttttctttatgtagcaattggaaaatgttaaccatttgtttacttttacagattgatgtgagctgtactactttcttaggtcattagagataataacaacaaatatttaccaaaggcttatttgcccaggcactgtggatgtgagttcactgtggataatgcttttaatgtgggctccttgtgctcacaggtccctaaaacattttaagaaatgaagtatttgttttactaagttaaatgatttttgtttccccccagaacatacaacctcctcttcagtgtcaaaaaagccacggttagaccagattcctgccgccaaccttgatgcagatgaccctctaacagatgtatgttttgtttcctcctttcatctctaataattgatttaccatgctattctaaaatacttgttatgtctttgctttaagaagtg

SEQ ID NO: 66879 - DNA, 1045 bp, Homo sapiens
ttgcttttccgacactaacagggttttagtgactgcatctgctgcacagtattcttgtgactgctccaagcagaaagtaacttgaggaatgagtccctgatttttggcatcagaatcctctgggggtgaggttcctgttttttttgaacaggccttaaattataacccacaaacgatctaatttatagtatgatgcctgttgtaggagaaaattggctcaacaaacggttgtttaagaatttttttctgtgtaactgtcattgaagtttaacacacttttctctgggacatttagtaactttgtcagtgatattttttgtttgtttttagcttttgtttctactagcctatttgctattgtgtgaagtttagataaaatgcaaaccttacagagtctggtagagtaaggttgagttggaaatttttaaaactcagtcatggcagtactgtattttactagggttttgacatgtcaagtgtcataattcttataatctatgaggaatatctccattccacagatgacaaagttaagccaggtgacttgctcaagcccatatagtcagaaggagaatagggatgcaaactcagatcttcatgacagaattttttgtactaaggcaagcctgagaagccatattccttgtacagcctaagcctcataatttgttttcttgaaaacttttgtttaagaagattaagcaggttttggggaatgagttttagaacttattttaccagtatggatattgattaatactctataaaatgagtgtttgtaatgttggaaataacttgattatatttttcttcaaagcataaaagatgacaacagcagccaggccaacctttgaacctgccagaggtggaaggggaaaaggagaaggtgatttgagccaactttcaaagcagtattcaagcagagacctaccctctcatacaaagataaaatacaggtagtaagactttctttttttattgttcacaaaacaagaccagatctgttaaatggcatggtcatgatatagtagtatgtttgagttat

SEQ ID NO: 66880 - DNA, 1005 bp, Homo sapiens
agtcttgccaatttttaaattttatataaatgttcaaaatgtttatgtaaatgaatatgtattcctttatgtttttgctttattcctcccacttaatgtgtgctatctgtagctctgatatactatttagagtttcattgtataaaaatacacaccataacttgttaattctagtaattatcttttcgttgtagtgataattgcaaataatgccacaatgaacatttctgtaaatgtgcaaaggtgcatgtgtgtgcatttttcatatatatatttcatcaacaggagatgagagttcttgttctataatctcaccacacttgattgtccggcttttcaattttagctcatttggtgggtatatagtgatatatcattgaggtctcagtttgcatttccctgattattaattcacatgttaattgtccatttggatttcttcttctgtgaggtatctgtttaaatctttctattgaatcatcttttctttatggatttctatgatttcttaagtttaggcatagttctctgtcacttatttgtgctgcatatacaatttgccacttctctgcttctctttttggaaccacttttagagtggttcaattatcattcttttcctttttgcttaatgcatggtatttcttgattatgaatgtccctacttgggaagtcataatgatattctcaggtattatcttctaaaggtttcatagctgcacatgaaattcatttttgtgcgtggcatgctggagaaggggccttgaaatccgatggagcagatattcttaccttgtcccacttttataagagtggctttgctattcttggccctttggactttactataaaattcaggagccaattgtcaagttccacaaaaatacttttggaattttaattgtgataatatttaatttacagattaagaaaacattcttaaaaatgtaatgacatttttacaatactaagtcttcaaatctattaacaggttatatttttcca

SEQ ID NO: 66881 - DNA, 1027 bp, Homo sapiens
gtttccatccagggaagagatcactgaggagttgacttttgggtatagacatgaaagaagtaagaaagccaattatgcaggcatctatagagggggaaaacgttctgggtaaagggaatggtaattgcaaaggcctggaggcatgagtgtgttgaggaagaactaagaggctggtttggctagagaagagtaaatgagagtagcaggagatgaggtcagagaagtggggaaggagacggcagatcatttagattcttctgagctatttgtaaaatattggggttttactgtgtgtgaagtgggaagcaattgtgcagggttctgagcagagagcttcgatgtgatctggcttacatttaaataggaccattttggctgctgcattgagaatagacatgtggtgttaagggcagaagcaaagaaaccagttaggaggtttcagtgatctgacaagacagtagtatcttggatcaagatgatagcactgtatattctggatatattgtgaagaaagagctcatagtctttggagtgagagaaagggaagagatgactccaagggtttgggcctgaataatcagaagaatggagttgtcatgaataagacaaggatacaaaaggaggggctgtttgggggccatatcaagaactcgcttttgttcataagagcaagaatataatactggttgagtatccctaatctgaaatgcttgggaccagaagtgtttcagtttgaagatttttttttggattttggaattagtggctgaacctcccaaatctggaaatctgaaatctgaaatgctttaatgagcatttcctttgaatgtcatgtcagtactcaaaaagctttggattttggaacatattggattttggattttcagatctgagatgctcaacctatagtggctaccaggggctgaggggtggggaagatgaggagctcttgtttaatgggtataaagtttcagttacatgggataaatcagttctagagatctgctgtacaatgtaatgcctatag

SEQ ID NO: 66882 - DNA, 1002 bp, Homo sapiens
ttcagcatgttggccaggctggtcttgaactcctgacctcagatgatccacccgcctcagcctcccaaagtgctaggattataggcgtgagccaccgcacctggccccagactacaacagattttaaaaagaacatcacgatggtgggtgtgagtgtgagtgaaggggtgttactgtagagcagggtgggataaacacaggtaatagactaggaaacagcctatctgaaagatgctttgaaacaccaggattttggtatatcagaatgaagtgtccatgtgccagagaaccaagtccttccaaactcaagcgtttgaagtaatagaccagtggggacttctccagagtctgggcaggatgattctagtgctgcctctgtgctgtaagcagggatgcatctcaccacttgttttcttcttgcagatcgatgaccccaacagcaaccttgaggaggcgattaatgaggcagaggccatcacctctgtgaacagcctgggaagcaagcaagccttgaatacagattaccttgattctgattaccaaagaggacagctttacccattctcccttagcagtgatgtccaggtggccacatttactctcacaaattcagccccaatgactcagtccttccaggaacggtggtatgtgaatctccacagcctaatggaccgggctttgaccccacagtgtggcagtggggaagacctatatatcctcacaggcacagtgccctcagactacagagttaaagacaaagtggcagtccctgagtttgtttggctggcagcctgttgtgctgtccctggaggaggctgggccatgggctttgtcaagcacacccgggacagtgacatcatagaagatgtgatggtaaaagatcttcagaaactgcttccatttaaccctcagctgtttcagaacaactgtggtgaaactgagcaagacacagagaaaatgaaaaaaatcctggaagtggttaaccaaatccaggatgaagaa

SEQ ID NO: 66883 - DNA, 1038 bp, Homo sapiens
aagtgaaccatccttcatttattcagtcattcgttcatctgtcaaacacgtatttggacatcaaggttgcagagatgaacaatgcatggatttcatctttgaggagttcaaaacctagtggagagaacacatggtacaatcgtaacacatgaaggacaagtaagtgctgcagtaaaggtactaataacatgttccttggaacagaggaagaaaaaccacgaaaccatggaaattagggaagcctttacagagggtgtgacaaaactcaatttgacattttcaagctatgtacaatgatgtgcaccttgcagatgctcaataaagtaattactgacaactcgttagcagttctgtaaaatatctaaaaggggagaatcctaatagttgaaatgaggcttggggactgtgaattgttgccattttcttcttgatccgcattaattcaagcagcttccagtgactggcttttgttcatttctttaaaagtttgcatcatacatgaaaaaacagagaggtctggatcagtgaaacaggacttagaactattttttaatgttattgctctgcaaagtatttgggacaataagtgtttttgatatcttgcataattaagcaccaaagacttactgcttcactgaatctgaatcacatagaaaattatagaaatacttttattagtttgtttattcattaggaagctcccacagtgagagaaattacaagcagtctctgacgggggctggtcctctctgtggcctttagtagggtgatcctcttgggtggaggtggcagtaattcttggctgccttcccagtgtgggcagcatcttgcctaagctcaccacagaatacgtgtttgtccaaatgttacactacaagccatatagtgtggactgcttgcttttcattaatgggttctcagtcttcccattgtctctctttgtaggtattttcccccaggtcatggattgatgtctaactccaaatcaatttttaagcttaaatttcaacaaagaaagtgcttataaccacttgtcat

SEQ ID NO: 66884 - DNA, 2141 bp, Homo sapiens
acccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaatcatttgcctactttgtttatactggagtagcattctcgcttggtttatttctgcttgattattgagacatgcattcttaaagatatcagaattataggagtcattattttcactatttttttcctgacccagtttcctggtgatatttcttatcactcactcaatattctattggtggaatattgcaaaagtgtaagttgtgcaaaatatatagttattgttaccttttaaaatatcaattgtgatcttagcaagaggcaaattaactttattattgtctcttgttaaccaaagcagtaa

SEQ ID NO: 66885 - DNA, 1688 bp, Homo sapiens
tatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgt

SEQ ID NO: 66886 - DNA, 2623 bp, Homo sapiens
cccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaaggtttaagtaactaaaatggccacttagtttgtgtttatttttttccctggaaatgtaagtagttggagtttaggctatggaaatattagtgcctttaatagatctctttccttgcaaagtttctttttagctcagcattgatctatcttatcaataggaaaataagttgacttggaactataaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgt

SEQ ID NO: 66887 - DNA, 1549 bp, Homo sapiens
ttttcactttagtatcttttaagtaaatactaggaaaaattttttaaagcttttcacaggataagcataaactgttaaaaaaaaaaatgagggctgatttttagccatgtaaaattttataactagaaagaaatgtaatttgtaggaaaattataatttataaaaattagttttattttataacccaacagattgactttacaaaaataacaactttaataaagttatcagaattttttagattttatgggttatttttactgcttgcagagccattagacacaggtttgagtgttgcatcatgaacatggataaatatgcctaggtgtgtgtgtgtgtgtatattgcttatatacacataaaaaaacctttgtgaatgtctaataagattttccaggtgtttataatggttactaaactgataacattttcacttctaggttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcctttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcaggcactgttttttatttgtttgtttgttcatttattgttgttttactgctattggcgataacatgaaatgtgatacagctattgcccataatttaatgtgaaattaatcatgatgaattctatagcatgctactgaaatgccaaattcagctattttctttctcttctaaaatggaagtttcagttttccatatcagatgtatataagtggaattataacacaatcctatcactgacagtaatcctcagtcaccttaaataatcagtgctcacagtgctgcttacagttcatttagttggcacatataaacctgtacccacacaagactgaccaaaaattttctttgcacatttttcctttctcatagtttttttctatatttcgttaagcaaaggaaggttaatatgcctatttttcctgttaggcttttagaaattattttccatgacttttgttcttataatagg

SEQ ID NO: 66888 - DNA, 1050 bp, Homo sapiens
tatttggcagcatgggactcagtgattacttgctcttccctgaaacacttgactcctacctcaagtcctttacacttgcttctttaccaccatctggtatttgttcaaatatcaaggctttcagagaagccttcctgcccaccctatttaaaataacaactcctctcctcccagaccaagttccatttcctctccatggcagttatcaccatctgactacaatgtgtttatctttttaatttttcttcgttttttcttcaacaaaatttaagctccatgagaccaaggatttttgtctgttttgttcactagtatatcactactactgagtactcatggcacataatgggtactcagtaaacatttgttgattcaattaattaacgagcttttagtatttaattactagacaataaatgtccttagtataactttggaaactaaatattttgattttgtcattataaagctattgttgtattgctcgtaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagtacgtgtttcagtattaagcattataccatagacagttcttcagtacaagaagtaatagttatgaaaaatgacacatgaaagtattaataaattatagccattgacatggaagtggcatcatctagctatctggggtttttttgcttgtttgtttgccaggctggaatgcagtggcacgatctcagctcactgcaacctccacttcccgggttcaagtgattcttctgcctcaccctcccgagtagctgagattacaggtgcctgccaccacgcctggctaatttttgtatttttagtagaggtggggtttcaccatgttagtcagactggtctcaaactcctgacctcaggtgatctgcccacctcggcttcccaaagtgctgggattacaggcaggagccactgtgcccagc

SEQ ID NO: 66889 - DNA, 1050 bp, Homo sapiens
tataagattgaattatgacaaactcattcatggttattttagatgatctgctaactgtccatgtcactgggtaggtttgttcacatgggaatattccaagatctcctggggcccttccagataaaaggatagtgtgcgtagtacctgagtgtaggagatgaccagagttcatcactaacatggcaaatcccataccccatgaagaaacatccagacactctgatctactaactgatgtgaagggttattggtaaagccttagtaaagctgaaaacctagagctaaattagaaatagcctcgcttacttgcttcattagttatatttaataatacatagaatttagatggaaaatgcccactttgtaattaaatacattttattcttttaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgttcattgtagagacagttttttacatttctaagtgaaaattcaagcatgagtcttatttttgtcctgtttgggagtatatgactctgggaagaaaatattacatgtagacttctgattttaaaaattaatttcattttatggagaagcatttttctttaagtgttatgaatcttaacattgatgcacatgtaaatatagtggtaaaaatttactgagggaaaaaagcatcagtaatgattggggataggatagaattagaccaaatttgagaatccttcctggaagaacaggtgagttttaaaaaaacaggtgtagtgtccctttagatcactataataaattctggtttgtttagttagtttggtctttttaaaacttattttttaaggaatggtaattacggtataaacaaaactgtactaggttgtgccttcataagcttacataaggtcacataacactg

SEQ ID NO: 66890 - DNA, 1590 bp, Homo sapiens
taaatagtgggtagtaaagcaaaagaaagcagttttatttttattttgttttgttttgttttgttttagccattaagtaagccaaatgaaagttttagatttggaaggagggaaagagagggatgagattcccccttacatacaccacacacacacacacacacacacacacacacacacacacacacacacagtgagagatagagagagagaaagggagagaaaatgaacaccgatgggaaagaatccctgatggattaattggtggaattcactcttggacaaagtggaggaattactgtttttaatgacttcatttgtgatccatcattcagctggagggtcaagtgaaatacagaatatgaaaaagtgcttggaaatttttaaaattcttattcagatgtgaggtagtattctacaatttctgtcatctgctgcaggttctttctccattagaaggtatctaaaggataactgaaacttgacttgctgaattggggtttttcgtgattttgtgagatgaagtttccaatataccttaaaatgaatggttttgttcgataatctttaaagtcctatctagctccagtgttctttgattctctaaaagtatttcattaaaatagcatactatataaaaaatgatttggaagcagaagatttattgtataataagggatttagaagacactacaatgtaattatattgttaggtatgatagttttaatggcgcattggccaaaatcatatctttaacatgtgaaacatttttaaaagagagttttaagttttattactctaagtggatatatgaaaattggtagattttcattgaaatttctttgtagcattctagaatttttatatttgctctgatttgctttcttatttcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttggggttagttttcttagctatttttctttactatttttgctttaaacttctaatattaaaaatatctagagagaatttttctccaattagataggatattatatacttaaaatatttttgcataatttttattactgtaaaaatttggtacctgaagttctgatttattttaaagaggcttttaaagcaaatacatattactgcaaatcataaagactaaacagtgatgcattctagtgatcataggcttttaatgttagaccctttggacagtagatcccaaaacaatatacttgtatgtataagatgctggaacaaccaatggaaaacataccttatgacagcaaaaagtaaaacaattgtgctgcctcatttttttaaactaaactataatatttaatatataccaaatgctagaattgtagattttatgcacacacatatatacttataaacttcta

SEQ ID NO: 66891 - DNA, 1943 bp, Homo sapiens
aggcatgtgtccttgtgtgtgtatagagctaagtataatttatggacataagaactgaagaagcctatggccttttggataccaagtgtcttgggtatatttggaatatgttaagccacttaatgcactgaatgtttctcatttaattttcagtaaaatcatttttcatatttaatctcttacaaataaagatgcttatagcatgcaaaataataccccacaagttttgtctttgctcttgatatcttgtttttatacaaacacaagttgtttgtgacatttttcttagtaattttatacataaagaatgtcactaatttggccaagtaagaggaaagtatcagtcagcattaatggagaatctgaatgagagaagaattcttgagtgaattataacacttctaagtatagttctgattacaaactggttaactagttattcacaggcaatagaggtcagagaggagaattataaagttttgtgtgtgtcggactttaatggagaaaaagaagaacaagaacataatgaaagtgctatatatttggagaagttggggaagaaactgggctgacagggctgtcataactagccaggagttaggagattaagtttgaccacgtttgatttgattgtcttttttatagtctcactgaacttttacacaacaacaaaaagcaacattccatgttttattgaatgatgaacttcactgaggctgtaattttagcttaaggttttgatgacactaagtctgaaagcagacttagaatgcttgtaaaatgtggagaaataagatgtagagaatagaaagaataaaataatactgttttactgagaagcagccctgaggaaaaaagaggtcaattgagggctgattctgactgcataggaagaaaagggtcagtgagcttccatgtcatctgagtaggaagatgtgtacaaatatgactgcagtcacatttatcttaaagaggataagagaagtaatcaaattaggatgaatcctgagttgttagaatgtaagttaatgagattttattatgttttaagtagaatgtaataggtatatttgtcatattgaaatggacctgtatttcctattcatagctagaaagtgggctatggcttaagctataccaacttccagacaaggaaataattggcttcatgtggcaattatttgcttatacaagtatcagcttcatgtattgaatctattacatcattatgatggatgttttagaaaaaggattctgtaagaaaagaggtactggctataaaaatcattagctccatctgaattatttgtttagaaatagtggaaagaaactctactgtgattcttttatcaatgaatttttttctttgtgctttaggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcaggtactgaatgtttctttgaaataaaaaggaatttgcttaggacttaattttaaatatgtgtatattaggaacttggaacataaataatagtgtcttagtatgtgtagaaaagatgagtttagaaagtcagtttaatttaagcacaaatgaatacttctcctctttaagtgatcattatcttctacaactagtttggtgaatggctatgagaaaatttggtttctatttttaagtagtagatagactaaagaaaatacactagcatgataggatgcctgggatctagtctgtactctgttacaagtttgtgtccttttagtaaattaacttctatgggcttctgttctcccttctacggaatgagggagctagattaaatgagt

SEQ ID NO: 66892 - DNA, 1029 bp, Homo sapiens
tctctaatttttacatttttcttaaagtttcaaaacttcatattagatatgcttattgctattttaggggaaaaaaagcagactgggtaattgctttgaagggttgttatgtaatcttcttcgaatttaaccttttatttagttttcaaattgatgtctaacagtatactactataaaacactattttattatggaggttaatggttttcaggcatgtcagatgtgggcttaaagtttatggtgtagactgtgactaagggatatgacattttgaggaggctgtgctgcacttagcactatggtaggtgtttgccccattatctcatccatacagtggccctatgggttttctttgatctgaaacccaacacttactctggtctcacataatttaattatttattctctttattttagtaccttagcaataaatgtgtacaaatttaacatttcttagaaagtcatcattgatacataaaacttttcttttaaaaataggataaaagaatcagagtgtctcaacccttgacaagaggaccaagtgcctttattccagagaaggaagtaagtttatctgtcttaaaatataaaaagtaagatttaaaaataacttaactgtatcaaagaatatctcctgttaatatgaaagtaggaatgaattttgcttttgagtttcttgttcacatgtcagaaaaccatggagatattttcttttcagcttcacaaatatttacagagtgccaattattgtcttaaaagaagggactagtagaaatagaataatacctgatcattgccagagtcaacagttctttcatcatcagatcacctttttagtgaccttcccacctaagtgcagatccaaagtgacagtaacatttcgggagctcagtgacaatagctgatctcggtgaggacgatgcaccatgcactggagaagctatcctgcttatgcctattttcctcagatagcctggggctgctctaagttgcctactacatataaagacttcctgaagcatagtcat

SEQ ID NO: 66893 - DNA, 1024 bp, Homo sapiens
tcaacaaatttaataaatcattttttgtttccaaaatcccattgtccatcttaacgtgagtttatattttgctccccctacatgttctctaaattttatgtattttttattatttaaagatttcgatttatctccctgttgaaatttttttcctcaaacctcataatcataatttttcctcataatcagtttttccagctgctttgttcatttgaaatgaatagttgtccagaaaattgcttttcatatactacttcgttaagtttgttgttgtggtggttttgtgagatgaggtctcactctgtcacctgggctggagtgcagtggtgcgatcatagcttactttaaccttgtagttcattgagttatacagagagtgttcgaaatttttttttctatatcttatggagactagcaaaaggaagaaacctgttattttcctttaaattatctttctgggtaagtctagatttggttgacatagacaagaaataccaatattggaatcctgacttcatcctcttaacatgcagtcctccagtgtacttgaccaggagattgaggcctttgtcataattttgtaaatataacctagaaatataaagttatttctgaaactttaccaggttaagagtattattgtttaatatatttatttcaatagaactcccaaaattgatgaagattgtgtgtacagctcatgagggcagagagcatatctgttttcctcaccctgtatcctcaaagtctatcacagtatctgattaggctctcaaaaaaatcgtgttaaatgcctgactgcctactttcaccaatttgttttgtaactggttcctaatgaagtaaaggatttaagagatataaataactattttgtgtttgataggctgtttgattgtaaggaccaaaaaagactcaggttacctagtaatggggggagaaagggagggtgagaagaaggaccctattctctgattcgaatttttatggcttgtatcgcacttaatgaggatactaaaatatt

SEQ ID NO: 66894 - DNA, 1570 bp, Homo sapiens
gtgtatcacttgcagatgctgtctaccaccttttcagtgacatcctagaagcttctctattaccacagtaactggctaactagaaatgatctttccctaattttcatgagcatcttttttctgatataaaccagggagggaaaaaaacaaagttccttcactttgaaggaatattctcctttagtactgtgcaacagctgaagaaaggtcaaatccaaaaattatgtccattataccaaattgattggttcttggctacaagggaaagaaggaccctgagtagcaaggttagtctgtttggcttgaaagctgagaagtgtgggggaagcagcagcagaaggaacaagaaaagagagagaagagacagaactattaatgcagggtactgataacaagcattgtttgaatgtgggagttcctaaataaatcctcaaaggtatagtggactttctattgtgtgtgtgtggtgggtttgcgggggtggggttggggggattgtggtacactatacacaaaagctatgacagccagcaactacctgcattcagtgtggtcttgaaggcataagcataagggcctatttactctgtctgattagatctgctgagacctataagtgactagctgtatctaacttgtcccttagacatcactgtggtaggagtacagatggcggggaggaagtggaattcactatataaagtaaatacactaccaagtcaaaacgtttagtcatgtgtccccataacagtttccttaaacctgtgtgatttaaacaatttaaaatatatatcctatataacctaaacctgtagttaccatatagaattcctatttgtctttcaaaaatctgaagaaagactgttcttcaaaagtctgacgacatttccaaaaagccttttctaatcttccaactcttccttctccttctatcctctggactgccatgatattcaattgcactgcatttattgcacttagcatactgaattataattaacaattacataaacctttctcctactaggttgcctcttatttgggatctagttaatggagagtttattgttagcaaaataggattttgatttaaagacatttattttaaaaatatcagtagtatatttatattagatacaatatagccaataatatgaaaacttttctcattttccaaaatatgtctgttcttctatggctttattttgttctctttataagaaacactttcagaagtgcaatagcaaagattatttgagaaaataatcttataatgcatttgtgcctggacttctttgtttctttgtttttgctttcgagcatttcattatccttgtggccatgaaaatatttcaattaaatatcatcacttttgaaggaaattctaatagggagcaagaatgtcccaccaagagacagggtcaagacaccagccttagctgctggcctttctcagaaatgtaaagtggccattgcttttaaatggacacatgctccacttcttggaatctgttagtgttttataagggatggctgtttttgagtagttaagggtataccttcaaacttc

SEQ ID NO: 66895 - DNA, 1033 bp, Homo sapiens
agtcatttagttttagaaatgtaaatatgtgtaaatgttttaattttactcaacttgccagaggtagaatgtccctggacaactaactgatacatttctttagggccaatcgctggctttagaagagcctcagctaatcacagtagagctggactgttgtggttttccattcctttgcatcgtattcctcagtctctgcggaaggcactgctccttcctttcctttctaaatctctctctgtctctctctctctctctctctctctcgctctctcctcccctagtttatcctggactcatgctgagctcagcaacccttgaactcattttctatctgacatgtgaaatagttcttaggtttcattaaacatttggaaaataaacgaggtacttcgctctgccacttttcaggtatggtgaagaaaataaaatggcctccctgggcagtactagatgggttgtggttgtgctggccttgctcttgatgagatagcactactgttatttctgtatataccagacctgtcactttgcattttctatttctcagtgaagacatgaacatctagacattccacatgtctatggggaactagagtgtccaggaatggaagcaaatggaaacattctcattatgcaagtgtaactttagctgtgacctaaaatgtattgcctaagacttctataagggtgaaattgaaaattttccattttttttaacctcaatattgtataatctagtcactgttcaaaaactcctcaaacttcatttttcattacttcatagggtttttttgtgaggattaaattaaaagacatatgtaaagcactgagaacagtgtctcccctatcattagtactcagtaaatgttagctatttgtgttatttttaaaagatttcatacaaaaatgtatttttaaacagcaatcgaaatttacttgaattttaatgttttgggttccctagtaccatttaccaagacagtttgttttgatttaaaagggcctcaagtgcttgataacactcagggtt

SEQ ID NO: 66896 - DNA, 1026 bp, Homo sapiens
cagatacttgggaggctgaggtgggaggattgcttgagcctgggaggttgaggctgcagtgagacgtgattataccaccgtacttcagcctgggcaacagagtgagactgcatctctacacaaaattaaaaaattaatcgggagtagtggcacatgcctgtagtcccagatacttggaaggctgaggtgggaagattgtttgagcctgggaggttgtggctgcagtgagacatgattataccactgtacttcagcctgggtgacagagtgagaccctgcccccaaaaataataataatagaataaataataagagtcaaaaaattttggtatatttatagagttgcacaaccatcaaattttcataattttaaaacattttcatcacccaaaaagaaaccttatacccattaacagaaagagttacccatttccccatccttcactctttgttttaacatctagctgctggaaactgctaatccactttctccgtctattgatttacctattctagatcttttgtaaacatagaactatataatatgtggtcttttgtgactggctcctgtcacttagcaaatttttgatgttcataatgtagcatgaatcagtactcatttctttttattgccaaatactgttccattgcatggacctgccaaatcttttgtacttttttattagttgatagtcattgtgttgtttctggcttgttttcattgcttatttttctgtccccctccatgacagaagagaaggggtctcatccatgtctgtctcattcattgctgtaaaaccacgtgtgtggctctgttgcccatctgcccatgagcttctcccactcctgctgataacagactatcctcctcaccctgcactctcacaggagcccaccaggcttgagttgccagagcccatgctccccaccacaaagaaaaaggggttcttgggccaagagaaggaggccatgatttaaggagaagcaaaggcaagaagacacaaaaggcagtcaaagggagtgcca

SEQ ID NO: 66897 - DNA, 3343 bp, Homo sapiens
ttgaaattgatactgaatttgaaattgaagtttttcgttaccaccttagttattaataaccactgaataggaaagttctattgatcatgcatctgaacataaaaaattatttgatttgcacatataagatagtactgagaatatttgcattttagaggtcatgggtgttaattagcaagagtgattggagaagaagggtgggggaatggaagaataaagtttgaaaaaggttatttcatgaaaccactttaagatggcatacagagaaggcagagtgttatctgcccgtaaaaagctaaaattagaataaaatatgaagtactgagattaaaaaagtctgtctatataataaaaattcctggaacctgtgaaggaaaatggtgttgaaacataagtcagaggatatctttttaaaatgtgttaattttagggcagtgctctattttcatcactttccccattttggctcaaactacaaaaatgcttgatcattaatgtatttgtatatatagggatccttactatctaagttttcatatttaagagactgaataaggtgacaaaggcagtcaaaatgtgaaaatattcactgtacttacacattcctcttcactaaactagtgatggatggacatttaataatgaaattcaagtcagatgatgaaatgaaattttgaatctttgtaaaaattcaagctttcatgagataggaaatgatgatgtggaactgctcaaaccacactaaaatcagtgtcagatgactggtaactaaaggaacaacaagataatgagtggttctgatgggtgctttaaaaaaaattgaatatcattgggtgcatttggcaaagtaacaaattctgagttgtttttgcaaaaatgacctcttatgcttgttctacaagagagtaaacatagaaaaaagaccttatacagcttgccaggaaatactcctcccaaatcttgattcattctttgattttattaattgtaaattacaacttattttcatagttttcatgtttttaagatgaagggccaaacaccttttccctattaaaatttggaccttcttttaagtggattcactttgtttccttttttgtaaccaattgtgcatctttggacacaattatattaataatgacatatacaaagggggctgatgagccaatctagaattttccttctgcatgttcatccttaaagagatgaatgtaaaggtatcaactctttcatttaatgttagtgctttagtgaaacatttatataaatgaaaacagtattaaataagtagtattcttcagcatgacttaataatatttcaaacatttttaatcttgaatgtttttgtctcccacaggccaaaaacagagaactactcaaacaggtcgcagcattatcaaagggtaaaaaatttgacaaaagtggaagcatactaacatctccttgagaaagtcatttgtttagcatttcttcttacaatgtaaatttggggaaaaaaaattctgtgaagcccttaaattctgtgtagtagaaaaatatttttgcacaccaaatgaattggtgtgtttcctgttcacttttgtaattgatatacagcattttttaagttgtaaaacattcaaataaaacttcaactggtttgaagtaactttttaattatttgatatccaggaacttttttgccagcaatagtattaaacagttgtaaaggagtgcatgagtagtgctctttatgaaacgcaacatgcaataatagagtaggtatggtttcagaagtcagagcagcagggtttttttgttttgtttttgttttacactatgctaatttcagacaaacagttttcaatttagaaatacaaaaacttttaaactcgaaaaatggcgaacactggttttttgggaattgtgtttttactttgcatcaagatgaatttaggagaaaatcacggtgcttttattaaatgaacttcagatatatgtaaatttgttttttaaagttacatcattaacattagtaacctagcattttcattattggtataggaattaatgtttattgtacagtatctaaggtaaaatgtgtttctgttttgtaaaaactactgtagatttttacttacaagtgcctttttgccacctaatgtttttatttataggaatgctgatcttttgtacatacattttgttttaaaatcatgtttaataaatgtttgtatataaatgcatatgtacagaagcctatttcaaaaggaaatcaaagttgctagtaaaatgtttgagattacatttagaactaactgataatgcatatagattgtagaaaattttgtgatttgtttctgtgtgataagggaagctgttggtctttgaattcatttaattatgtcaaaatagttccccaaagatttaattttaagttgcttcttaaagagtaattttattttttatgtcatgtggcttcatattagtattgtgtgagttacatgttttgctttatattttataaaattttttaaaaattttaatgtttctgcaatgatccatgtatctgctttccctatgtgtggttatctaagttaatatttatgtacaatgtaatttgtaaatttaaagcaaatctgaaaaaaattaaatgatctttttaatccaatctgtgataatctttgaataaattggaatctactataagattcaggcattataagtaaattgtcctaaagtctttaaaattgtctataaaaggttaaggtagggtgggataggttatatgaagttattgactatattctgatccagcggttttcagcctgaaatagaatttatctcctagttattatcagttcagagttttagtttgattttaaagtattgctagatacactgtatagagtgagttgcttctcttaataatttatgggcaaagataaatttgcttcatgtaaaactgttactaaatttataagttttaaaggttttgttttatacaagcattgattgtgaatgtcatatcaaagattggctttcttaagaacacatgattgaaacaatttttttttaacatgacgtgtttcaatagactgttctcatagttcattataaagtgaataccaaataattctttgtccattttgaaagcataatatagggtaattttcaagtgatacaaaaagattcagttagaatcttgtaaactaaaccagtttatttttatgggatcttcatgtaataattttcttaaatttagtactctcaaccatgatagataatgccttaacatggattttaacgtttgcaggatttgctaaattcataagatagttattacctttctttgaaattt

SEQ ID NO: 66898 - DNA, 3750 bp, Homo sapiens
attaatattatctgaagtgatggttttgatgattaatgaaaatgcaaagtatttattatagctcctggtatgtataagtgcccataggggctattactgtttgatcatcttttgtacttgttttatggtcccagacaatgtagtttgacctgtatcaaatgtattatgcagtaggagaacactaaaatcatttcttttaaaagaataaggccttaatatgaatacatatatgacttatatccatctctaagtctgtgctgagttggcttttacttctggcattcagtaatttttgatacattttgccacaccttgatggttagtgggcttaatttattttaatacatttgtagcttactttaagcaaatttagtatatgaaaattaggagtgacatataaaataggatagttacgggtgtctttgtcttatggttctttttgattgacagcattttttaaattaatgagcctttatggaaatttgtcctgtgtacaaagttttagagacaggccagatatatctgcattagccttgagaaaagttgaataaaatgccaactttactgcaaaatagcaatgatttcaaaaccaagtagtaatcagttatagaatattgactgctagatttttctttcctctctagcataagaggtactatctttgtattgtgcagttaattgaagttttctgcttttgttagtgttcctctttaaaaaaatcacaacactaatggggattgaaattagcattgttgtaaggaaaatcctaatggtaaacctaaaataactatacatttgcaactttttcttataaatctaagatgatgaagttattttactgaattgatttcacaaagttatttaatgatttctagagccagacactgaactagatcatgaggatacaaagatgaataaataagacataattcttattttccagaagttcatagtgaggaggcaactcacagtgtagtgaatagagtaattgtcttagctgatctggtgtatgttggcatttcagaacagaaaatcttttgtgattagagaaagttagagagagagaacttagttatactttgaatttgacaaaagcaagggtttttttttttaataagactataagactccatgattttctctatttttgctgttgtatgtctttcagtttattagatactgggtaattacaaaggagaatgtgtaaacctttaaagctggcataatgaaaaacattaaaaaataacctggagttccctctgcatggttctaatagtgaaattacataataacttatttagtttgaagtcatgagatattatactgttaggtatgtcatttatgaaaaattatcatgtagccttcttcctcaaagcactgatttttttcttgtatttgtctaatttagcccaaattttatagtaaccttctttcctttctcattctgtgttagttgtatttctgtgctttgttctctatttttacctcaagtgttaggtggtattgtgtacataatcctggacataaattaaaaaatgaaaacagtgtagcttttggctgaaaagaccattcctttttatattacccagtgtgaaatttctttctttaagcattgaaagattattttacgcataagctagtttaaatgtttatattgtttttactattattgaagtacatttttaaatgaggcattttcccagttattagccgttaagcttttttcgttggcataccagttgccaaactctatttccagtcgagccatgtttaggaaaaaaagaaaactgagaagttttactgatggtcaggtattaacattaaaattatactattgtgaagcagatagacttcatcatttcaccaaacaaactttagatagcttgtacaattcaggaaactgcagttaacatcttctacttttgtaatgaaatgtgagtttattgtgaaagttatttaaaatggtgtgtgtgtgtatgtgtgcaaatatatacatatattttttctttaatctctcagttaactgaactaaaggcagactttcagtaccaagagtcaaatttgagaacaaaaatgaacagtatggaaaaagcccacaaagaaactgtggaacaacttcaggtaactaccatcatttacgtaaaatgataggcaagaagggctaaacttgagtaatagcattcattgacttagattgttattggtagccctattttgtgcatagttggtgcatttcagttttgattttgactttataatcatttttaatcttgatctcattagaagttattgtttgaaattacttgaaagggggattcagtactttaatcttgaaaacttttgcctaaacttcaaatggagtttttggaggagggtatcattggagtgtgttcaattaattattgggcttatagcaaaaaattaaaaatcagattaatgaaactaaggtgaaaagcaggtcttcagtagcaatcattcctcacattaatatttccttccagataatgggaaaggagatgggtgtataaaaccaattcttaaggacctggagtggcaaaaatgtgtgcaaagcaagagagtttacttaacctgtgtacagtggttcgcaaagtgccaaatagggttctgctaaatgctaacaggtagtgatccacctgaacctcagagtactgcaaagtagcagtttaagtatacagaacaactgaatggtaaagtcaagagtcaccacagtaataatctgatgtctggcatgcagagatggtgaacatccaacatggatacagaatgctaccatattaagctgcttctcttctaggtttcatacatttagaaatcagaccacactaaattaattacatgttctctttgatttatacagtctcacatttgtaaaattagtctttagtaacaaaatttttaaggtgaaagaagttttaaatgttaatggaagatggcagcacacagacgtcagacttgggagagtacagcttcagaaggaaggagttaatactgtcctgtttcattttgttttttttttttcacattgtaacaccaaaggatatttgctatttctttcttttggttttgtattattcatacttctttgcaagtagcttaaattagtaggatttaggaacttgctcaaattcgaggtacagattatctggtcttaatccctatcatactattacaaagactgttgaaaaaggaacctcatgtagaacctgagacatagtaggcattcaaataatttgttgactaggtggtgatttatggaaatgcccatcagccctctgttctgagagattgcccgtatcatatatcagattcttatatattagtcaatgtttttatccaccagcaagtattatttttaattttatgttattcctgtttttcttactcagttattaatgctgaatgattacctggaacaaaatcttccacctggtgatctttgatttaatgtaatgtaaccaaagctctgaagtaaatccagaatgagataacagaataactgcaataggtgctcagatatgttttaacttagtgctccccactgttcaaaagagcagtttgtgtgttggtttttcttttttaaaatcatagttgcaaatacatggggtcatctttgacttagcctgatagatatcttaggcctacctcctcttggtaattgaagtttcatgtagtataaaagtaaccaatatttaaataggacattttgacatgattttacatatgctgtct

SEQ ID NO: 66899 - DNA, 1491 bp, Homo sapiens
atatcccttcaactttgttacttaagtcttaccaaaatcagtattttcagtaatattttaggggaagatgaataacttatcatttggtttctctgtcctttttactctaactattcttattaatgtttggtttcagccataaatcctctgcaacaattcagaatgaaactccaaagaaaaagcccaaattggaatctaagccatctaatggagataggtaaaaatgaattcttttagtgttatgaaaattcaacttagttgaatagttatggttgaatgccagttattactagataaaaaaatagaaacatgtattttctacattgacttgagtcacctagaagaataaacataaattagtttaaaatttttagcttaattttggcaataagaaagtggcactgaactatgttgttctatttgggaaataaatttgggttttgaagaaacaaatttgaatggagaacattatttttatctttattcttcagtgaaacacaaatctaattgtgatattttaaattgacctgcttagaaaatgtttttagattaaaaatattatgagcgttactttgttttagttcattagccaaaagtttgctgatgttactgtacaaattggctgcctattgctttacactagaagtattgacccccttaaagctaatactgaattatatttctgcaggtgtatgtaatgtgtgccattagtaaggtaatttgccagttgcatccatttctgtcaggtacatatttttttgcattagccttaaggatgtttgtggaattgtctaatttatgcaatttgaacacctgctaattttccttctacttcatttaactgtgttttacttttttctttttagtagctctataaatcagtcagcagatagtgggggaacagacaattttgtccttataagtcaattgaaagaagaagtgatgtcacttaagcgtctcttacagcagagagaccagaccattttagaaaaagataaaaaggtaagaacatggttcattgaagcctggtaagagttatgtgttgactgttgcttgataatcgcaaattttattagacttcctttaataatttggtaatgtttgttgtgcgtgatttttataagacaaattacaaaagcccctgaagccatctaatgaagatgggtaaaaatggtctttcagatttttagttctaagaattaactgaggcttaattaggatagtaatttccaaactttaattttcagtaagcatgtaatttaaaaatagatctaatacctaattaaaaatgagatgtaaatggaatatttcataaacttttttgatttaagaatgtagtttgaacagtctttgatataacattcatatatttgtatcaatccagtcatatatttgtatcaatccagatcaaaatactgctgaaaagtaatggtatgggaatttcctgtagtagtcagtaatagtaattagcaatagatgtctaaaagctca

SEQ ID NO: 66900 - DNA, 1052 bp, Homo sapiens
gattttttaaaatgcaattttagtcttcacggaaaaatcaagaacatgaaaatacaaattaaactgacaaacacaaattaaaatggaaaaaacggacatatggcatgcccattttcagaataatttattgtttgttcttaaatttttctgtgagtctttaaagtttcagatagttatttaaaacagaatttacaaacaactgatgcccacctcattttggaacacatgcagtatttttagaatgtaatgtagttctgtctaattagtaagatttgttgtaaactgtatccaatcacctattagattatgaggttacgttgaggttagtgatgtttaattctaccatgttgtagtgttttctaaatgtggcagtggtagactacaatgcagtgtcttctcttctggctgttttgaagaaaccttgtgatctttatatcagagtatttcaagaagcaaaataatataagtctaccttgtttttgcttcttgctttaagaaaaaatatgacaaaatgactatataccataatagcatatgtcagacctacttctaagactcccaaaatgtctcctttccctattctttacagataaatttgtcttagcatgatgtaaaaggacacaatcagattatgtttgtgaagactaaagtatgtgacagcaacttaattttttgaaagaatgacaggtttcaaaaataaagggaaagagaacagtattgaaaatgaaagtcttcaatttttttacttctggttacttatgaaatacaaacactattttctatttgatggctgttgaccatttgatgaacagttactttgtagggtcctatcttaagttcaatagatcagaatgaaaatgaggagcattcatattgtgatagatagtgatcggcaggggtaggggatgtggttgccaggtggcactaaggtgggtctgaatctaggaatggacaaccctcagaaagataagatgggaattccaagtgtttctgtcagtgatattaatgtgattattcttaactttgagatatggttagtgctgttagttcat

SEQ ID NO: 66901 - DNA, 1033 bp, Homo sapiens
gacctgtgaacagtgcaaacagcaatgtgcttttgatcggaaggaggaaggaagaagaaaggtatgctttatttatgttatgacatcttctggaaattaaataaaatgccaaacaagttggaaattataattaatacactactgagactggatctattctttaggtccatgaaagcaagtagttagatgaaagtgcaggaatagtgagttttctctttgtttgcatgatacatagattcatgtactatactttaaaaaatattctatggtggctattctgtactagttggctatcccacatttggttcaggagatttaactaattgcttaaatatctccttttactttacccttttgctagttacttgacatcactggtgtgaaaaaaatacctgatggcacattggcacataaaattcagttactcttgtgccttttgataaaggctcatatttgaaactgttgtttgtttttgtctacctgcagtgacttaatgtaataagtatttgtgttcatgtgataattcctttgccgatcagcattcacacaggcctcctgttgcctatcaattttagttgatttggagaatgactacctctttgaggggcttcctcaggtctccccacagcaatgtacatatcccattataagacatgtccctccagcatgtctggtacataaacatcatggaatactatggatggaatacatgtgaacaaacagaagataaaaacttggttttatttttagaggtttagtcagtacttctggaaagtctcttctttgacacaggtacgattgattctcattatttgtggtagttctttaaagttcccacaaaacagtgaatacggtagtacccaccttatccatgggagataccttctaagaccagtggatgcctgaaactggggatagtaacgaaccttactgtgttttctcctgtacatacgtgcctatgataaagtgtagtttttaaattaggtataacaggagactaataaaaataataacaaaatagaacaattatatt

SEQ ID NO: 66902 - DNA, 1062 bp, Homo sapiens
agaatttcaacaagagaggtttgtatactgaatagtttttgactgttaaagacaagtgttgtctttatggaatacttgggggttgtaatcccatgtttttatgaaagtatttttaaaaaatggtttagccccagaaattttaagttgtaaaccttttatacatggtgggagagagaatgttgcgaaaaaaaccagtggtggttaatttacagttagactttatatgagagaaggaataatactacatggaaaatgtacagccttgctaatgaaaatgcaaatgtaaacagttatgttaaactaaaaaaaaatggtaaagccttaatggatctgaggaaaggtctgtagtgttaccaactgccttccaaggtgaaaatctaataatttgttacatagaagaggagtagtacgtaacatttttaacagttccactctgagagtatatacagaaagtagcctcagaaaagaacaaataatttcttcataaataggtgtgggcattataatgttggacagtagccaagtggaaggttaggtaggcactggtattgtaatgctgtgcagtaatagtgtcaagtgtgaagattttggagctatataggaaacattaagatgttttgtttacaaaaagtaatatgcaataaaaatgtataaaaacatttgtcataagttaatttgggtaaaacaactctgaaaatatccttgtatatttgaaaaaaatccgtggtccttattaaagttttaagtacaacaaatctttgactcattttattttgacattgtgctaattactttagaaagctacataaacatgatctatatacaatttatttttcagcaaaactaacacaatttgtaagaagtgtgctcaaaatgtgaagcaatttgggacggtaagtatgtcttatgttttcatgtcattgttaccagttaatatttttcataaagctggaccttttaaaaaaatatgtactgctggctgggcacagtggctcacgcctgtaatcccagcactttgggaggccgaggagggcggatcacaaggtcaggagatggagacca

SEQ ID NO: 66903 - DNA, 1007 bp, Homo sapiens
tcagtccagcttctgacgcaattctggaggtcggcgggaatgcctagattgccccgcgctccccaagcttccattcactgtggctgtgtcgaagctgcaccctctggctcccagtgaaactgggctggccgcccctgttccccagcccttattcaccttttggcgtagcaaccaaccccggttgcctaacattcccaagggccggctgggataactgcccactccctggcctgcaaaaatgtagctcttttggtcacgtgggttcagcggcccctctaggaaactcgccagatcaggtgaggcgcgccagtgtgtttaagagacgttgcagaatagtagtccgccgtctctcgagcgcttactagtcgttgcttatgctgtttcctatccctgcagtgcctcccactcccatccacattaacttcgttgtgtgatgctcgtagccagaacgcgcgcttcctgtcacctagaattactggaacttcaatgtggaaatgcccttttggagaggcgacagggggaattgattttaaatattgttttcgcctcatcaaatgtcaccatccagtttagttactggtattcactggtatttctcaaattggagtgtcgaatgcttaggtttttgaaaaccgcggcattggaaagctttgataggaagtaaatgttggagctcttatttctccagttagcaaatgttcgatgcctggtatactgttagggtccaaatgaacagaatagaaaccctgctttgaaggagaaaaacactgaagagaaactacacgtaattagtgattactgcgcagtatagtttaggaagtgctaccgtagtagaataatctagaggggagtgattaacagtgcttgggtaggctagagaaggtttcctagaagggaagatggagctagttgcgtgtcgaaggaattgtgattgcttgtcccaagagtagagaaaggagaaaaaggcagtgcgggaattttggagtatgtgctagaacagtaggtgc

SEQ ID NO: 66904 - DNA, 2106 bp, Homo sapiens
ttgacaatattataaagaattgaaaactcatcctattttccagttacctgtaaaaccagatgccaatttgccattaagtttggaaaatgacaaatactagtctttgttatatatgaacatactatagtagacttagcacttatttatttgagtaccacttttaagacttggccctaccctcctaagctctttgtccccacttttgattgtcatagccatagtgtgttttatatttatataaatagaaaatgttttatatttgctttcttaaatcacctggaaatttgcatgatttttaacatggaagtaaaatctttaattttaaataagatttaaatacagtgcaggtatttcgatagcctttgtttcaggagattgtttactgttttaaatattcattgtgctcttgtacttttatgaacacggattattctggtaaatgtaaatcttcaaaggtaagaattgaaaaacatagtttgctgtggccgtttgaggaaggaaagtggatgaacattttgaatagctggtagtcatatcttccaccttagccctcagcttcttagttacttcccccagtctaggaccatctgtcagtaggaagtcgcctacaacaaataaaactccacagttagcatctcctgggttgaaattattatgtggaatcctaaatttaacagaatctcattcatgacagaatggtgtactgtggaaataaagttttatgtttgagtgtttgatgggccttaatgttttctaattattttcttttttgttaattaaatgtaaagtatttgaggcaaggacagtgccttattttctttctggagttttgaatactataaatattcaagtagtagtttgtggatggggaatagagtaattcagtcatttgtagcagtttctggtcctgtaaaaataatgtttttatttttctgaacgtatatttcacagtatatatttttaactgcggtatttacattcattgtatcatttaagtatttctgcacagcatttgtattcaagttgtatgaacattattttcttcttgtgtctggcatatggctatattcagactaatatgaaacactttaaaagttgtatttctttaatgattgaattgtattgtttctagtcagtggattttttctgttgtctgtatggacagtcaatctcagtcataaatatttgtgatttaaatctgctatttgtggttcacacttttgaaaggtaatttgtgtctttattttttagaacagctttgctgagccatcaaggtctaatggaagcatggttcggcattcttcatctccatatgtagtatatccttcggataagcctttccttaatagtgatctacgacgctccccaagtaagcctacacttgcctatccagaaagcaacagcagaggtaatcgagcctaacgaaataaatgttatttgtgttttcttgctgctttaaaattcttaactttgtcctccattattttgccattagaggaaaatatatttcccctttgcttccagtttcagcccccagaaaatattatgcttttcttgtattccttatattgattgttgaacatcatcatccaccaaattactgatgctaaaacactttgagtcatcagtgactgctctgtaatccccactattagtccggaatgaagacctttttttgcttctgaaatataccaaaagcatactgttttttctgcctttttgtgttctcattgctttggttcaggctttcatcatctgtagcccagatgttcatagtacattcctcattaatctccctgcctgttttctcctcctcatccccagttaacaacatttctgtcatttgtcattatccatcatctctcccacaaaattaaagctttagcatctcttcatagcttacataataaattcttaatttttcataacctagaccctatatgcctcaccagcttcatccctaacttgtcttctgttttttcctttcccatcctttgctctggctactttgaaatacatttattcctggaacctgccatctgtattagttttcttgtcgccttaacaaattgccatgaacttagctttaaatatttgttatctcag

SEQ ID NO: 66905 - DNA, 1908 bp, Homo sapiens
ccatagtaatggggtttttacttgagcacatttcaaacactcaatgtcttttttttaatttattattattttttgtgagacagaatctcactgtcgcccaggctggagtgcaatggtgcgatctcagctcactgcaacctccacccctccacactccccaccccacccgggttcaagcgattctcctgcctcagcctcccgagtagctgggattacaggcgcccgccactatgcctgcctaattttttttatttttagtagtgacagggtttcactgtgttaggctggtctcgaactcctaacctcaggtgatccacccacctcagcctcccaaagtgctgggattacaggtgtgagccaccgcacccggcccactcaatgtctttaaattgattttttaaaaaacaaatatgagataattaacattttattgttcccaaagagtgatcctccactggactcatccatcaattttattttttatttagatgagtttattctttcttaatatactttctccgcatatgctgttacagcatccacgtttgtgtttgtatttggcagccatattttctgctcttaagaatcttcaagataagattcgacgcttggaacttgagaggattcaggcagaagaaagtgtgaaaaccttgtctagagaaacaattgaatataagaaagtactggatgaacagatacaagaaagggagaattcaaagaatgaggaatcaaagcacaatcaaggtttgttgatgaagaaaattaaaattctatcaaaataagtgttgtgcagtattaagtattctaaaagaaatagtacattagtgttttgtagcggtatcttcaagtactacaaaactgcattgtattctggtgcattttgaggagcaaatgctgttgtcatacatggcatttatttactgaatgcaaggccagtttgactagcacgtagaaagaatgatttaggtaatctgaaaaggcgtccaggtctgtggaaggtgtttttattgtatacacaatagatccaattcctgttaacagcttgttaaaactattttatgggtgagttgatttctgcttttcttatgtattctttttagaactgacatctcagttgttagctgcagaaaataaatgcaatctattagaaaaacaattggaatacatgcgaaatatgataaagcatgccgaaatggagaggacatctgtcttagagaaacaagtaagtaaagcacctcacagattgatactcaagaacagttatggggaaaactaattgaataaagactttttttctttcggtgaggattaatggtgctgttacagcccaggactgaaatttcttggcatcagttatgaaatctaaatatgtgattggctttttcttgttgttattgttgtgtttcgtagagttttacttaaatggtaaaaatacagttgtgagatgtttgaaagttatgttagcttctttgagtctacattataaaaagtgtaaataaccatatacctctgtatctctgaaatttgtttaatgactccagtgagatagtagatgactttgtaaaactcttcagaattgttacttagcatagcatttttgtgctttcttacaccagagatcttcgtatttaggtgacctgtacatttgtgagaagatatctcaacatcagtctcaaatatattgattgatcaattgattggatctcactctgtctcactctgtcacccaggctggagtgtagtggcatgatctcggttcactgcaacctctacctcctaggctcaggtgattctcatgcctcatcctcccgagtagctgggattacaggcgcatgccacgatgcccagctaacttttgtgtgtgtgtgtatttttagtatagatgtggccaggctggtctcaaactcc

SEQ ID NO: 66906 - DNA, 1037 bp, Homo sapiens
attttacatcactggatatttatagcattaaaagtgatcttataatgaagaaatatattggagttttaaaaagaaaatataaatttggagagaatgttcacattttacaatcttggtgggcatttttttttatgaaaatgtttgttaaaaaattaaatgtttttggccgggcgtggtggctcacgcctgtaatcccagcactttgggaggccaaggcgggtggatcacctgaggtcaggagttcaagaccagcctgaccaacatggtgaaaccccgtatctactaaaaatacaaaaattagccgggcatcgtggcgcatgcctgtaatcgcagctgcttggaggctgagacaggagaatcgcttgaaaccaggaggcggaggttgttgtgagccgagatcacgccatttcactccagtcagggcaacaagagcgaaactccatctcaaaaaaaaaaaaaaattaaatgtttttgagtatccttaaggcttgcatcacttggtttaagttgctctctgagctaattttagttttaattatttcatttgggagatatttaataccactgataataaagttccagatttagcctccctatccctctttacattcatgcagtgctgtgttctttggccatagattttacccataattttgtccagctacctcacagatgataaataattgaacacaaaaggagagcatcatggatgccatccagctcacagcctccattactacagtgatctaaccaccttatattgagtaggataaaatttacatgttccagtgctgctatattaaaattttacagacacttaagatttttcacctttatcccttttgacatttttatcactagaaaaaaatgcaagagttggaagcaaaactccatgaagaagaacaggaaaggaaacgcatgcaagctaaggcagctgaggtaagttaaaatgtgagaaagtgggctcttcatatttcttaccgctttttgtgtacaagtaaacaattacatttaggtatcttacattatttgtattt

SEQ ID NO: 66907 - DNA, 1183 bp, Homo sapiens
gctatgagagagatgtaaaaagtgttataggtgatctgataatggactgattgattacctggcagttttaaggaagcctttaaaaataatatatttgaactgggttttaaagaatgatataaatgttgctaatacaccaaaaaaatgtcatctgcaaatatggtttgttcacaaaatggagagaaggggaggatgataggacatgaggctaggaaatgtaggttgcagctcaatgatgtgtatgtagggccttattttccattctgaaacatagttagtggatttatatcaaaggatttcaaatagaagaacatcatgatgagaataattttaggatttatatactctactttagggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagcttgtgagtttttgtttttttttttaaattcagtttagctctaaaacctcattttttaaaaacttgttgactttattaaatcttactttcctttgttgagcaagtatggttgagcacaatccttataccaaccaagttactgggactttaacaaatacaactaataagggtaaaatctctctctttttaaatactgttaaatgttttgaagaccaaggtttatatttaagttttatttctttgagaacttatgatatacagtcatgcatcactgaatgacaaagatgtgctctgagaaatacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatctaggtagagtaaaaatatgatactaaagtcttacg

SEQ ID NO: 66908 - DNA, 1057 bp, Homo sapiens
aattaaccttgaaattaagaactcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaatttattgctctgttcaaaaaatggagtcattttttaaacacatggagcagtaacccataatgaggtataatagacctaaccatgaaacacagaaaacttaaccatgttctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaacactttaattcaaatattaaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttgctaatcattttatatcagccaacaatgtagtactaccagat

SEQ ID NO: 66909 - DNA, 1054 bp, Homo sapiens
gatttccctggcttttgatttgaatttgaagtggatgcaagtatgttaagactagaagctttaaattcttgatctcttcagccattctacattcttttatgtggtatcaggccaagataaccaaggtttaaatgaggaaaatggcagatgcgtttgtgaaatacttggagtagaaagcttaatttttaattactgatttgctagccacttaaatgccctgttaaaaagcttatatttcacacaattaccaaagaaatcattttggtaccaattttgctaaattggatatactaatagaaacttcctcactgcaagaccaagagggaggctaaggttcagactctctgtatagtgaattagtgagtggaaaaacactgtatattttaattgtttgatttgggtgttggttaaggaaaaatgggtacaaactgaacattttcatctggggtgcatattcctccaataatttccaaatatttctggggaaaaaaaagaaatggcaactttggacaagaacaaagtttaaaagtcagttggaatttcttttaattaaaagaccaaggggacaagaagctcctttgttacagtacattacatatggctcttatgtagaataaaatagacatcagagtcaaatgtttctaccagcaccaaactcttacttgtagcaggtgaacagtgaagcaagatttcttttactggctttgagattgtaatacatcttttacatgcagtgtgttctttggtagacttaatcgttgagtgaaattacagaatttgcaaaggaaaaaaatgtaaaatttgagcacagtacttctcactataagctatttatacagaattcagaaaaaatgtcaatcctagtaagatttttaaatacttcttaaaaacttgctaattagcttctgtgtgttcagacacacaagacaagtgaaatacactgtagtaaataattagtttttaaaatatctttcatgatgtttctggtaattgggctaatctgaagggcatggaattctttgaactcctgtatggctactttctccccttcatt

SEQ ID NO: 66910 - DNA, 1102 bp, Homo sapiens
agggctgttaagagtgtgaaaaataggtgggatttattttttaaaggaataaatgggacttgacaaagttttttacaattggttttgttgtggaaatgcttggtcatcttctgcttgatcatctgcttcattcagcttcacagccacaaaaatcaaggcctagtaagtgccctttcttgtttaggaaatctgtcatgttaccctgtctatacttgctaaaatgtaggaaactttaaggcaaagttgttttcatccatgttccatttacatgatgtttatactattttcctccactataaaggaagggatctaagatgtaaaagcttggaagcaatgtgtattttcacagtctgcaatctaaatatttatataatttcttatcacgtacagccctataattggtagaatcttacatagaagcttccaaataattctgaaatattagataggatggattaaacgaaaccttctaactttcaggggttcgtaatttttcatttgattagtcccctaaaattgtgttgtgtaaaactaagacatccagtcaagcccctggcttgggttagagagtgaattttctttttgttagatgctgccaaaatagtggcttacaagggactctggtttgatgggatggatgttccctgaaaagtttacgtcggtgcaaaagtaattgccatttcaatggcaaaagccgcaattatttttgcaccatctaaatatttaataggttggttgacttgtaaattatctgccttagatgtttacttttgtgtattgctgacattttctggagacattattggcattttgtgtgtaatccttaaaaaagaaaaacaactatgttcttgaaaatttaaagaatcttaatgttgtttgtggtcattttgggcagagaatgcctagagttgccagaattgcctaagtcaaaattcagcctgcaaatttagggttagcagatatagcagatacagaaacatcatgatcagaaaagtgataacatgatttttgaaaagaaaaccatacgaataatgccataatggcttggaataatgtagatttgaatgtttaacttcattttaaatactacctcaaaaggatc

SEQ ID NO: 66911 - DNA, 1190 bp, Homo sapiens
atctcctaccatactacatgcagtagcaaagagttaacacatatttcccgttttgtcacacaggccattaaaaaaaaagtgtacttaagggatgagatttaataaaatcagtaatttttactgcgttgttaagtacactggcataagagaaatggactttttttctttaatttaactgtgagtgtctggtagggtagaatacagtgggtacgaatgcagttttaattataagcattgccctgcttgatgcctgcaaaggcaccagaatttttatccttcataacttctgcatcattagtgcaaatgccaacacactgaaaaaggtaaataatgtcttaatattatggaaatagttttgacctcacagcccttggatgtttgtggaccacacttttagaattcctgctttggggtaaggagcaggattctgttttcagttatctgagtcaaaggtcctcagaggaaataactgagaaactaggtagatgactgcatgcttggagggtggatgtcaagcatttttgacaggttttctaagatgtgtgctaatatggttcctcctgatgaagacacattagtgctaagataggagggggtacccttcactcagtggtcaagatatgaacagagaatggtgctttctgaggccagtgtccatgtaacttatttctcagagagaaattaaaatctccaggacaaaaatctggcctctgaggttctgactgcttccatcttttattagcaaccttttaggatctgagtttattaaacagagtagtaattcatattataagcacttgtgtcagaaaatatctgagcagtttgcacatcaaaatgtttctgcttggcaggataatgggtgattttttacttactttgcaatgctctttaaaagactttctgaaaatttttatgtatttgagacagggccttgctgtcatgcaggctggagtgcagtgatgcgaccgtagttcactgtagtcctgtacttttgggcgcaagccagcctcccaccttagcctcctgaaagctaggactacaggtgcacgccaccatgcctggcttttaaaaatgttttgtagagatggggtcttgctatgttgcccagacccatctcgaattcctggctccaagtgatccttccaccacagcctcccaaagtgttgggattacaggtgtaaaccacagca

SEQ ID NO: 66912 - DNA, 1072 bp, Homo sapiens
atctttagtcaaaacaatacaataactgctatagagtattttaaagagatccagtattattgctttcaggtgcttatcccaatttggtttaagcattgttttaaatcataacaaggcttcaattgctatatcaattatttttatttaaatagatgatggaatatttgattcttagaaacagatctctttagaacttttctaagaagaatcttacaccatgatttatgtagcacccaaaggtacttttgatttggctatttcgttgggcaaattaataggagtcagcaattatgaggtttttctagttttaaaagcaaaatttatatatcttctaccatttaaaaaaattcttcttaggaagggacaaatgtttttcctcatgttattgaaataatgatccctgataagctgtattagtaaattttgaagaaggaagtatttaccttgtttaaaaacaatgtattaaaaaatctgttttccagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactagtaagtaaggaaccttgactttggatatatcacatgcattcatgccaaggcatgtgaaaaaaatgtgttttttaaaataagatattcatctgaaattgatcatttatctagtggggtaaacgtttttgcttgttttggaaagcattaagatatccctaacatgactagtctggagtcagagctagctatttgtcaagtgtctgacccagtcttttctgtgatctccactgggaaacatcggatatcattcagtgatgtccacgggtgtttctgggcaggcgttttcctaaataattgaaaaacttttagaagggtctttacccagatgctgtctgtaatgtttacctttagtatccagtagttaccagagtatactagcagtg

SEQ ID NO: 66913 - DNA, 1019 bp, Homo sapiens
gaacaagttattcagactgaagaattggcagttagctgtagctgattgttccagcagaataaatattagcattgtggaaattgaaattttggttcagttgaccaaatctataggaggagggaaggagagagaagacataactacagcagcaggtaccattactgaaaagcgctcatcttttcaagtgtacatttcagtgcttttagtatattcacaaagttgtacaaccatgccactacctgaatccagggcatttttattctatgtgtttcggtgacaggttctgtatagttgttaccactgctgtctttctagaatgttgcaacaaatttgaattgaaagttcctgtcttattcccactcttcagaagtaatctttaacaggtatcccttgaaatactgtaaattctataattgtgccaaacgatttcccagactctcagtgtcagaaaggaagctgaacttctgttctttcagtagtttgttgctggttatgagttggtggttttgttgtttcaaaggtgtgggtcatataatcacttaattttgtataatttactgctccagtattttcctaatttgtttctattagggctctaagaagtataattttacacgagttaggtaggagatagaatattttattcatgaaatataaaaagattaagtccagaaaaataaggttcttctttctagccatagcttattttgaacaccaaatattttctcattctattttgtagatgtagatttaagtctttgagaacattgatgatgatagcattctgtgcttttatccttgttctgtctttttatttaaagagaattatgtggttaaaaaagaagcaggtcattttgattgcaaagagtttatttctcagatatgaagattaaaatgaggtgaagaggcagggaggtgaagaagcataggtgaaccagacatgtggtctcagcacatgaaacttacagtctggtaatttcagtatatatgaaaggaagtcatctgtaagaacttatgtt

SEQ ID NO: 66914 - DNA, 1653 bp, Homo sapiens
tgtagtcccagctactcaggaggttgaggcaggagattcacttgaacccaggaggcggaggttgcagtgcgctgagatcgcaccattgcactccagcctgggcgacagagtgagactctgtctcaaaaaaaaaaaaaaaaaaaaaaaaaggaatatttgaagtcttactgtttccttccacctcctgaatatgcttagcacaggtccacactgaatatttagtgaattaatgtctgttatattaacatcaaattgggttccacaaatgaatacgtatccctacattagaatatctaatcctgaaagcctgataccacaggctgacaacaactatcccaacactttaggagatggatagtagaggtcagagagattgaacaggatggcttctgtcctggtgtcgtttaatattttagttatatagtaatttgtcttatgtttcatttcacatgtagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagtaagtaggaagtttggatgagcctttgcaagtgcttttttactcaacataatgctgagattaatgagtaggagaatggattcaggatataaatagctacagcagcaggtctttcatggggatattggagattgatttatttagtaaagttaaaactggaagaaagacttaaagaggcttccagagagtgtgatatgggtattagataactgcacagaattgcatgattcttcactgaaaaagtttgctgtgtgtattagtcactatttatttatcttattgtatattctttagtcatgatgataaatgttcttttttttttttaagtcctagaaagaacaccttacagatttataactggatcttagaaagatgagcttaaataattttaggtacaaaattcatagattctaaaggcttttagaactgagcagttttactaatatattaagtggggtttacttagccctgtttcacagtatttttttcaggagataacatttcccaataatcaaatactttcctaaatcagtatctgactaaagaattagaccaagttttccacatcccagaattggcttgaaggaaaggtgatgatttttcttagcagcctcagatgtcctttcatggccaggctttggatccaattagaaagcagagctttactgagtactgtttttgagaattataaacagagaagtatgtaaaaggtgtgttaccattttttcctcattaaggttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggtcagatggtctcttagtaattataattatggtttcatgaatcagctgagtttggcagggccacagtgtagtaaaaagagctcaggctctacagtggtaaacatataggttcttgtcttggc

SEQ ID NO: 66915 - DNA, 1575 bp, Homo sapiens
aactactaatcaggttttataaataaagaaatttatgacagaaaatgggctttcacagggaaagcacatatgctgatagtttgtatcagtcatgatattaatcttcagatgtaatatcgttaatctccagtggttacatcaaatactacctctttcactggcctattttgagtccataagcataggtaaatttcctgccctctgaattctgcttcatagtagagtaccttgtgtttctttcagtttttcccaataaaccattataatttccctgtctccaggagctgatgtctgatttatttttgtatcccacattcacagatcttaacattttacaagatagttccaagtaaccttatttattcatttaagtaagtagtgaacaattattaacttggttcctaaatcttttctaggatattaggaatttacgatttgctcataaacctgaggggcggacaagaagatccatatttgagaatctaatgaaatatgcatttcctgtctctaataacctggtaaaatgtttcctgtctttggaaaatttgtgctataattattgatgtcgtataaagaaacttgtctaggctgtctagaatctctacatttacatccctgctttgacatttaaccagatgtatagtgtaagtgtaacttagtctcttagatcaatttctttaggtatgaaataaaggaagctggactagctgatttctgaggtccattccagcactaacattttatgattatatgatcttgctattcagggtgtttccatgatgaaaagttacctgttgtcttcattaggatttgtaatctcctttttaattgggagccagttaacactagcaatttgggagggaggtaagggtaggcaaaccctgagttcccactatgtgctttagacagtgttagactcccacgtttatatcatttcacttctatgtagcctatggtggtagatattatttatccctgtttagcgatgaaagcaacatcaggtaagcagttaactcaagggcacagttagtaggagtaccatttggaatcaacgttggtcttatgactccagttcaaatttttttcacatcatagttgtgtttaaatgtaatgtctttatttgaaagtaaacctacaaaggctaccaaggataatctgaaagaaatacaatgatatgttggtatttgataagttttgttggcaagtgtctttgcttttttgtatgcttaaaaatatgtaaaaaaatagattttcaaaatgataaaacaaaaactataatacaaaaaaggatgctaatacataaaatgttcttgcagataaataaatgaaaactttggatatatggatacatttctgattcattacctttgtgaatatcttttttagctcttaccattgtttacttttttgtagcctctttttgcttttgaatacaaagaagtattccctgaaaatgggtggaagctatatgaccctcttttagagtatagaaggcaggtatgtactttcttctctttcaattttagtattttgtattcttttcattccaaagaaaactgggtggaaccatgtacg

SEQ ID NO: 66916 - DNA, 1325 bp, Homo sapiens
ccagctaatttttttttgtatttttagtagagatggggtttcaccatgttagccaggatggtcccaatctcctgacctcgtgatctgcccatctcggcctctcaaagtgctgggattacaggcgtgagccaccgtgcccggccagtttttctacttctaaaacaatagtgtggaaaagttgatattgtagacttttcttatgttcttatttactggcattctttaaatgcgttgatacttgaatgaaacatagattgttacatttttaccattaagtcataggtatttaattctacgtaccacttctccaggtcactgttattaaggcctaattaactaacacccatgcacattgagattctacatcacattgttcctttctttttattctgccagtgccaaaagaaacagcatgtgtataattcaagatactttgttatgctaatcttagaagttttgtgactctggtattaaagctaatgacttagtaattatttttgtagttttctttttttttgagacaagagtctggctctgttgcttaggctggagtgcagtggcgtgatcttggcttactgcagcctctgcctcccgggttcaagtgattctcctacctcagcctcctcagtagctgggattacaggcatatgccaccatgcctggctaatttttgtatttttggtagagatgggtttcaccacattggccaggttggtgttgaactcctggcctcaagtgatctgcccgccttggcctcccaaagtgttgagattacaggtgtgagccactgtgcctggcctgtggttttccattatagtcagaagggctctgtgagtgtaatcgctggcaaccatgtgtcaagcacactgtttcctgatcacttttctgtagtttaagagtaagtagtgcatagaatataagacgatgtgaaagaagataattttgaatcttaatcattttaaatataatttctttccatggaacaggatcgttatcaataaacaaaaatatttgtagggcccctgacatggtactttcagagaactctgtggttaacagaatgattctgagtatctcacctagttataaagatatttactgagggaaaacaagatatcagcttaggttcccgcacatgtttattttaaaagatagtaaagccagcattctagttttggatcatatactgtcttacttatgtattgtgggtacactgtagtggagaggctttgtgtgtggttctacaaaatgaggcataataaagctattttgaattctgcctaggtaaaaacatttaaataaaatgatcagtcttaaaattattc

SEQ ID NO: 66917 - DNA, 1082 bp, Homo sapiens
ctttgcattgccttttgtttgttcttgaaatttccttgtttgttggtctgataatctcctatcttttgagactcagtttgaatatcatctcctctgagaagtcttccctgaactttctggccagaattggctgcttccttttcttttctcccatagatatttgtatgtatgtggggtgtttgtgtgtgtgtgtgtgtgtgtatgtgtgtgtgtatgtgtttctatttagagtcataacactgcaccactttatttacttgtctgtgtcacaggcttgtgagcttcatgaacatggggatgatgtcatatttattttcaaatcacagtgcctggtgtagtggttttgtacattggaccactcagtgaatgttctttggatgaatgaatggatgggtgaatggataaaaagaaggaattagcctggagtgtcttcatgagtattgggagtctatccagagggaacttggatcataagaatacttgacccagcaggaatagtttgtaatttgttaagacttagagataagattgaataggcaaagcagaacttagttggctgtggaaattttaataaatattggagttatattaaatacaatgtctgaaattggtctttgaagcccccatttttccaacatactgtacttttgtattttgtagtgcctccacttctcattcagagaattcagtgcatacaaaatcagcttctgttgtatcatcagattccatttcaacttctgccgacaacttttctcctgatttgagggtatgtatactattttaaagttctgatgaagtactttctgttaaatatttgtggccaacactatcaatataactaatttagcaggagatactgatggagtattctcatagatcccggtctacaaaatatcccagaataggccagcaaatttggaatgcttacttatttgtaaaagaaaaatgtgtaattcatctctgaggttgatcacctctaagttctttgccaaaagatgattaatgaattttttgtggtataaaagatttttatgattattctcataataaccagtaatagctaacatttattgaatatgtac

SEQ ID NO: 66918 - DNA, 1125 bp, Homo sapiens
aagagaattagtagttgaagaaaggcttggacagagaaaagtgggtgtaggaaacacaaagtaatatggtaatgaacatatgcgacagagtgttgactagaagttttagcatttggaacaaaggcccaggttgacaaggaaaacaggaatgtttggatggactgagatgaagtatataggcctaggaaatctggggaccaaaatggtatcggttacttaatgaggttagagactgcagtttctacttcaagttcaaatgccttgctaattacaagattcttattatttggagtttgtaattttaaaaagaggtggccatgtaactgaagttctctagtctaatgtgggaagtgttaagtgcagttatagacaaagtctatgaaagtgtagaagactgagagtttagttccaactggaagaccttcttggaacactccaagacttcttggagaagttagttttttaaaccaggtcttaaagggtaggtaggatgttattaaatagattagggtaaaggaacattctattttggaaaggcctgaagcagaggcatgaattttgggaaatacagagcttgtttgtggaacagttcataaaaaataaacatagagagcttgacttcaagatgagcaagggagaaatggaaaaaaagcagtggaaattagcgtgtgttataccagtagccatggtgactacaagcatgcacagagccagtatgacagaagaacacaaacaactacagaaaagagaactatgcatcctactgtgcccacggccaccttcagtctgagtagctgctaaaggcagcactttacgtttataccagaagttttaacagttctgctgcacctgcatgcttacttgctctctcatgctctctctgtctccctctctccctctatcctgtgcactctctctccctccctctctccccctttctctctctctgtgtgtgtgtgtgtttctgccgtaatcacaagaacagtactatgatgtattcccacactgtacccctccagttcaatatttgcctggagagtaaaaccctttgtagactggttatacagaaatatacattagtgcttattaaactataacactgtggatcataatatctacctatgt

SEQ ID NO: 66919 - DNA, 1050 bp, Homo sapiens
tgagtaggagaaaagagacaagttatttgcactagtccagagaagtggtgttaggatggtaaaaagtaggatagagagaagatatacccaagggatggtagggaagtagactgtacaggactttggatagattggatgtgatagctgtgtgggagaagaggatggttatggtttaaaaaagtcacttggggaatgggagaatcattgagcactgtgttgggcctagctgatgtttctaatcgtaagtcctaagtggccccagtttgaagatttccttcactagtagccaagaaagatggttatgttggtccacatttagggattagcaggacagtcgtggctaatggatacggatataaggacactgatggttaggaagggaagcgaagtgggcaaaggagagcaatgaatcatgaaggataataaaaaatggaggggttgagggtctgggtgtctctactaggttgaagatgagatgaagggaaagttaagaaagttaaatatttagaaagggttggcatctagtcaaagattaatttcctcaagtttaagattatagtggcagggtaattcccagaagtgataaagtccaaggtgtaatgacaagatgcacattgctgaagtgggaatgtgtatgaggttatgtaggaattgaggaattttgagctaggttgttgacagtttatctttatggataataaaattcccataatgatggcagctttggagtagaaagaaatgctagagaggaaagtgagccagatgagaaaacccttagtgagtgaggaggatgggtgggtggatgatagtaacaaggaggttgtatactgaaaagccataaaccttagaggaagaaggtttttatatgtgaagatgcaaaactaatagtaatgtagaagcctgagagttcagctgggaaaatgcttgtttcatctttgggcgttgttacatgtgggaaaagaaaagagtctcttattaaagtctgcagggaagtggattcctgtgaggagaggttagttgaggcagaggtgaaggggagaatcctgttga

SEQ ID NO: 66920 - DNA, 1319 bp, Homo sapiens
cttgctttttgatccttattaaaatattttgatccttattgcaagattttataatgcatcattatcattttataaatagagaactctatccccagtatttagtacattgatgatatcagtaaatgtttgtggaatggaggggaggttaaaaaaaaacaaaataaaggagatttaggaagttcctgctctagagaggacaggagggaagatggctgaggcctttagttagaggtggaagacctcagtctccatccttccgaggaagctaagttggtgttttgaggtgtggaatatttggatgtgatcagtgaacccctgctatctggagacagatttttctgcctttgcagcattaaaagggattcttataagtccagagtttgagtcagaatatgcttctgtagtaggtaccaaacttcatttgtttagacataatcttaatttgaaagtttcttaggaatatttgtaactaaaaacaaaatctacatgaaacaacagcaaaaaaataagtgaagagtgctttgtcttatttattgattctattttgaaaagcatatagagagtaattttccccccccaccaataatgtttgtataactttgttcacctaaatgctacactttgaaatagtagaacttttgagaccaaaagagtggatcattgcttttaagaatagtgtaacaaaggaaaaaaaccctttgttataataacagcagagaaaaaaatgtgtgggaatgactaagaatcagatgatgggattactgttttgatcttatggtggaaagaaaactctctggctgagatggtggcaggactattagaaaaccaaggcagactagtgctgtactatattattctgttgctataaacctaagtcttattatttcataggcatgtgtatatgtatatattccagagtgctggctatactctgataagttttgttgtttttgagaaaatattttctttatcaccacttcattcatttctaagggttccagtttcaatctacgtatagataaccccctcacagcaccattaattgaatagagtcctttccccaatgcttgcatttgtcagctttgtcagatcagatgattgtaggaaggcagcattatttctgggctctctattctgttccattggtctgtgtgtctgttgtttttgtaccagtatcatgctgttttcgttattgtagccttgtagtatagtttgaagttgggcaatgtgatgcctccagatttgttctttttgtttagaattgctgtggctattcgggcttctttttggttccagatgaattttagaatagttttttt

SEQ ID NO: 66921 - DNA, 1054 bp, Homo sapiens
tgaggatcctgcaaatattctgacaataagtcttttgtgtctcaaatgttttatacacactgcaggccttttattattttttttaaataaaatcttcaacagaatgactaatagagcatgaacagtgcttatgatactatagtgcattgtgttaagtattgagagcaaaatttgcgttcctagaaaagcttgttcacaatcagaatatagaaggcatgctttaatgttcttgggcaaacatgctgtgtatgtgctcaggacattacttacaagaaaatcactttttaaaaagaaccttttctttttacggaatattgaagaaaaattgaattggcagcaagagtgaaacagttaaaggcaagtggtttagatcttattgtaatgactatggtcagtagaaatgcagcctctcctaaatcttctagaggcatttgtttactaggatatatgaaaagatagatgacttgaagtttccaggttgttttcactttagagtatatactctaaagtgtatatactctttatatgtttgttcatctgcatctttaattttcagaaatactttttcaattttataaaaaatatttttgttaaattataaatattagattctgttcattgctgtgaagtaccttcaggtgttgctgtgattgacaataaagtaatgataattccattaacactcggccaaaccagtggagccagaaagggtcaatacttttctaacggttacattgaaaaatactggtggtgaaattggttttgtgattgaagttttgggtctgtcttctgattgactatataaaaaatcatgtagggtgtgtgtgtgtgtgtgtgtgcgtgcatgcgtgcgtgtgtgtgtgtgtgtttatatttaaaaaaatttctccccaatatttgtgctttgtattatgtgattcatcagttaactaaaacttgtaagtttaaaagtatgtatattcaattttcctagtgcacatgaagacattttacattatagagctgaatgaaaagtacttttagggcctagtgctttgcttaattttaatttaat

SEQ ID NO: 66922 - DNA, 2444 bp, Homo sapiens
ttaggaatcggcatttaacagttgaagaaccacccatccaaatgctgttggatgctagtctagttccaaaagttttcagatgtggaaatagatctagagaactctaataatttaccccaaagcacaataaatgttagagggccaggaaaggttgtggttttcctctgaggtcatagagctatttagtgtcagagatgatctcctaattcccagttctagactttaccatgtagcatcatgatttttttgcagggccatataacttcactgtatttcctgtctatagaaccctctgcttataggatgtataagattataaccaatccatcactgttcctgaaaaaaataagaggacatatgggttatgtaaatgaaaaacatactgtttcttcatttttagtcagatatgtgactcattctggttttgaaatcattggatagacttggtgaaggaaagaaaaaacttttttttgtatccatgatattatttctacctggatttaagtttcatgcttacgaaaatgaggatctgatttcattttttgagtgaaatagtaggtacaaattttatagtgttttgcaaatagtaggtgcttgataagctatactatgaacagtttactgttaaaacttttcttcatttgtattctgtgaagtacgctagttaggagtgattttatttgcttcatacagaatctgatgctttatataccaagccagaaactttaaataattgaaataattttattgtatttataatactatattttatagttgatattcacaagatctctgagggactgaaatttataaagtatttttgaactataagagtttgaattcgttttagtattgtgtatattttatattgtattatgtatggtatattgatagttactgatttgtaactttatatgagtaaatctcgttatcttaattttggaaatactctgtaattctcaaattactagagagtttaatgatgcaatgcctttttttaatatttcaagacatttttattctatgatttttaaaaaacgtcattttaaaatagcctattgatttctaaaaaattattatatttttcaattataaattttcttttcattaaaaacttttttgttcttttcataaccatggaaacaagattgtacttataagagctctagaaaggaaccttatctattatgtggttttctagtttatgatttctaacaactaatctggtaaatagggaagagtattcaaaattagggagagatatccttggcaggcatggatcactgagtactgtcagtattttgatttttagcttaacctttctggactacaaagagaaagatgttgaatgctctacctttcctactgagagttttaacttagtaactgaaaaaaaaaaaaaaaacccacctgtgttaacttcatttatatgactttgaagtttgtgcagaaaagttgtatctcattacattgaaagggtagtgaaagattaattgtataataaacagttttgcttgtcttggaaaaacaaaatatatctatctggatagcaaaaataatggatatatgactttctaatttgaataatgaattcaggtttgcaaggtggagtgagaaaattacatgacagatcatttttcaagacataaatttccctgttttctatacttgtccaagtaagtgtttgttgagcaagtgtttagggaatagatcaccttctctcttttagtgtttttgcctgtatactttagtttgggatggaagggttaatttcagagctctaataatctgaccagttttcagtttagtttgattcttctctcagttaagtgatatttaaataactttttccctcttggctacttatgaatctgtgtgttttcatttgagctgtcatctgaatttgaatcggaggtttttgaagagattctgagaagctccttaaacggggtgctgaggctgtgagattggtgctggaactcaaggtccttcctgccctccagtcctcacccctgtctcccagggacacattcattttccgcagaatactttggctttcacctctttatttatttaaatttcccaataagttctttgaagaaacaatactctggagaaaaaacagacatatgtaaattattttctatacaaactggttgttcagactctgctgcattatgaaatcatatgcctgtgttatattttgggaaatgtaattaatagacctggaaataaattgataactgtgtccagggtcacatgtaccttagaaccttgggattttccaaactaagtgccaacatgcaccagttggaaggctgtcccagagctcaaatctcctttgtttctcggaagaatacaacatgttgtctcttatttctgtcaatcagatgccatgatgatcatttatataatcgtttttatcttatgaattggctaagttt

SEQ ID NO: 66923 - DNA, 1083 bp, Homo sapiens
tagctttattatgcaaagctaattgtgcctgtccctcctaatatgtttctatataggtaccaatgttgtcattaatacaaactgttaataagcaagcttcataattcttcccttccccaagtacataggacctatggccataatcactggtgaatatttattctttcaaagactcttactttgtgtgaataactcttgggctctttaaatatttttagtctagagtaaataagagcaaatgctgtgtattaaatatattaaaaattacctgtaaaatatattttaattaaaaatttaaacactgttatttggaaaattcttttttttttttaagttctactttaggtttagcagcacataacaaaatacaaactgacagtggcttaatataggagatgctaaatttttttccacatgaaagcctggagatagtcaatacagatctaatatggtggatctgaagtatcaaggacccagattgtcttacattccagggttacctcatgaaccaaaattattgttggaactccagctattatatcttcaggaggaagggaagaagaggagcatactctctctctttgaaggatacttttttggcagtcacatgtcattttttttaacttacatccagttggctaaaacatggatggtcccatggccatacgtaggtaaacaagaggctgggataggcagtctcatctgtgaggcctttgtgctgagctaaatttggaggttctgtcactgaggaataggagagaatgggtattggagtcatagcagcttttccccttgggtacagatgaatcatttaaaagaaagacattttccacctaaagtctgcaatatttcacttatgccagagacacccttagagctgcaaatgcgatgaccaaaatagaaaacacactgaaagagaggaggtaatacattgctgcagaccaaaaaagagaattgtatcttggagcactctgaactcttgagtttagctttctatttttttgtgtcttgtcttgggtcagatttttataatcctaatctggaaccataaaatgaaagtggtacatttaatattgacaagat

SEQ ID NO: 66924 - DNA, 1111 bp, Homo sapiens
gtctcagaactgtaatgagttacacagcagaatttgacattatattggtaataatctgccatcttagtctggttttccatttttcagtttatacactattataaaatgcactgctttagtgggtttctttgattagtttgtattgtgcataatcaaatggtaagatatctagtgccgaataggtgctgagtgaacatctaaataaaagaatgttgacggaatgttcaccactggtcttgtttgttgttcccattcaaaggattaaaaaggattccttctgttgaatttggcctgaacacttgcaatttcaggtctaagctgaagttatttttatgggagactggacatcttgagctgattttactgttctgtgcccagtcctacacacaatgaggttattatgtcctcttcaactacctatttatccatctgctactcttgattacttttgccccttttgctctaacttgtgttgttagtcgttttaattaatgtgtgttcttgtcatccttcatataacctcaggctttagttattctgggtaccatacttgtttatcccagattatttggttttatcaatttgtagtatataatttcattagcattgatgagcatcttatatttacatttaacttccattaaaaaaatcaaagggggggtacacatactcaaagtagttctcaactaattgcatttataaattgcatgcctgccttaaaattatcatcatttgaaaacaggaattcctagatttctgtttccatggattttgattatacttatagcctgaagaagtagaggagtttcctagatttctaaaacacattttgttgcaaggtctcatctttagttttagcctcaaggtcacttaagagtgacgtgttggaggccaggtgcagtagctaacgcctgtaatcctagcagtttaggaggctgaacagtttgggattgcttgagtccagaaattccagaccagccagggtcacatggcagaacactgtctctgcaaaaaataaaaagttagctgggcatggtagtgcatgcctgtagtcccagatacttgggaggctggtgtgagaggatcacctgagcctgggaacgttgaggct

SEQ ID NO: 66925 - DNA, 1015 bp, Homo sapiens
ttaacacagtagattttatgtcctttcctgaaaggtaagtctgggacgatgaagccttatccacatcctcttaccaaactctatctttacccaggcatttgggtaatacttgttgtaaataataattttaataagagctagggggccttcaggcagcaaatgcccagactagtagttctccacatggtagtctcagtcttgaccattctttctagaacctggtgacagctcctctgtgaaattaaacaatagacttcatatataaattaggacttgtcagttctagcctccacccaggcaaaagaaatctgctgtgatttcaggaaaagcttttctatctcttgaagttctcagaggctttaggagtagagatccatgccagttccagactctcccttgcagctcctcatgagctgccctttgaaggccactctggacttcccctgtgccacacagggaaactggggcagatggtcaacctgggcagcatattgcttgcagagcctatctctatgtgtgggcctggtcaccccaggaccaacaaaacaaagctagagaaggacaactgggtggtccactgtgttagggaaaccaacacgtgtcaacagactatgagaattaggactctttcatctgtaaataaactatgatttttcaccaaatcttggagtgtataggactcttgtagcacctattatccatgtaattcattttagcaagaattatactctctcaaacactttttctgtttagccttgccttccccacaggacttggaataccttgagaacaggaaatatgatttatatttcttttgaatactaaaaccacagccctggaaacacaatagataattctccttgaactgaattaaaatggaaagggatataagaattagagaccaccccttgaagcttggaaaaggtaatttgagggtaaaaataatgaaaggaaaagaaaacaaaatgtaatcttaaattatcaggtagcaagtttacagaagttcttacccaca

SEQ ID NO: 66926 - DNA, 1054 bp, Homo sapiens
aaaaaaaaaaaagagtcaatcaaaactgaaattaagaaagcttttagaaccagaaagttcatataaggcatcatttttaccaaagacatcagtttttccttaggcacaaaagtaaactttgtttcttcttaaacgtgtaaaaatttgcatggacaacatgagcaaaacacctgaaagtttgaaaacaaagtgcagaaacaaacctcaatgctcaactgtattagctgtaagccagacgggaatctttccaaaggagcaacaaagaaggtagggatggatgaaggaagacacatctttgacctttgagaggaaagaaaagaaaagggttccgatggccaggcaacctccagccatcagtcccatcagttagaagagcagaaggcagctcatcagaagcagcgacatttgggctactgcaagagcaattattttgcttgccaagtcaattcagcctgtgagctacataggctctagtttaagcaacatgaatcatacaactgctctcattatcatgtttgaaggtgtcccttcacaagcctgctgttttaccacacagtactggtctgcctaaaaaacagtaaaattgaattaaacttagcccgagcctcttgaaggcagtgactatgtcatatttatatttgtaccccaagtgcagtgcctgaaatgtgttagacattagatgctaaatgcatgatgctaaatgcatgttggatgattaaacaagtatagagcatctgcaatataccaggcatcatgttaaggcccggggatggtccctgggagttcactcacagtcttgtagaaatgagtaaatgaatatattggtaagtttgctgcattcaagtagactgaataattgttactaacaaaacaaggaatggcaacaattaggtcactacagtaattgctcaaagcacaattaacagactggagcattcaattatgtggcaaccatatggttatgcatttcaccatgttgacatcatactgtaaaattcacacattatatgaaaagaaattacgccaggaaagtacaggctaccacaaagtaaag

SEQ ID NO: 66927 - DNA, 1047 bp, Homo sapiens
ctaatgaacatcaaagatttcaacctaaatacattgagtgcccagtatgtgaagggccttatttatgttgttttaaagctttttaacatactttaaagaagggactggttaatctccactgtctagatccattagacccggagccggatggccccaggggcctttgggaatggcgtggtgggacagtctccacttttgcacatacccaagaaaagaatggtcctttgggaattttgcagacctacaatctggagataatgtacttctgatcataattcaagtgcccccagatatagggttgccagatttagcaaataaaaatataaaatgctcagttaaatttgaatttcagataaacaatgaattatctttcagtacaagtatgtttcaaatattccatgggacatacttataacttttaaaaacttatttgttatttatctgaaattcaaatttgactgggcttttacattttatttggcaacctacccagtcaggaattggagggaaaattttgagatttgaattttttggcatacataaatactcttctatgtgaagacctcaaataaactaaaaaacaaaaagaaaaagtgtcagtattatacattcccataaaatatgctccattttaaaatgagaccaatggggcaggaagttacctcacaaaagtaattttgtggaaataatataaaaatctctgagtttttatactttatttattcaagaaattctggccttaaaatagtagtcagttgacccaagtaagtcacttgctctgcatcaagataaaaatgcatttcatgctgtgtacgctgaggataaaaaaagacatgctgaaaactggatttccaagtagtgcccctattaaagatgacaattaagtggggttcaccgaggatgcatggtgccttaggattgaattataagaatgatgattgtttttggagttggagtcaaatatcagcctttaaaccaagtcaaagccagggttacagctgcgttacagctgccttctgtcactgacactgctgtggaaaaattcaa

SEQ ID NO: 66928 - DNA, 1041 bp, Homo sapiens
ctagcatataatagctcaatgaggaatgatcagcgacccttgtgaatccagctggacttcagaacgtagaggacaaatgttggttggtctagtgggttcatgacttaatgtgttcctcttctctttaaattgtaggccccagatacatttctcacatgtttaaagatttctccagttagatacttcaactaagaaatttttagttcttcaaggcaaaaggaatcattcattagtgtttattttcacttttggagaaaaagattgtagcacacaaagcctgcattttgtttttgttggtataatggcatctcatggtttcttgatattcttctatttcccatgtcaagtgttctaataaacgttgtagaaaacagtattaaactcacacatctacaaaaaaatgtgctaaagagtgagtgcccttacttaatttctggttaataaactaatgtgagattaaaatagacaaggagaactgtaattgcatttttggtgtggacagcaaggtctgtagagagcacaaagtttaacaggtctgcagtgaatgaaaaagaaaaacccccacaccttgacagttaacatcactttagtttatggcttgtttagttttaaattttataagtgatcaaaagttaaagtttgtggattacacgatctttcattcgcccttgttgatggattggttcctgctttcctgagtttttaatggaaacaattatatcatataagaaactatctcacttgtttctattccctggcatcatatatggaaaaatacagcagttagttgaattgtctgctagaaagtggcctttaaaggaaaatataagtggaagaaaatttgcaagtgtgtacattaaggttgaagtgaaaaggggaagggagaaggaggaggatgactgaggtcacattccaatttttgaagattatttgctaatgttcatgaaggaagttacagttgcctctgaaatgtagtacaaattttttgaggtcatttaaacttgtattataaaattcaacatgattagagattgtagggaa

SEQ ID NO: 66929 - DNA, 1150 bp, Homo sapiens
ctgacacagtaatgttttgatatgcttgtcatatttacagtggtcacaatttcaatttttcctttttctttttttttttggtttttgttttttcatttcactgtggtcatggtgacccgtaagccccagatctgtttgaagaacatatttcgttgaattacatttgatttaatttcatgttttcattgaaaaaatccacacgaaacagccttaatgattttaaaatgttgcataatgttatttaaaacattatccactacatttttgtaaagcgcaagtgaatacttacctttagagttaattgcttgaaaagctttgctacttctgaggctgctgtgtactttttctgtattaattaagaagtatgtgacaggaatatggttctttttgttttggttgtctgaagttttacagccaaatttaagaatgaaccataatttttataaataaaattaaagcttgtaaaacattttatgttatttttatctcaatcttaacattcggatttgggttctctgtggttctgctgtttctaaaaatattttgttagacttgataaaattcctacaaactgactcataatttagtgttaaaagggaagaggtagatagacatagataagcagatatattttgcattatgtaaattatatagttaaattgatttttcctaggctggtatgtaaaaaagtaggaattatacaaatatttgctattattatcagtggctaatttgaccaacacttatactgaactagcctatgattatttttatttgtactgtaaatgcagctacagaatatatcattttattaaaattaaattttagttgctatgatacttgagagttaattacatttgtgatatgctctattgggaatgcaaaatctcatatgaggcaaaaccaaaattagaatttctgttactctcttcatagtgatccattatctaactaacactatcaaggatggggttttgtgagtgacaatggggtgtgaaagaacttatgaatttattcattctataattaatataaggtaaatgaacacatctttaatatatcaagatctaatatggctccagtataacttttaactaagtttcatcataatgtatcataatctattttgatataactataatgagatgag

SEQ ID NO: 66930 - DNA, 1050 bp, Homo sapiens
gccttataaaagagtgaggaagcaatgatttatattcttaggaagcttacaacgaaacataatacagatatgtgaaaagaactaacgtggatggtttcagatggttgagaagtcattggaggaactgcagtcagcgtgtcttcgagggagatatctactgatgggattggtgtaggaagacagtctggcagtacagggcagcagggacagcactgaagcagaaatgaataatcttcataacagggctgacaaattggtatatttttaaaatgatagcagttaacaaatgagaaacgaggggagacctgggaaacacgtactgttagttttgaaagttagcctaaactatcccgtaagcttcatggggacttttgcctatcctatatttgattcactgtggtttctgccccttgaattgtgctgggtccttgggggtgcagaatcatcatgtgttgagtacaggccatgacagcaatgcagcacataccactgcacattttaagacctgcttgtggttcactgtgaaggacgtttttaagcttagataattgaaacacgagaatttaattataagttaaaaccaaaaaacaaaacaaccagtggattccgtgtcaaacaaatgctgttggtaattaatgaagataatgaaattgagtacttcagaaaacgaaccaatagttttctagttagtaaatttactgattgtcaatttctgaagcatcagttctttctctggactcacttgtatgtttattgtgtgaaatacaactgtatttttgtggttttatatcgtatagggtaaaagcatgtttcttaggaggacgacagtattattagaaaatgacttgaatttcaccgtaaaaatatgctaaaaatataaatttcagtagttttattttgttggtaggcaagtctgcaaaaaagaaattaattaaaaatatttttttgtaggataagtcttgtgagagattttaggaaggataggaacctctgaccccctttaaattaaaaactatctttaggttatttggagaatgaatgcattgggtg

SEQ ID NO: 66931 - DNA, 1035 bp, Homo sapiens
agctgcagtggactgttgcctccagcctgggcaacagagcgagactctgccttaaaaaaaaaaaaaaaagacaccgtagtgtattcagtgtattaaaggcaaatgctgtttaatgaaacttgtttctgttttataagtacacatgcatgaggatacaatatcagatttgaaaatgtagttattactgcgagtcatggtcaaaataaaaaattgaggtacattatcttatgagttcaggtgtgtgtctctagcatgtatatagtgaagcctgattcactttttattccaaaggtatgtgggacagatcacttggagaagagagatggtttggaggtcacagtgtttgtggcatgagacacattttataggtcttatgaggcccttcaaggtagaacttggccagccccattgtgaatagctcttgaaggtggtcatagccactggatctagcatctgatactaaggtcaagaaagaatttatttagttcatgaaagcagatattttctgtgcaaatgcatgcctttgacataaaccatgtcttttaattttgttctattaagaatatttcagacttttggaggagtatagcttggttgtcagaaaaaaggaagatttactcagataaacaaatttgaaacagcaaaatgccaacctgcaaagtttgaagataaataaattggacaaggactcaaacacaccacgaatagaaaaattaaagttacatataggtagggaaatggatttcaaatggtaaaataaaagtgtatttctgaacaagaatttaattaaactggaatcatctaccatgtggtgcatagtaattttttactaattctcacagagtaaattctcacttagactaatttctcacatagtaatttctcccttcatgtatattaaatgcacagattactaaaaaagtgaatcctatattgagtaaattatcatgtaaattagtttcttgtttatgtaatggttcagtactttatttaacgtgacttatttaaatatgtattgcatttgatagatttcat

SEQ ID NO: 66932 - DNA, 1085 bp, Homo sapiens
ttaggtgaggattttactgcagattaagactgtaacaggaggatgtatctactttgagctctgttggaagttttggccatgataattatttaacatcagtctccatggcagcaaggggaaaagctctaggcaaacaaacagatggattcagaggaccttaagtgatcaagtccggtaggagccagcagctggccttctgtgggctacttattagcattttccttagcttgttgtctgcctgcacttggcagcaagctggaggtcagatttgtgatgcaaacacatttgcatccaggttctggtatctactcactaactcacaggtgacctcacccatatctctgcctctctctttcctttttttcttttattgtgtgtgtgtgtgttgtgtgtgcaggttcaaaatgacaggtggtaaaatgagcagcaaaaggatactcttggctataccggctcttcctgtctttcagatattgcacatcctgagcctgttgttttacatggaagaaaaatgaagccccttcacacattcatagagaagtgtgcttgaaaagagagaagaagcagcagagagtgcttagcagcaaggctatttactacttctgtatcctaggcagttttccaggctgtagtttcacccccaaccttgcctcccctgctgaatgtggctggtgccaaattcctgctattggctgagtcatcatgtcctagttgatctggcaccgtagtcaacatttgtagcttttaccattgttgctttggagctagatcactaggttagattataggctagataattaggttttcctaaatagagaatctgctggtgctgaaacttgccccagaaggcacaccgtggtggttattcacgtagatggcctggtgtatgtgagatgggaaaatccagtaagtcactccttaattcaattcagcagccttttactgattgcccagaaactggatgatctggcagaattaaatggattattttgtttaaaacctaaagcaaaaagtttaaggtgggattccatatgtaagttgttcctatgaatgattgttgataatgttggaaaaaaatgggaaaa

SEQ ID NO: 66933 - DNA, 1051 bp, Homo sapiens
aactagtagtgagtctgacaccaatatcctcactcttaatatttttttaattagatctatttgtgttagaaggttatgcaaagaaatagaagcccatgacagccttttctttaatgatttatatttgtgaaaaattttagtgtttttttgtttgtttgtttgttttttaactgaatgctcactccatcaagcttgaatagaccaccaggatcatttttatagtggatgttttataaggcaatgttgagattgtaggttagcaggtaaaaatgtccggactgcttttgtcagcagccaggtgtcccccactcacccccatcaccctgcagcttgctaacagatcttaaatgaaagaaccttctggccattctctctggctcctcacatctcatcggcttgatttgatgtccatatcttaagtctgtgtgtttgctggggctctggttttcctctcttcctcatagcaccttttatagctaggggcaagcctgtgtctaggcacctggcttcttatctctaattgctctctgccaatcttaaaaaggccttaatttacctctcctaaatactctgaattcccacattcagttctgtttattgacagcttcctattttcaaggtcctgtgttgggtgcagtaaaggctggaggggttctctgccctccacaccttgctgttcagggagagttataagatttagacacaaagaagtataataataaaagggatcattgtctagggtatttcagtagacatacaaaaaaggaggtagagtacaataatgcaatatttctcaaagatttctcctgaagtacatctaatacgagaggaggggaaaagtaccctctcggtagtctggggacatagcccaaactggctgcctcagaggaaatatcaggtacaagctaattcatatgaaataggctttacctcaatatatgcatttaaaaaatgcaaaactgtgtaaaattacttggcttccttctccccaattttcaaataaaagctgtagccccaggaagacacaataagagggtccatagctttctga

SEQ ID NO: 66934 - DNA, 1050 bp, Homo sapiens
ggtagttccttgataaaggctttggtaaactgacttccagataatacacatctgccaccaaaactctcttaaagcagtaaatctccactgtgtagatcagaccagatccattttcagtatttatagtgtctttaaattttggttaaattagtcaaactggtattttaaaggattctggttaaattagtcaaactggtattaaaggattctggttcatataatacaaaatcaaagttatataattttacatttggaaactcattcggattcagtggaacctcaccttatggattttttgcttaacttttacttgcagatctgtctatggcagtgcagaaattttcccagtcattgcaagatttccagtttgaatgtattggtgatgctgaaacagatgatgaaattagtattggtaagtactactgttttagaaagttctattactaatatttattttactgaaatcaaatagacacacacctaaataataaacatgtaaaatattttctgactttgacaatactataagagtgattttaggtttctatggaagaaattttttctttttggagacagagtctctctctgtcacccaggctggagtgcagtggcgtaatcttgactcactgcaacctctgcctcccgggttcaagtggttctcctgtctcagcctcctgagtagctgggattacaggcatctgccaccatgcccagctaattttttgtatttttagtagacacaggatttcaccattttggtcagcctggtctcgaactcttgacctcaggtgatccacccgcctcgacctcccaaagtgttgggattactggcgtgagccactgcgcttggcctaaagaaaatattataaattgtttttaaatcgaagctctgtgtttgtttgtttgttgtttccataaggaaatgacttaatcattctataactcaggtcagccgagctttgaattattcgttcaaacaaatatatattaggtatctactattaaatataccaggcactggtttaaaaaattatcttccttttttttctt

SEQ ID NO: 66935 - DNA, 1044 bp, Homo sapiens
tttgataggtgtgccatgaaatacggtctcttgatacgtacacttttgtgtaacgaggcatttactttataattagatgacatgaaatgtgataaatgtgaggcacaactcaggttaattcaagtacaaaaatcctttctttcaccctggaaagaagttgctttaaccttgttagctcttgtcagtgtagaatcatagataaaagctgcaaatatttggatttacttgttgagttattgacagttaataccaaaggggtttttccagatttttttttttgctgttactttttggtttgttcaggagttgagttcaatttaggggcagaacttcccctcaactctcagtggatttcactcttctttgcagtgacagtggctttaaaaacctcagaagtataacacttttatgaatagcaatggcatgtagtacaaaatgtggaatcagttgagttagaatataattttcatcctttattgttataatcacattctgcatttctgtggtagtcagcagagaattaaatctaaatttcataccatggttctcaagaccttcggtgctctgtacccagtcttcatctctattttccattgccttcactaggctttcatcatgctagccttcttttcatttcatcaatatgtcttacggcattggcacttgctcttctctctgcctgaaagccttcttccagatctttgagtaggggttggaggcggttgaggagttcttgtaagtaatgctggagttccaaggtatctcctcactgaggctttgcctatccagtttaattcagtgccccctactgccgtcattttttgccacatcatcttgttttgttttctttgtggctcctgtcattatctgatattatcttgtttatttttggcttacttgtctgtcttcctgaactatgtaaacaagctccaggagagatttgtattacactgtaagtatttgcttgaaaatgattgagttacaggcattaatgaattatggcctagtggctaaagattgaagtattgcaaactaagccaaaaa

SEQ ID NO: 66936 - DNA, 1032 bp, Homo sapiens
atggtggacaaccatcctcccaacaacatttgttattttaagtaagaatgtggtgaatctcatcacggatttgtctgtatgcactgcttttactttatacaaaatcagccaattaaaaagaaaaaattattttgtttccttgggattgtgcagataagtgaactcatttgttagccaacattattgaaatctgtgggtatgtttgtgtagactcagccctagagcaagcaatatatttgcaactgaacacatatattgagagaaatctggtaagctctaccatttatattcatcatagtaaacagctcactgactttattaataggtttcacttaatacagcttcttactgttctgtatttagagttgattttacgtctttctcttctatatacagccagtaataatctgaagccaaatttaatgctctccagagaccatgcaacccacgtttgcatcaagagcctggtgatttacagactctgagttggagagatgacctctacaattactgtagaaacccagtgagaagtgaagtgagctcactgtagaaagatttcaggcattgaaaaaacttgccttatttggtaaatgtggttaactggtcccagctggtaatactggtgagctcattgtgagatgtattgtctcttaaagccaaattcttgtatttttaaaaatctgttagaattggagtattaaatagtatttgttcagtttttcttgatgttctaggaagtaaatcaaatcagaaacaatagagttccattttgaaaactaaagctcagatgcagtgacacttaaaatattcccagtatatcttttcttgtctcttatgttgcttaccttacttagcctctggggaatttggagtttaatttatgccttgaaatacaagactcctacgggaagcaaatttatgtggccatgtgtgctttactatacttctttgctcatgtaagtttactctgtatattacactttcaggatagattctgttaattgcattttctttaatgaccagtagcatttc

SEQ ID NO: 66937 - DNA, 1125 bp, Homo sapiens
agacagagaaggtggctgcgtgttatttacatgagaaaatggtttcaaattgtgtttcttccttaatttaaaataataagttacagatacattatgagtgacttttcaaaaatgttttctaactttattgcaggaagaggttgtgggaaagattaggttaggagacaagtctgtgaaataaaatccctgtgaatgaaatgaaaatgcttaaattttttttccaatataacgttccatataacctgtgtcctgtaattccatggagagcctgtcttaatttatggataaaaacataaatacacatatgaatttgagattagaaggttaagatcatagaaattatgactttgtaaagatttcactttctctgaaatgaaaaacctgtgttatctagttcaatgattttgctcaccacttccctgttttatgttctttccattcctttgctaaaatgttgtctattcaatactcaaatcagtactgccaccttgtgatactttttcttaatttcatctggccaaattctcattccttcccttgggtacttcttatctgtgatttactggtttggtcttccttacgttgcacatcttttatccccttgttttgattagaagttcttccagggtgggatctatgctattatactttagtcgttatcttagtggtctcttctggatatttcttcaatgcatttgaatagcagaatagttaacatgacaaatgtccttgatcagcctcaaaagttaaattactgtctaccaaaaaggaaataaaaatccttttgtggtttctgttttataatcgtaaatctattgcctgccttgccaaagccattgaaaatgtattagtttgaggaattataatgaaatataattttctccctattttatatcattaaatgatcattaaaacacattttcatggtttctttatctctttatctttgcagcttttgtcatttcttcagggcttatttactttttaccatgagggatatgaacttgcccaggaatttgcaccgtataagcaacagctgcagttcaacttgcagaatgtaagagtatacctgttcttactgtctctcagcaaatctgcaaatctgatttcacagggcaactaatt

SEQ ID NO: 66938 - DNA, 1082 bp, Homo sapiens
ttggttttagtgtctttttacctgttacctagttatgatatgaggctttccacattgttccatattaattgtaattgtttttagtgactagactgtaccacatcagggtcaagttctcatattgtggaattcatagatggctttgaagaatgtaactttttcatcctttttgatcatttcaagggaaatagtttgaaactagtctccttcagactgtcctgtaccaaaaacacttaatgattttatcacctgtgatcattagaattaaaaacattttttgcatgcctagtgatttttctgaaagtattatacttcagtctttttcttttttagaaaaattcctatgtttttctcctctgtcttcatttctcttttctcttaactttttttcttcaaattttatctttttagttaactgagaatttaaaaagtagtaaatgtgtaaatatagaaaatatttgtttttaaataggcatgggatcatcacgttacaggccttctcagaagctaataggaaactctggcttgaagccatggatgggaaggaaccggtaagactatgacacattctataatttaggttttattgtcctaataattataatgtatggaaattcttttcatagtatacaatgttttgcctgtagtataattgaaaatattaaaaaaggaaatcaggggagtagagacttttatggtttcctagtctcactcatggcccataactctacctttctgacttattttataaggggacttttgggactaatttaaaaccctaaaattacttcttaaaaaattacttacactcatcaccttggctccacccattaggttagcttattcagttaataatgatcgcatgcccagtctttgcaaggcctgtgctaggcatgtgattagagtgatgaacaaggttcagggtaagaactgattctctaatcaagaccatttttaaaaagtataacttaataaaactgcctgtggcttgacattttcacttccatacatatccccatttttaatagttattttgaaattgtatgatagtctacttacaaaaaataggaaggcttacgtaa

SEQ ID NO: 66939 - DNA, 1023 bp, Homo sapiens
tggcttccacttattctaaaatactcttgttgtcctttggaaactcagttttgcataatatgtatttgtgtttttgaactgctgaagacaatgaagtttaggatggtaaaatatataacttaggtaaacgtttgtttgaatgccagccatttagaagcaatcataacatctgtgccttcactgaaaatcctacaagcaacagtgtgagaaatatctaatgttctaaaatagggccatagtatgaatttacagagaacaaatgccatagaatgaagaataaaactatgctgtgactgtagtttcatgctactctttgtgagactaacatgcaaaagtcttcctaccttgtattaatagttactcttaatttaccattttcaaagtatggatgccataaatgagacttgaaaaggaaagcttgaatcacctttatgaaaaaacatcaaataagaaaataaaatattggtcaatgacagggtattgaatttacaaatacttttctggttgtaaaatatgctgcaatatccatgaaattgtaagactttgggaatgaatttatttttgtagtagtaatatctatcatcagtattaaacagatgccattcaattaagattagcactaaactagtcctcaagccatgacactggggacatttggtaaaaagtagctcacccatatgttttctgtagttctgccatttgaatacatctttcaaaggaacaaattacattttatgacatacctttcctgccccaagacctccatcttggaacagtcatttacagaggcaaaagcagttaacatttcttctaggctttctttctctgacattctcaattggtgccctgagccttgtccccattcaaatatgagttttgtgtgatggcttctgagctggtccttcaaccctgggtctggagaaggtgagcactgtgaaagaaaaggcacttagatctcattctctcatgcagtcagttcaaaaatattccattgtgcacctactctactccaggtactgcgag

SEQ ID NO: 66940 - DNA, 1034 bp, Homo sapiens
ttagactgtgaaattggataagtagctttcaaattttgttaggcatatgtctgagtttttaacattctgtacttgccaagctgtatctcaagccgttttcttgtgattttccttcctattaggtatcaccattttaggactctaccgaataggaggagtgaactccaaagttcaaaaactcatgaataccacattttgtaagttttggatgaagcaacttacataatttttgtgttcttataggtaatctaaagtatggacttctttgactagtgcttgtctttgaatattttcaaataatatttaaagttcatatatgtattcagtttttaatgttcatttataatagatgaacgatgagaatttgagggggcatttttataatactgtattttttttccccaagtgtcctttggtaagctagagatacaataagatgcatggatgctagctggagtcatttggaatcctagctcagccacttacaggttttgtgaccttgagtaatttgcttaacgtctttgtgtctcagcctcctcatttataaaaatagggataataatggtacctgcctcttaagagttgtgaggattgactatgttaatctccgtaaagcacttagaagcatgctaggcacatggtaagtgctctgtcatgttaacaattagcaataatttcatttgggagacttatttcataagatatatctttgaggtttagtgtcagctttttatcaattcacgcaaacaacagtactaatgttaactcttggcattctaagaaatgaatacctctctcttttgacctacttacgtttgtgcccatttttcataattgcataagaaatattttgaactgcacaatttaaacaccttgttttattctttccagctcctaaatcccctcctgatattgatattgatattgaactgtgggacaataagacgataacaagtgggctgaaaaactacctcaggtgaggagggtttaactcctggtactctggatgtaatctctgactcaccccttgagta

SEQ ID NO: 66941 - DNA, 1041 bp, Homo sapiens
tttgaaacatataacttaagatatttttgttgctttttatttgcagagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaaggtaggcggaattttcatgtggaagtgtcaagttttatatcttggttttataaaggaattttgcatttgatctgtgagctcatgagttttgtataaattacttcttaatggggacttcagttttctttccttgttgtttttaagtgcttctcaaaatccttcagttaggtggttttctttccttctacataatagacttcaaaaggttttcttctttacattgtatggtaagtttattgctcctgtgcagagaacattttaaaatcactttgtggttggttctattttaaccttctctttgtatccctttgaaatcaaactcttaattatatagaggtaatgttctaactaaacaaaagaaaaaaatataggcaacagtcttgaagtcttctctatatctagtccctaagaaggatttcttgaaaaaagtgagatcttagaataactatgaaaatgggaaattttgaaagctgaattagttggagtattaagcaaattgaaccatttaaggtctaacaatttgtaatccttttatctctgatctggtccttgtgagagaatgattaaggccttctcctcccctgggtcccttcccagcacccacagaagcatgcccttagtgtctatctaagggcacaagctctctcacaatgcaagagcacatggctgtgtcctgtagctctgcacataccttaacctgcagctagccacactccttggcagctcagagccaacagcatggcagcatcttctcctgagaagcaaggagccattcagtgggagaaatgatatagagtgagcctcagctcttctcaggttatgttttttcagagtat

SEQ ID NO: 66942 - DNA, 1427 bp, Homo sapiens
ccgtactaggtaggggcctaccactttaatggggtcaggtggccgcagaacacatggtaagttggagaacagaagggttttggtgatgctgttatcaatagatagttacagttgctttcatctctctccctcctactccttaggtgactcctatagcagcagcccagacagcacacctatggggagcattgagtcactctcttctcattcctctgaacaaaatagcactacaaagtcagcttcctgccagcccagggagaaatctggagggattccttggattgcaaccccatcatcttccaatggacagaaaagccttggtctgtggacaactagtcctgaatcaagttccagagaagatgcaaccaagacagatgcagaatcagactgccagagtgttgcttcagtcactagcccaggagacgtttccccacccatagacctagtcaagaaagagccttatgggctttcaggactgaaaagagcttctgcttcttctctcagatccatctctgcagctgaaggtaaggcagagtggaacttgtgcaagatgtcattgtctcagtgtcacttgtgctggattattcagcatggttaagcagggataaagttaatggtggagaaactaatgatgcttatctacttttttcctgtgcttggattttacaacctaggcactgtgacatttttcctgaatctttccatgtctgtgaagtgatgtctttgtaattattgtagattttgatctccccaagtgatgggttgctgtactcaaagaacattctgtaccttcccatttgggctcagagaaaaatgcttccttttgttatgcacatgtacgtgttattgctattatgttgtctaatagcaccttgcctattttcttgggctttctttttaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtgtaagtgagcgtttgtatatttgctgtgtctcccagggatacagagaggagttgagtgtttcagaagaactcttgggaatcccacaagttgaatacattgggaatactttatctgtagagtgggtacagtccacttctgtaagactctattcttttctatgagtgatgtggaagtcttcggatatggacagaatctctctcacagggcagcacttcaagcactttcctttgaagcagagctatgacttaatttgaggaaatgaaaactgatgtataatacagtagttataagctttggaactaaaagtgttcccattaaaagctaaacatccatctctccgctgaagagactgccacgcattgactata

SEQ ID NO: 66943 - DNA, 1122 bp, Homo sapiens
tgagcatgcacagtttctggtatccacaaggggtcctggaactaatcccccacagatactgaggactgacaatccgatgtgggtgtttaacccatctgtttatataattatttgacactaatgttgactgagtgctatttatttatttattttgccagtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctgacacagatacacggggatcagcccactaagtgaaaacagtcaatttctatcaagttcttcaccagcagactatgtagctccttattaatggaaaaaaagatttaaattgttggccattcttttttggttggtttcttattttaaaatatcttacttgtgaaaaatgtgtttttggataatatgtaactctccacaatgtcgcttccgtagcaattgtagagtttcaaatactgtgttaaatactgtatcccagaaatttggaaaccagaaatctgctatatggattttgagatctgtcctttactgcctggcattctctgaggatctctgaaattgttacttaaaaatgtaatttaaattgttcatttattgttttttttttcttagaaatatactgcttttatatatgattgttttgctggtcctaaacatttcaaggatgtaagtctttgttttaatataactttatttgttttccaagtagatgataatattcaaaagcaataatgtatatgatatctataaaggaagcaaaattaagtcatacactgattccactgtaaacaatctgtccagaattccagacaccttcagcaaactttttctgtaaaggcctgatagcaaatatttttgtggtgggttgaatttggcttatgggttatagtttgctgacacctagtttagagggtgtgtaaaactatcttcataactttgagatttttataaaattttacatgaaaatatactgataaattatatgcacatattttctaccagtagcattatagtggcatcatagaagaatat

SEQ ID NO: 66944 - DNA, 1032 bp, Homo sapiens
aataaaaagaataagattagaattaacaagtagagagaataacggtaggcagagtcagaatcaggaataaatatcagtgaatcaaaagaatgaaaaatattatgtaataaaaattagcaatgtaatgtaaacgtttgataaaagagtatctttttcttttatctcttactgttgacctctgtgcactgtaataaggtgtgttgctggatcttcttggtcgaggtccttggtgaccttagtagtaataacagcattgctgacaccctaattgccctctgctggaacagaaggtagttttccagtgtaccagtcccttagtctatacagcacccttggtttaagcacacttgccatcatctggtatcctgctagactagaatctcttaaaagcaaattggttttctttcaaagaccaacttgactccaaagagagattcagaatcctacttctcctgctgctgcataaagaatctcaaccttcattttatttgaacacggaccaaagtgttcctgcttctgagttgtctgtaagctaattctgcagatgttccattcagatttaaagcttttttactgcataggatgtggataggaagcctaactattgtatctgatggcaaggcatatgttgcagccacagtactggctatggtccctttgctgaaacaagctacagaagcactgattcaagttgtgcttgtgcttgaacttttaatcttctagatttgtgaggatggctctttttccttcataatggattacaatgtaagcaagtcatggccatatactggagacgggctaaagctgcttttcccttaaagtaagtttcctacagataaggtatttatgagcactgagaaagtcaggacatgtactctaaatcacacagaatgttaattccacaggaaggcaatgccagacattgaaagaggatcacattcaacttttaatagtagttcaataacaaaaccttagcttttcaggaacaatgtgaagatacattagaattgccacatccatatcttcaaaaca

SEQ ID NO: 66945 - DNA, 1044 bp, Homo sapiens
taattgtattgaggttttagatgctataattcattaataaagagagatatagaaattagtttattctttattatcacacagaataacaagaattagagttaaattcacaatatttttaaagaaaacattatgtgaagatgattcatttcaaaccaccagccaatttaacataaaacacttgtcaagctgagtagactgttttcttatgtgaaccacaaaatattttctctgaaatctacacttagtttaaaaacagagatgggattttgcatattagcttgaaaataagtatatgatgatgatattaggtgcccactagcacctagtttttacagctttgcattgtcaccccatcactgccagggacccagccccaggcatacacagatgaaaggacagtttcaccttcttggcaaaaaccttcagaacaattgtcaacatactctcaaatgtctttcccactcagaaatgaggagcaaggtgtatgactttagattcaagaagtatatggggctaaatatctttaaaagtataactctggacaatgtacttagggacctactacttactcaaaatagggtagtagcattaataactaaatagggcgtgagtcatgagaaagattccctgcatctcttgccaagtattaacactagttttactaataagcaacggggtagataactttgaagattgcatcaacttcaacacaaaaaaatgtgaatatctaccatgtgcaaaacagtcaaagtatgttaggggaaatttaaaacattacatagaaaataagtatgtgatgatatcgttaaaatacatgatcacttaatttttacagttttgcatctgttaccagccagtgccaggagaactgtcaggcacacatggatagatgaagagtctcaccctcttgacagaaaacctcatatgaatacccaaaccactttgaaagtatgtgctcaactgaaataattaatctttgtgtttttctctttggcactggacctttctcctggtcagttggaggcaggcatattgctctgagga

SEQ ID NO: 66946 - DNA, 1041 bp, Homo sapiens
taagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccatta

SEQ ID NO: 66947 - DNA, 1041 bp, Homo sapiens
ggctcactgcaacctctgcctcctggattcaagctattctctcgcctcagcctcccaagtagctgggattacaggcccccaccaccatgcctggctaatttttgtattttttagtagagacagggtttcaccatgttggccaggccgatctcaaactcctgacctcaggtgatccacccacctaggcctcccagagtgctgggattacaggcgtgagccaccgcacctggccctagttccatctttaaagtcaagaaaatctctgcttctggatcatgaacaagtcacaaggatgccattaaaaacacggctttcaacttcctttgtcccctgttgagctcactacttatttgaaatgaatataaaatattatatttacactagaacacactgtggctcaacctttatattttgttcctttttttctgtgtagggttgtacattgtagtcgtttgcagtcaggttaatagggaacaaacaagctctaaactttattcctttaacgggagggattaatgtattccagttatgtactgagagtttacaatgtgtccctctgcaaagaggggtgaattcagtgtgaataaggcaaaatcatcattgctctcataggactaaggaaaaccactttaattgtttattgcttcctcaaccccagaggaagagcatagggtatgtgcccagagattaagtagtcagggcaaaaacagtgtcagtgttgtaaaatgagaacaaatgacttctttcattcatctccctaaagtggtttgcaaacttgctagttgtgtataatgttaatctctaaatatctgagtctaattattcccattgataattgtgcatgtaataaaatgcaaattctggaatttcttttatttctactttcctaggatgaatctacattacgcttacggctgactacactgcctggaatagttacattccatttacaattttagaacttctgctgtaatagaattgcgctttaaaatatttgtaaggatttttaaagcacaaagtcaaagttaagctaagaactta

SEQ ID NO: 66948 - DNA, 1062 bp, Homo sapiens
ctagcaccatggattctgaaagtggggataaagacagaaacttgtcaggtaagtggagcctctttggaccaagatgccttcagaagtttgattctggaagttttgccacccaggcctaccaaggagcctagaagccttctccaatggaattgatccatgcccaggccagctgaatggctgaagatccagtaaccttgaagctgcccaagatgaacatcctagtgatggaagggaagaaacagccaccatggacccataagctcaaaccacctgacttgaatgtgctcacacccactggcttctagagccctttctattctagggactctaccttggctgtgacataggaaggttacatttttcaaaacctgttaaattgagactagcactggagacataattggtgtttgagaaacattagtacaaagcttgcccttgttgtgtgcaaaaagccattttgtactgctttaaagttggactaaataatctcagcagtgatgtatgggggatctcattacctattttttcatcatttaccctagataagaacttcgatcattgcttactaggtaaagaatgtttgtgctgttctgaaacccagacttcttgattcctttaccactatccatgtgagcattgacaaatcatggcatagaggggttcactgactcgttgagaggactctgaccctcttgactgctggtgctgtgccccagccttgtcagttaggggccccaagatatgtttagaacctgggtacagataaaagccagacttggcatggacccctctttctaggctgaaccttgagtccccctgctttttggtagacctcatggatcactgtcctgcagccagttcttcatgtggggcctcttaggccagtgctgagggaggcatgcttctctttctattccgcagaacaaaccctagtctggcaaagcctttcttgagctttaaagtgagattaatttaattccaatttggttgaagacttcctaagagagaaaaattcagtctactgaattggcataggtaaatggatgttaaacttttttaaag

SEQ ID NO: 66949 - DNA, 1062 bp, Homo sapiens
ctggagtgcagtggtgcaatctcggctcactgcaacctccacctcccgggttcaagcaattctcctgcctcagcctcccaagtagctgggattacaggaacgtaccaccacacccagctaatttttgtatttttagtagagactgggtttcaccattttggccaggagggtctcgatttcttgacctcgtgatccacccgcctcggcctcccaaagtgctgggaatacaggcatgagccaccatgcccagacagatattttcaatttttaaaaactcttgtagaatgaagaaaagcataggcgtttttcttgttcaacagtgtgcagttgcttgaagtcttagaagagttaaactgtcagaacaactttgctttccctgcagcaaacatgtatatatgattacagcaagtctatgctaggatcattaaataacacacatcatctttgttttatagaaatgatcttcattgtgcattagaatacctagttagttttcatgttattttaacatactattttgactttgacttcatgatatctatatctatctgtgtgtgtatgtttatatatacatatatatatcacataaattctatgtatttggaaaacaacaagtgtatacaatgtatagtgagaacactatgatttacttattaaaaagttagacttctctccacagataaccaataatcttaagtaatgtatatgaaagtgctttgtaaaatttgaaattctatataaatatgagatattggaatattaagaatcaggtgttaggttaatggacatatttttatttattgaaaatgtaattaagctgaaaccattgataaactactatcacattaaaaatacattttcagtggaatgtaaacctaaatgtgttaagaaataaagtaatgccaagaaataaggggcttacaaagaagcagaggtatatcagtaagattattctaatgtggaaaatgttagtggtagataaaaataagatgttggcaatctgatcatgtaaaagagaaaaaaaatatatgataaagtgcagggcatttagtgcttaagccc

SEQ ID NO: 66950 - DNA, 1049 bp, Homo sapiens
ttttaccctagaaataggatatgattcctaaatatgtaattgggtgtgaatgggaaattgaaaataaatttgaataattgataggtttagtggacatgttttaggattttagaaggggatacctggaaaatttaacacagattttttaatgttaattatttgacttattttgttttattttattttattttaagacagggtctcactctgtcacccaggctggagtgcagtggctttatcatggctcactgcagcatcatcctcctgtgctcaagcaatcctcccacctcagccccacaagcagctgggactacaggtgtatgccaccatggctgactaatttttatattttttgcagagacagggtttcaccttgtttcccaggctggtcttggcctcccgagctcaagcgatctgcctgcctcagtctcccaaagtgctaggaatacaggcatgagccaccacacccagccaacaatgatactttttaaataacatttagaaatgtaaattcatgggaataagtataatagaggatttgcttgacttctacacagaaggctataacactgttgagagaacttaaaagaggcaggggtaggggtatggaaaaaaaattaaagaagatctatgaaatagcggagcagggggaagatatgccatgttcatggattggaaaagtctgtattaaaaagaaggcaattctccacaaactaatccgtaaatgtagtataatctctatcaaagttccaataggatttttgtgaaaattgagaaactgagtctaatatttatatggaaatgcaaaggcaaagaacaaatgcaataatcttgaaggacaaagttataaaactactagatattattaaagctaaagtaattattacaatatggcatttttacaggatatttagaccaattaaatagagagtccagaaacagacctacatatttaaacacttgatttttggcaaaggtggcactgtatagcagggacaaagagttcatcttataattcatcaataggatatatagaattagtaaaaatg

SEQ ID NO: 66951 - DNA, 1065 bp, Homo sapiens
ttggaattttaactcttcttttaagataactgagtttacttcatgcattacatgagcatctacttgcaaaataaccagggtgccagtgtcaatcatatattacatgagtaaaatttaacttctaatttttagataataaatatgaattggaattctaatatgttcttgaagcacaccagtggattatcttacacaatcttctggtgttctgtgtcatgctctggaggttactgctctaaactataaatccctcagaagcaaggattttgttgaattcatcattttaactgtgccatgcttagagcatataagaggagctcaataaagcatgctaactgaatgaattaaacttacagagttttcttgatatttgaaagtaacttgaaaatttgcagtgggtatatattggctactcaactagcataatttttaacattgtgctggcatttgtttaagggtctactgttatgagaagaaaacgaattgctgaaactaagcggagaaatattttagagcagaaaagacaaaaccctggatctgtaggacagaagtacagtgagcaaattaatgtaagtatggtattaatcaaaatctctattcaatatttaaaaattgcttggaaaacagaggttcttaaaggactatgctcttgctgtaaactgtataccacaacataaatataattatagccaaagccatttgtgaagcagtcttggaatctttatgctaggagattattccactatacctacttgctatgttctgtataatcagttactaatgaaagttttaaaccaactttaaatcattattattattttagttgttattattgatagccaatgctggaaaaaatgaggtcattcacaacaaaattcaacaaagctacttaaatatacactttaaaaagaaagtaaagtaaattagagacctggatagaagaaacaagtatgctaggccaggcgcggtggctcacacctgtaatcctggcactttgggaggccaaggtgggtggatcacctgaggtcaggagttcaagaccagcctgaccaacatggtgaaacc

SEQ ID NO: 66952 - DNA, 1121 bp, Homo sapiens
accgagaggccgcaaaggaaaggggcccagggctcaacttcacaaactcggccgccgctggcaacacacccacacacaaatgccagaggcccccctccccctttcccagcccggcccggcgggagcgaaggtgcggagcgcgcggaggcgcgcgcattgtgcaagcccaccgcggcccaggcccgacttttccccacccccttccttcctccccacccctcctccactcccgccaacctctcgggaaccccgggaagaaagaaaggaagaaggagggaaagcacgccccccggggctgcaaccgcagagagaaactcagaagggaaaaacaaatctcagccccggactctgggaggagtggggagctggtcaccgcggcggagtggacgactccagttccacttcgcctcgggacccccaccccagctagagttcccgcaacccccctcccctgaccagagctggcggccgcggctcccgagcgcccccccggtctgaggcccgcccgacggggaaacggggagaggggcaacgaggttacctgtcgggagtgggatttgggctccggcggcttgaagaaggagtcgggcagcttccggagcctcatgggcacggtctggggcacgttggccgtcttggggttcatgacggcgttgaagagcgcctccaggtcggtctccgagtccccgcggacgtgcacgatctgatgcccggcggggggtgcctgcggcgccgcctgggtcgccgcgggtgccggttgcccgggtccggacggcgggccctgcccctgcgggggctgcgaaggcggctgcccttggccctggggggccggttgaggcggcggctgctgcccgggatccatggcttctgcctcccccgacgcgcaccccctgacccaggcgagcgagggctacgcccggacgccccggctccacgggccgaggtggagaagcggcgacggctgcgggccgggcggcgctgtcctcgctctcagggccggggggctgcgccgcggccccgcatcccccgccccggcgcctccgcccccgccctgcgccccggctccactggtctggcggctgcgcctcgggaggggctgcgaggcactcggacctgcggcg

SEQ ID NO: 66953 - DNA, 2044 bp, Homo sapiens
taacctgatgacaaaaacccgggttaaggaggaggaaagaaggaaaaacaatttagctgcttgcctaaacacttcaatttgtcttaggtatgcttttttctcttacccctcgaagtgggtttatggactcattgtgggtaaatgtatgttggcatgcaccctacagactgcacggtatgttttcaaagtataatacacatagattggatcccccattttgtggcatcagccacaaagaattacaactgggaagtgtactttttcttctagtaaataatttttacaagaatttatatccagcagttctaaaattcataaactattatagttttgtttgttttaaataagtttttaactaagtgttttgcatctgtaaattcgacttttatttctcctaatgatttcctaaatcatacttattctgatgggaaactcaaaaaggtgtatcactttaaggcattaatgactctactgagtccttccagtttccttacctttgtgaatctaggaaattctaactttttgataatcaaactctaatgctaattaaaaatattttaaaaactatgcaagattatgaatagtacaaatctaggttgtaaatactattgttcacaacacaaactggtgactgtaagttctttcatatacatccatttttctatcatgaaaactattttataaaggagaaaacaggcatatggaagttaagatacttgttcagtgtcacactagccaacttagactggaactcagatctttggggtctgaatgcagaattttttctgcttgtatagagttgtggatgtgtgtgagttcttaagttaaaattggactgataacatctttatcttctacatacaaagatatagttgggtttttttcatcctgttcattgtagatggcttttaagaacatttgggcagttcaaatttgttgctctcattaaaatttgtgtaatttgttatgatttctttattgatggcattttatcatggttggaataaatgacgagggcttgatttttcttgagtttgacctagaaaaaaaattaattacttaaaacctagtaaaaaatacatattctttgtgttgtgtttatacttagaacattttagaacttggaaaagcacccataactgcactgacctcttaaaaattaggttttaaaattcactattatttttggaatgttttattcattcagtactagttgcccttacatgtctagtgtggaccaggggaaattcattagatggactgctcatcaatacaattacaaacatttataaaatttatattaaaattatataatattaaaagtatccatttgaaaacctgtgttctccagtgtcgaatattaaatgttgaaattttcctttggtacttagatattcggctgcaattaagcgctgactgggaaatttaaagggactcagttgtgttttttcttttttaatttttcatcttaatattccctaataggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaagtaagtgaaaataatggtgggagacagttatctaagacaaatatgtattggaaaacacagtaaagtggtgtcaagatacagaatatcatttatttttatgttttatttaatatttatgttaagctctgtagctctatcttccatatatatgtttcagtttggtatgacctaaatacctttgttagtatgggtaatattttgaaagctttactgagtcttggttctgagcctctttataatcttttcttttgtggaagtttggttattctcattttgagcttgtgccaaaccttttaattagcctagca

SEQ ID NO: 66954 - DNA, 1662 bp, Homo sapiens
aaattttcaaattctgggaattacagggctagcagcgtcttacaaaatacgtatggtgctacttgtatctttttaaataaatattttattggtagagaactacaaaataagtagggcttttgggggagtctaattttacagtattttaaattgtgaaatgacaagcactacaactgaagcttgatgtgacttaccaatatttccccccaaaaatgtaaagggaaataaaaatttttaggtttcatatgcagtcgctcagtggcaaacttctttcaagctagtaggtcttcacaacagaaaccctcctctctgggaaaacaaaaacatgaccgttgggttgtttatttatttttattttttcagtccttttgtgtttaataaaatggcagaattacactaggctgaaaagacataaatagaattttctctcctctgattttgaaattacagataagacctcaatttttttctggcttgtttggatcaagtatatattgaaatgttgactaaaactaattatgatagactgaaattgatgtctttaaaaaagctcacttaatagtgtttaatcaggttgagataataaagtgaaaaacagtgtaagttttgattcggataggtcttgacagtctactcctaaggcaaatgtaacatttatttatcataccagataacaccattaaggatgttttgttgtgtgaatcctagtatgtgttttatattgattgtcttccagggtgggttgctactttgtaatgtaagatagaaagttttgtgacagacttacagaagagcaaaggaaaaggtttgatcatgaaaagttcgtacagtttttttttgccccctttcctgcaactttttcttttcttttcttctttttttttaaaaaaattcattttctggtgtcctggtatccatttcaaaggatcaggtttcaaccagaacagtaaagggcctgagactggaaagtacacacaagtctggcaaactcatctgcatgagcaagatcatttgttctcaagcagacatccaaagtaaatgattgaaagagctgctagctgtgaaggatgtgtcttgaaggggaagggagtggaaacaaaccaggttgttaggaagaaaaagaaaggctgcacttttttgaacctctccctgctgggtcacatgctgacctggggagattgttaaacagcttaatagcctgctttccttctttctttggttgatgctgtggctaaaagtataaggttaaagagcaacatttatgctcttcttcttagttctttgtatcttgtaataattgcttgtaggtgatacctgcctacgatttcattattttgaatgaatgatctttttttgagctgaaatcagtattctagatacagttggccttccgtatctgtgggttcagcattcatggattcaaccaacctctgattgaaaatatttggaaacaaattacatctgtattgactaatgtacaaacttttttccttgtcattatttcctaaataatgtaacaactatttagcctttacgttgtattaagtattataagtaatctagaggtgatataaagtatatgggagaatatgtataggttatatgcaaatattatgccaccttatatgaaagaccagagcctctgtggattttagtacatgt

SEQ ID NO: 66955 - DNA, 1603 bp, Homo sapiens
gtcctggaaccaatccttgaccacagatgctaaggaatgactattcatttttcaaagtttccagtgattcttcctttgtgaagaaatgtttctcttaaaggtattgatatatgtagatggattaatgaagggtatataccttccaaccccagtcacctcaattcacccctgtcaactatgggcctgtaaggaagataaaccaggctaaaataaataaatctcaaattatgtcataggagaaaaggttgcaagggtagagagatatttacccggaaaagaaaaaactgggaggaggagagataagacatgattgttgtttcagtgtttctggggaacttttatgtgggagtaggattagtcttactatataagaaatgtgaggaattttgattccatggaagaattttcttatataaaacttttaagaactagaagagttttcctggacaggtaaatcttgctcaataaatgtaggtaaaatcatggttacttggtatctgtcagggattctatggaggcccctaaacattggatgtgggagaagaatgctgtgggcttataaaattttgtattttaaagagtatctgctttatgaacattatgcaatttggagaaaagttatgaaataagattatttcaccttctccagttagctacttccatgatgttatggaccgtatagttgttacaacttctttttgtgtactgaacagacaaatgagattaatatcctaaccattagtcaaagatgatgataaactaagcttttggtgccaagtttctgttgtcaaagttcatttttatcctagttttgatgttttaaaatagggctgtctttgtaatcaatatttatatactttcctcttgtatctaaagaggagtgttgttgtcatcagatgtagaatgaagatttaaattagttgccttacacttgtttccgcaatgaaacattttattttaatgcatctttttagatatttgttggaactgacttttaagttacaaagtctataacttattgagatttatatttggcatgaagaacctgactataaatggtccagacaggcaagacgatgtaatttgagaaaaaacttagaaatgttaagaaacaacccagttgttggccttgtgaccatagatgattgagtttttgaagttagttggcctatcatctagtttccaggcagcatgattactgaaagattataagcaggcaatcattcgttgttttaaagccctccttaggtcagtgagatcttgtggaggagactcataccttactttggcaagtgatacggtggaagtatggtgctagttacatttatcagtggcttgttttcaagctctgggatgaatgtgaagtatgtaaacaaggcttagccatataatatttgttctactacatttactattcaaaactattttctttaccatcgtattgagctttcattttaaaagaattcattctctttatgactctgagagttattaccttcttcagctgtcttacggttttcctacaggaaatagttcttcaagtagttggtcaacaacttcctatttctttataagctgctgaataacttcctgactcagtatt

SEQ ID NO: 66956 - DNA, 1047 bp, Homo sapiens
tgataactgtgaaaacagtagcaaattcaaattgacagtcatttgtcataacctccttaatggaactgtcctgcttggaatttcccacttctgggaatgataagcaataggaatgatttctttcatagtacctgattaagataaagtggccttcatcataaagacgtgtaaagaaaactaagcaaatgtagaggctgacagatatttgtagagggcatcccagcattggcagtccagcctgagaagagacaggatgacctccagggtgctttctggctccagacctgtgatcaagagtccataagcatagctgattgagcactgaaagtagtgattaccagagaaaccaatgtttaatgaaaagtgaaaattcttgacattgtagaaatgattatttatgcctatatacatagagaaatcccagtaatattttctcaactatgtacagaattagttcaggttatatagttcttgtcatgatcttagggccaaattattcccataggagtaaagtacatattcaattgtattatttaaattggagaaaaaaatttatgtaaagaaagttaccttatgccattttagaacctctgctatttaaagtaagtcacctgttgtatgaatttgtaatgtggcttattgatttttctaggatgcatatttttaaagagcagaataagcttctgctttcaggaattcagcctagtatttcaaatgagagctcatgtattgcaacattatttatctatttttgtaaagggctgttaatcacttggtgccaccctgtctgagttgtgtgcttgtagattgttcacatgaaatcacttgatatggcatctcatttctgcaagaattttttctgtatttttagcccaccagcctagcatgaagttaaattatttaatagaaatatttagagaccagaagcttacttttaattttgcgaatgttgccttaccctttttggaataggttactgtttaaaaacgtgtcgatgtagttatgcaatataattcatttatcctacctttggccaaaacacacaca

SEQ ID NO: 66957 - DNA, 1781 bp, Homo sapiens
atgtctgtaacctatataagaaagttcacttctttttgacatctgacatgtagtagttccatttaaaatagtatttgttcaggaatgtcagtttaagcaaaacagtagaatatgagaaaaccaccaaccatcttttgaagaggttgaattgctattttggctcttttgggtaaataaatgtcttactgtatgtaaagatctgagattatgaaagaacatgtaaaattgctaggtcaattattttcctgaaataactgttgttattcataaaaatacccaggtgctaataagtctgccctgctaattttgatgcaggttgtttgggaaccacattttgaaaaacacttacagcagactttctgtaactaaaatttctcagggctgttttaaaatatttctttatttttagttctgccatttctctttttttgccttttccctgtaaggtgattattacgaaaagagctaggtggaccttatcattggaattctagtctttgttttcagttcatactctaatgacatctgttgttttctatatcatgaaatcaggacaaatacaatttttgaacttttgggaggaatattctcagtcactatggcattaggaaaagatgttcaattttgctgaacgtaacttcaggtacacgccatttgggatcaagattgagagaactgtgcttgcttcaggaagcctccacttgagctttggcattattctcatggctggtccatcctcaccctttccttagggaataatcatttcccaggggagatgtattatatataaacatgtcagcatgtcactttttttgtcaacatgtttaagttgtgtttaaattggtttcatgcttgcgggcaaatgttaattttatcaaacctaaagctatagggtcagattatagtgtggtgtacagtttgtagacttataataaatggtcatgtttgcttttatgtatttctgctcatacttgttcataattttaactcattaacagccttcagtgatagcttaattatttaaatttcaatttaagattctgatatcctgtagtgcagaaaccatattatcatagaggcaaaatgtttacgtcttctcatgcatgtcaaggaaatatagtatatgcataatcactgaatttttgaggttctagaaatagtccaccatggacatatacaaatataaaaagcctatagttgtggtttaggaactgtggctcatggaaggattagattgaacaatgtatcattgttcctagagtcagttaagcgtgtaggtttagctagtttgggaacagcctctagcatgtgactctataacacttgcacaacaaacatgggcctgataagtgagcagtaaatctgggctgactgcccactcccagtactgccatcatagtattttgagggcctgacaacaatattaaaagcttaaaacattcttcacaccgttttgtattattcctggttttccagttttattgtttactaaaagtcaatttttcttaataaaaaaagattgtttagttggtcatttgatttctcattagatactaggctttgtgaggtcttacatatatttaagttcaagttttctcacttttcttcagggaagtgggtgacttggttgtcctgatgtctcttttgggcacataaagcacatttttgtcatgttatctttgttcacttttatcagaaaaaattcagtgtctgagcaggtcactatcatcaaaagtgcatgtttgggtttttttctcttttccccttacaacacaatgaag

SEQ ID NO: 66958 - DNA, 1028 bp, Homo sapiens
tttggactggaacaataacagccatgtttccttaaattatctctaatgaaatgaatgaattcagtttctccacattttggaaattctgaagaatggtgttgcggaatttttttccctgacataaggttatgaaagatgatgacgaacgctttaccaactgcagagatcaggaagaacaaagctttttaaagaaaaaaattttttcctttaaaacagtgaaataaaacaacttttctgtaagcttaagtagactattgattacacacacagcttggtcttttgttttaagaggaggaggtactttaaaaaaacactaccaccctccagcacgttatgtacacacaggcatacagttagatgtgcccagaaaaagtttcataaaattctcttattgcatttagtttccctttttgggcccaccgtgtgtgtattccagacaggcttgacaatatgccagagctttttattttgtggcccgacttttaatctgttccagaccttttcactcagagagctcaagtgtaactgaaggggggcaggaaagaaaaaaacgtgtgggtttctctgatctagagtgacagcaaatagagacaagctgttagctgctggatttgaagttttccttgaaatcagaagttctgcatagtggattatgttttatctctgccaaagaaatataaactatccccttgtttctgaccctttgggccatacaaacacaaacaaatggtgtaggatattgctttcatgattgtggagtttgcttttcgatattcttcaaatctatattaaaatatttatcaatttttggcttaagtcaagtagatgtgtgtctttcagtgtcttagaatgggagctaagcccctagagaagcttaattttagctccttcaaacaaccccttttatatgtttatttatcagatgctttcagattaattatagttagaatatagccatttgctttaagattaaacatatttagtaattacacttcatttgctgcataataacgtttcagtcagcggca

SEQ ID NO: 66959 - DNA, 1810 bp, Homo sapiens
gagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggttagaaaccagccttccacttttgggggtttgttttcttaaagttgggcagatttcattttaacatttattagttacagaggaatgttgtctttgtaaaactgagtgacacagaagcattctatccagccctgtccttgtcttagttttgtgactgtgaatggcctttgatcaagttacaagggatgtgacttggaaacctgtatcatgaagagctgttttggtcatggtcattgcaattgagcaaaaattgaaggaagcaaggatgctttctctaatgtacatggaattgtggattgctgtttttctgaggatttcactaaaggggaaattctagaacatcactcaggagaaaacatcctttattaataacttacgtggcgggatacaccaatatgacatttctcaaatgacaaatatacttcggtattaccgaatctaagaattttcattgaaaacaaaataaatgttacctttggccaggtgcggtggctcatgcctgtaatcccagcactttgggaggccagggtgggcagatcacttgaggccagttcaagacaagcctggccaacttagcgaaaccccatctctactaaaaataaaaaaattagccaagcgtggtggcacacacctgtaatctcaacttctcaggaggctgaggcacaagaatcacttgagcttcggaggcagaggttcggtgagccaagattgtgccaccgcactcaagcctgggtgacagagtgagattctgtctcaaaaacaaaaagttatcttcaagtttagaagatgccagtgtgctttaaaattacctgcttatggatgtttttttattttggggaaagtaggacatagtagagagctttgaagccctttaatcaccaattccatcagctttcttccagaaggtactgttggtttttatgttcctaatatatataattaatctcaacattaatttttactttatcttatttcagagtggttaaatctactaagttcagatattggagataaggtcttttgttaagtagcgtagatatttttaaatttccatataaaatttttttgaatagataatagaaaaatggtatactagtgatagatgtacagaggtgaaagtacactcaaaataagatcttttccctgtttttctagttctctcctatggggcctaaataactatgagtttcttaggttttttgttttttgttaatttttccagagatactctgtttacatacataaaatacatgtatctgtgccattttttccctagctaaatcacagcatgctaagtatagacatttaaaaatcgtcatactcggccaggcatggtggctcatgcctctaatcccaacactttgggaggccgaggcaggaggtttgcttgagcccaggagttcgaaaccagcctgggcaacatggcgagactctgtctcttaaaaaaaaaaaaagctctacatttctgttaccaggaaggaggcacctaaaggtctgttttttgttttttgggttttttttagggctgtattttaaaagtatctcttgagtgtcagtgaaaatatgtgaactcagtactacctgaactctgatttggggtttgaggaattggtacttcaggagtta

SEQ ID NO: 66960 - DNA, 1052 bp, Homo sapiens
caaatatattgtatctgctttatctaatactcagaaacaaagaacctacgtgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggtaggctcttatctgatgttttagcactggaaaaaaaaaaaaaaagatattaaattaggaaagagaaacttacattccagggtcctgtccttattggacattagcccagagaataactttgagccatctttctaccaagatactcaggttaacattgcccttccaagaaagtctacacagtctgctccctccctgctcctcctagggagtttctgtttattttgattccatggaggtcttttttattctatatttaaatgtattgtgtctcagttgtacatcctatcagctaggtatgcctaatttttatttgaatagcttaaaatagtatgtgtaatgatttaaaggaattaataaattgaacagtaacaaaagcagtatttacttggataggctactttaggaaattttagagtcatgatactatgaggaagagaaaaattctttctagtggacattccaaaggaaaaatatcaaaattatcaggagagtatctgcctggatagtgtttcaggttttcttgttggcttttatcagcattctctgatgaaccccagggagccctggttgtgaaggcatcttatttagaaggaaagattgtggccaatttttcttctaacacaggcacttgtctgactcgtgggaagaatctcgttcttaaaaccaaaaagattttaggtgtttgaggtccac

SEQ ID NO: 66961 - DNA, 1061 bp, Homo sapiens
ccagattgggtgacagagtgagaccctgtctcaaaaagattaaaaaaaaaaaaaatctagaagcacatcttataacgtaactactgtagcattgaaatagcaatgatcataaatggtattttaaaatatttgcaacaactacaatgtgatatgaaaacatttatatgttctattggtgaaaagttaggtacagtgaatactaatggtgcatactacattggagaaaatgttgacaaatttagcgaaagttaatgtgtaatttttttttttttaccccattgaagttcagagactctctgaattctgtcatggtccgctggttaagaaactctggtttaaaggatggtatatccagaaggcataaacctaaagaaaaataagtggtatttgcatgcaggagaattgtagtttagaagtggcagcgtagagctaggagaagctttccatacttcaggaccccatggcgattgtggaggtgagggctggagatggtggggccgtgcctcagtgagcagacttggctcagaaagctgtgtggaaggatgacggagtcaggccagtatcctttgtgataagaaactgtatgtatttcaaatcaaacccaaaaagtagagggaaagaaagctgatggtctagtagagatgatgtttacgataggtggagaggcacagtgaaaattcttaggagggtaagaaacagtgaacagataaaggagagaaaaaggacagagtagtaatgagtgtgctacggatgggtcacagtgagatgaactgtttttgaggtcctgggcaaatacaggctgaaacctgggaggtttggaagcccttgaaggcaggccttctgcaaccatcagagtagcaacctacagcctttgctcaggtttacagggagaatcctgctgagaaattgttggatgaccctgaagaaattttaccccattttaaatattatgtttgtggtggagaagccttgggtttgtgttttaacttctgatgtctttttttcattttcctcctctctccctgctagaggatggaacatattctatccagctcaggata

SEQ ID NO: 66962 - DNA, 2266 bp, Homo sapiens
atattccttaagctctaaatactttttgccccaacttgccttggcattgactcttagtagtaatgctgagttcccttagttcccttttacttttaccctcaaagctcactcagatgtccccctccatgaaacttttaccctttacttctaagctccctgtttgttctgaaagcactgtgcttacatctgagttcatatagcccctaaatatgattcattagtatatttgttcatttccctccttgaagttgtgagcctctcacaaaacattgtttgtaggtggtggtgattgttaacctctttatcctcaaagcctagtctaatgcctgtcatgtagtagcagatgctcagtgaatgtttactgaatgagtggggcctgtaggaagtggggttctgcagggagcagttcctcaccaggaaaatggccctgtaaactctgtcctcaggaatgcccatgtgcttcccctgtggtttggaatgaactctgcgcaactctgtaagttcagttattcagtaatagactaaaatgtctgatgtgtgtcccatgcttagcagccgaatagagtgatgactaggaccaggctcttgtcccagatcagggcaggcaaaatacaaacaaaccacatcctgaggccttctcatatatggctgcattgtataccaatggtctcagaggcaaatgtgtgttttcttggatctgtgtgaggcttttgagccttggcaaaatctggcagaagcattagagtaaaccagtgatggcagtatatagaatgaggggagagagagaacaaggcaaatgcattgcatcatttagggaaggcagttggggtattgactgagcttttagccttgagcaattgttaaacttgtttttattttttaacttttatgtaagttaaatagctgcttattaaatgtacaagccgtagagaaagttgaagttcacactcacacagaccattgaagaataacagctgccttgattttatgcgtttctctaagattttgtagagttagtagaactcagggaatgccagctgatgtctagatgctactagcttaggaaagtgttctatttctcagggtaatggatatttaccatacttttaatgtaaatctgggaaaccttacttagtctaaagtgaaaatctgtgttgggtcattttattttcaagggatgtgccttgcagttttttgttttgctcttttctttaactggagctatatgatttcccgtttcgtttcgtactgaagtgtttgaggctttttcctcccccgcccaaacacagaagcaaggagatcaagccacgagtattcttatcttattggcagtgactcacctattttggctcagtcctaaaaggaattctggtggtttatttggggttgatttttccttggcttatgttctctgcacaatagctaggaatttaacttgagtctagtgcagacctgtctcctcgcccacctggagtttgtgttgtgacgtctctgtgccaccaccacctggagaattgaggccttgggacaagtaagttgtatgggttcctccgcacccccagattcaaatgatattacagagaggagaatactgatgcagagaattttctgtcagccaggaaaactaactgggggtatctttttttgtcccttattgtcaccaagcacagaaccttaggagaaatcttggttccttagagctgccagcttcaattaggattaacttgtctatttcacttcatagcacaagccctgtctatggccctgagggagggtgcttgtttcagacattgcaggacaggaattttcactaatcctctttgagaattatgttgctgctcagcaggtgtttatttttaccttgaattgatttttaaaattttttgtgttggtctttaactgtcatgtttatgtagtggcacctatcactctcgagatgagagtacagacagtggactaagcatgagcagctacagtgtccctcgaaccccagatgacttcctgaacagtgtggatgagatggatacaggttggtattctttattcctcttagtaacctgacttaacagtgggatatgttatcaccaggtctcataaggtattgtaagcaaagatgattcagaagaaaaccaattaaaatcctgtaaatttgaattaaattgatcctgctttgtctctatacggtgatttgtaacttgtcttttcctagtttaaaaaaatatatatcatggattggccgggtgcagtggctcatgcctctaattcc

SEQ ID NO: 66963 - DNA, 4020 bp, Homo sapiens
ttcccaaagtatatttaaggccaaggtaggtctataccactcatgtttatgtttagtcttattatggtggtgcttatctggaagacagggtagtgatgctgtcgtgttgtgtacttgttctttctcccgctgctgcatataatttttcaagggcttttttatttttttcatgactcctttagtgctcagcacataatagcaatcaagctgttattggatatctgaacaatgttgaagcaaaagtaaacttggcattgttattttgttatctgtgagttgtttgacctgatataaattctaggtatcagtttaggtcagtcaggagcgcttttctttccctgtgcatttctctgtgctcatatgatacagccctgatgttagcttttcaaaaaggactttgttatctctgtgtgtttccactaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattt

SEQ ID NO: 66964 - DNA, 1288 bp, Homo sapiens
attcttatagataggaatgaatttatttccctcctcctctgtgagagctatctttttgaaaaaagtagtttattgtctttactggttataaaaataacacatacaccatcataaaattagaaaatatggacaattaggataatgagtatgatagctaatagttttttagtatgtgtgatgtgttcagtgctcttctaaatgctttacatatgtaaatatgttaaattcctcatattagccatgaggtaggaaatattattgccaccattttgctgatgatgaaactgagaggtacggaggggctaagtttttttttcagggtcacacaaccagataataaggatcacaaataatcacactgtctagagacaatcatcatttcagtgaatatgttccgtgcttttctttatcatatctttatttaaatgagatattaaatgacaattcgtaacctgcattttttttagtctgtcttatttatttgttactcaaaaaatcttatttttgactagattcagacttggaagtagaaactcacagagaggacagtctgcgtctcttggcaatctgttcttgatgcttctctttagcctccttcattctcttggccaaaagtttagcatattctgcagctacttccttattttccttaattctctgtttcttcagagcaatatgccaccattcgtgctgcagaacatgtggagtaacaagatacttagtcgtgggtgctttggtcctaggtttcttaccttctttgtttaaagcctttcttacaacacactggtggacatcatcatcttcagagagactgaaaagtttgcagattctgctagctcttttgggcccgagatgacaaggcaccatagtatcagtcagtccaggaatatccttctctcctttttttacaataaccaagttgagaatgctcagattggcatccacaatgcaaccacgtgcagatttttgctttctttttccagttcttcttggtctgtaacaggcatgccttttattcagcagcaggtggacatggccatgggtcaagacaccctgattcatagggaaaccttgtttgtcgttcccactgttgattcagaccacataacccttccattctttacccagagcatcagcagcaacttctgtggccatacacttctcataaaaagtatgaagtttgtgttcattgtccacttcaatgagtttctggcaggcagtggccaggaagatgttcagcttcatcttgaagcagctgatcgccttcgagccaccatgaaaaagagct

SEQ ID NO: 66965 - DNA, 1060 bp, Homo sapiens
ttttttttctgcagctgctatccacatcagacagcccaggagatgaaaatgcagagtcatcaagtaagtacaatggataataatgaatgcatttaaatagagtcatttggtactgttaatattgaaagttgataatagtaatgtacctgtatattgatttataatttacgatgaatgcattttcaaatatactgtgttggtatttcccaaacttcagtgcatatcagagttgcctggagaactttaaaaaatatgacagatttccagtttctacttcagacctactgaattaaatctgagtatctaaaggtggggctcaggcatgtatagttttaacaaactacatacatccagcctaacacttgttcttgggccagtgtgggagcagatgtactatgatattagattgctcacatattctttctgtgaaagggaaagaatagaacacgttagtcacctttttaaatagggacgctgaggctcagaaaggttaaatgacttgtacatcaccttacacctaaaatgcaacagagctaatatttgtacaagcccctctactccattatctcatgttcaattcaattcagtatatatttattgtatattgtatatcgcctgttctgaggaaagcatagagaacaggatagagccaacccaaatgtccatcagtgatagactggattaagaaaatgtggcacatacacaccatggaatactatgcagccataaaaaggatgagttcatgtcctttatagggacatggatgaagctggaaaccatcattctgagcaaactatcacaagaacagaaaaccaaacaccgcatgttctcactcatagttgggaattgaacaatgagaacacttggacataggaaggggaacatcacacacagggcctgttgtggggtagggggatgtgggagggatagcattaggagatacacctaatgttaaatgacgagttaacgggtgcagcacaccaacatggcacatgtatacatatgtaacaaacctgcacattatgcacatgtaccctagaacttaaagtaaaataattta

SEQ ID NO: 66966 - DNA, 1453 bp, Homo sapiens
agaccgggtgtaattaaagcaatcatgccagtggtcgtagtgccggagccactgtttcacaggccactgtgttaggttttgttttcgagttgctttctgtggtcgttgctttgaaattgtaagggaatggcagagtttaagagtttatattaatgaactcgtggtgcattttactgcagttttcctagtcgtggagagacttgatattacaaactaacgttgctgtcttaattcctgctgtactgctgctgacagggtgtagtggagtgtctgtctgtctttttaaccaatgtgcctttgcctccagcagagtgccagagttacctttaggccagaaaaggggaggagagcaaggacaaaatgtttcctgtgtgaaaatttccatctgtctctgaagttgtgcgttttaaagacacgtatagttagtgctatggggagtatgttgcatttacttattttaattaatagctttttcatttagaaagttgtgacaaattgctggaattaagatgtattatctaaagtgtgaattattcttagactttactgaataaattgaagagtatgtaagttctatttggcatgcacatacagttttctaaaatactttttgttttttcttttcagatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagta

SEQ ID NO: 66967 - DNA, 1985 bp, Homo sapiens
gttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtaagaagcaaataactatacattttatcattttattttaatttacatattagaacatacgtgttttcaatatttagtcttttttttcctgaaggtcgcaatgatgatgtcaaatgcttttgttgtgatggtggcttgaggtgttgggaatctggagatgatccatgggtagaacatgccaagtggtttccaaggtaattgttttgaaaaaggtatttgtacaaaaaactctgtgcttaaaagaagtaggcatgcctacatgattttgtttacctttaaattataacaaagcctcttttatgccattggggaattatccttctaaaagatcacattttaactttaattattttgttgaaaaatattctgcagtcttctgtgtacttttgtaagtcagttacaagtatgaccgtacattttatttatttcccatttcttttaaagagtacttaaggattacaaagacatataaaatagattaaaaagacgttagaaaaaggtaagaacaggaaaacaagaagggacatagaatggatgcaggaataagtcaaatgtaaaagtccatgtattaagagcatatcttagatgggcgtggtggctcacacctgtaatcccagcactttgggaggccgagataggtggatcacctgaggtcaggagtttgaga

SEQ ID NO: 66968 - DNA, 1049 bp, Homo sapiens
cgtgatatataacacacagaaggatgtatattgttttatgataattttgttcctgttagatatgtatgtgttctgggttgtgacgtaaaatgtttttactatggagtacaatgaaagatttgaaagccatttttctagaatgatcaggttatatttgatatgaaacaattttaaaaaataattttcctcatatgttttaggtgtgagttcttgatacgaatgaaaggccaagagtttgttgatgagattcaaggtagatatcctcatcttcttgaacaggtaaatacatttttaaaattaacaacattgaattctgctttataataacaaaaatattattaggttggtataaaagtgatcatgatttttgccattgaaagtcatggccaaaaccgtgatcacttttgtaccaacctatattagaagttatgcttatttctcttttattaattgtaggtacatactttcatccatgttaatgacatctttggtttttacttttgtaaccaacttgatttttgagggctttttaaaaaagattgtttttttgtttttactattttgaaaaatcatttatgctgccactgtacaaatttgtgatgggattggagaaggatctttagtgtctctttgctgttttccagaaaaacaaacaaaaaataacttgttaggagctgagacccttggagagtaacccagttaaaatcttattttccaaatgaaatgagaaaccactgatacatttttctactttcctgaaactagagaaatacttgatttctaatttgggatgacatgaaatttaaggaaatctatgtgattagggtaaaagaaagcaaagcaaaggtcataaatcactcagttctcaaaagaacatatacatttacttaaagtaagcttattttagtgttgttcttttcagattgttggggatatctgcttttacctattaacttttctcttgtttcatagctgttgtcaacttcagataccactggagaagaaaatgctgacccaccaagtatgtatgagataattttaagtataga

SEQ ID NO: 66969 - DNA, 2116 bp, Homo sapiens
taaatataaattaactgtggagttttatgtgatgcgatattaaaggaaaaacattggctttttaaaaaaaggtcaggcttgattcttaggtagttttttttaattgctataaacatagacatttataaaataataatggtagttaactatgtaccacatattgtgccagatgctttacatgtattattcaatccttacaactttgaggaaggtaccgttatgtatattttacagatgaggaaactgaggtgtatggggaaggatgaggacacatagctagtgagtgggcctagccaacactggaacctaggtctgttttgacttggcaactcaaaccctacaatactacaataccacgtcttaagtatggggtgttgaaaagaacactggtctaggatgcctggttctgcagcttattctttcttgtgatcttaggccactcattcttttctgagtcttttttctccctatgtaaaaatgagaggcagtaatactcgccttgtttaattgacaggatcactgtatcaaatgagacaaattactatgaaagtgcttacaaaagtaaaatgatataatggaaatacaagagtattattatatatggtggggggaaatttttactgtcttctacaaatctcttgcaacaaaataaagtaaaagcggagttctaggacatgtaaatatatagacttaaaaattaaacagagacttcctctggaagttttccaaacaacaaacttacaaatgcaaacaagttactttgttcttttttgaactttatttagtgcctaaattgtttgtagggttggttattagtgactatatgagtatagttaaaggagtttaaaatctaatggatttctttttctttttttaatgaagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttggtgagtttgttgggaaaattattttagaaattcttaggactggccagatgcggtggctcagttttgtatttagtagagtaatggtttttatgttttctttcctcagtggataagaatatgaagtatattccaacagaagatgtttcaggtaaaacaaagatttaaaaccaacatgaactattaccctttttttttaatgaagtggaaacaatttcactaaagttattttttgttattaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaagattgtgttaccagaatattttttctttcctgatttaaaaagtaattttcatgtgtcttcc

SEQ ID NO: 66970 - DNA, 1909 bp, Homo sapiens
tcttcaaggtaacaagggtttgggttttgaaataaacatctggatccttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctg

SEQ ID NO: 66971 - DNA, 1018 bp, Homo sapiens
aaccatttttatattcattagtttatccatccattcaacagatatttgttgaaagcctattatgtgatatgaaatacgttgagatgttcagacagagatgattaagacatgtccctgcactgagggaactctgtcttctgggttgtttttttttttcttcatatcttccccaaaatttctaactttatataaatttagacttggtttctgttgagtcttttactagtttgagacattttattgcagtatagtgcaaagtattaatgggctaagtatgttaaatgctgctgtatttgtaagatctcttgctttgtctgtgaccatgaaagtctcagtgaaatgggatcttattccctaaatcatagctctggttttaatgtttcttgatattattgcagagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaagtatgtattaaagctgaccttttttttcctatgctgcaagtagttaaatgccacatttaagtcattattctgtctggcaaaaataatatagaaactttatatgcctagatttcccttaattcctaattaaatgttcttaacacagaaaatcagagagctttaattacaatgttaaaaaaaaaaaaataacgctaaagcccttttttgttttcttttgttctagtcacaacaactatgcattctgaagcaaagaaaggatcaaaatttgatactgggagctttgttggtggtattgtattaacgctgggagttttatctattctttacat

SEQ ID NO: 66972 - DNA, 1106 bp, Homo sapiens
atcatcgcgttaagagcgacaatagcagggaaacaaaaacaggctgttgtgttagcccagccaaaagatgatggtgagtggcaatggagataaaagggtggattctagatctatggggggttgggactaatcacttgctgatggattggagggtgggatgaggaagagagaagaatcaaaggatgacctcttggttttggggttgagcagctggtaatgcaacaattgggaaggttgggggaggagcaggtttatagtagaaaatcagtagttccattttggcactcatatctgcaggcttaggaatcaaactatctggtccaattccagtctctgccactttgtatctgggcggccttctctgggcctcagttcttgtctgcaaaacaatactcctaagaattgttgagagggttagatgagctaatgcacataaccctggcttgtggtaagcacctaataatgttggcaattgtttgctatctgctgctaaatacatctacgtagtctgttgaccttgatctttttcaagttaatcttacactgtatccttttgtgataaatagatgatagtcccatcaagaagaagaaattctcacaaagaagaaatttgcccaagaagtaaagataaatccttcaaagttactgcttttctttgtacttggaggatttttttttaagtgggggagagttcatctttgtgaaaaggacacaataatacacttgctctctccctatgtgttatacatatttaatcttcattagacaaagactcaaaacgaataaagcactctgaaaagttgcttaattgggacatagaaatctcttacattttttccaaatctaaaggtgtactaatttaaaaattaaaaccctactgagaaggtgcagttaaataagaaaatcctattttatccctccattgtatgaaattaggggtgttggttgggtggtgcaagacctagagatgcctgtgagtagaatcggcctctcctgaaatggtccactccactcagaagagcagagtcctcagtggcagaaattggcccatctgtccccaattgtgtgggtaaatgaattttggcaaagctgttgcattcggtggc

SEQ ID NO: 66973 - DNA, 1038 bp, Homo sapiens
ctgtctcaacctcaacttgctcaatctgtaaatggagttagacatacaacctcatagggttgttgcagaaataaatgaaaataaattcatgtaacaagcttggcatagtccctgacataaagtaaagctctataaacactttctatttttagttctctatgattctgagttttgtatattgtcaaatgtctttatttggaaaaatatcttactatttcccttgtctgtatttgcagggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttattttatcttattgttgtgtttgtttgtttcaagggcaagttgttctcataatttgggcactttatgggctgagcatgctcagccagtagactagagtctccatggcttggggttcacaatgggttccagaactgcagagaatctaccacttgccctcctcatgagccctgcaaacaggatgcttatttctaccacctagacattttatgtgtcctgacatacctaaggcaaaaaatctagaggggttgtgacattgtagagcaggctctaggaaaaactgtgaagggaatcctataatcatagcaaattgccttgtttgcacatctcattttacagggtgaggaaatcagacttgtttttcatcttttccttttacttata

SEQ ID NO: 66974 - DNA, 1034 bp, Homo sapiens
ttcagaggggttttcacataagattggaattttataaactatatcataggagaaaatagcatctgcttcaatttttctcctacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagaggtaaaaaaaaaaaaaaaaaaaaaaaagcaaaacaaaacaaaacaaaaaacacatgaaatgtatccattcatctatctggtgttgttgtactggaaaaggctcaaaagggatccttgttacatatctttccaataaatttttttcctactagaacatggagacttttacccttttgatggacctggaaatgttttggcccatgcctatgcccctgggccagggattaatggagatgcccactttgatgatgatgaacaatggacaaaggatacaacaggttagttacacatctctcagaatgattttggcattaatttttttatatgtagaaatctgttaataaccaagaatgctcaagaaatgagatgttctggattttccagtggatcagagatcagcagaatatatttttgttttaattattattgaaaatattttcagatgctttaacagttttcctatattggtaagcacaatataggaaatatcattaagtatttctttaatgactggatctttgtgatctaggggtaaccattattaagaaaaatttctcatatcaaaatacaaacattcaagggatagtatattgcactgaatctacattaaaatgtgctctggatgttacttatgtaatttcctccatttacttctttactcttcaaaccagaaataagaattaaatttcagaaactgagattctcttttttttttttttctggctgaggcattattttagtacttttaggttaaaagaatttttatgggcttgttctgaaggaaaagactaactcccaaat

SEQ ID NO: 66975 - DNA, 1048 bp, Homo sapiens
gagaaatattttatgtggtctttggtctctgcttacaaaatatggcagcctattcttgaacaaaaagaggtgtttcaggatgtctggtaattgaatagtggtttgccttcttgactttttaaaatatgtaaattaaactgatcacaaaaccatttttgtttttggacatcaataaagacctattccttagtattctcttctctgatttctattcttatcctctaaagagacttttcaaatgtcaagaatgatactcttttttttttttttttttttaaattaaacccaagagcccttttttggtttttgtttcccatgatcttgtagaacgaccttcttcttcttgaactctcctcttttccaattttcaagacatcactactctagactgcctacctccttgatagttcctcagctcattactgtgagcaattccttgggctcagttttgacttctggcctcttctctttatatccttcccatgagagctcatccactcaagcctctgctcttccttccctgctatgtggatgcttctgaatttatattgctatacagtccatgccttcacaggatattttccttgatcagttctccttcaacttgacttaacaagtgtaaagcaaaactcattgtcttaacccctaaactaagttcccttccagtttgttctcatcagggaaacattcttctgcagcattatccttcattcctcataaccagctagacattcaattctgcagacttttttctttgaaatgtctattatatctctttcttcctcttttgtgtgcaccaccatcacacaagtcacacaatggattattgcaccaattttctggctggtcacacagaatttatctgatcagtcaatatatctggtctccttctttccagtatgcttgcatcatggtacccaccttatcaaatatttttactggccttattttcattcaatagaacaatctaaatcctctgtgtggtaagttccagggactagaagtggttgttttagtaaaattagagagagggatggagagggaacat

SEQ ID NO: 66976 - DNA, 1840 bp, Homo sapiens
atttacagtgtagttggcaccaagtaataaatgctcagtaacatagctactatggctgtctttaaaagtggattggtttgacttcataggaaggactctatttttaaaaaagagaaatattaaaaaataaaaagccaaaattctatgatgtcttattacattgagtctcttaaatcagtttttttttaattaagtagcaggaccctattgcaaaataagttttacctagaagcacagtatttaaaacagaaagctaaaatactctggttaagtgggaagctccctgtcttcctcgctgctagtattatttctgaaaaacctcaaaggaactccttgctctctgaatagcaggttttaaaaaccactacttgcacatttgcaccttgacatcaaacatgtgaacaaagtaatagagtgagaaaactgaatttctatttaggaatttctattttattctctctataaaaagccaagaagtggttggtgtttggaataacatgaaaaatattccaagtatctttggaaatacttacactagaactataaggtttatgataattctatcttagattcattatctagagctggtctaaaaaaggatgatatgtaagaactaccaagagagacttggagtagatacaagaatgaaggaatgaatcaatatccaataaatatccataggcccaggctttgctatgccctcttattacacaggataaaacagtgtagttgttagtttctacctttgaagattatgatccttaaaaaggaaacagctctgtgaacagagaccatgttattcataggtgttcctcacttgtttccaccacataataggtatttaatgaatgaaaaaattcacgtctctctttgatcctagactgcaagttacttaaaagaaatggaccgtattttacttatctctcatggcctgcaaattgagtttgcttactgaattaatgaatgaatgaccaattgtacacatatgtctgtaaaacgtttacatatccacattcccattagactgagattcttgagggcagaaaccatgtcttcagctctcagcatggtgcctgactcatggtaggttgtcaaaagcatttgcagaactgaataaaacttacgtttaagtagtactggagcagtctcacataaccgggcacagtgtcttctaaatagacactaaaattatttcataattaaagacagatctcactaagcattttctgagttagtgccagttgaataatatgacaataagctataggagttcagaggagagtgagttctgtggactgaaatagtcaaagtggattttcagagcagatgagacgcgatgaaggctggggctactttggtgttttaagaacattaattaggcagcaggaaaatctgaggacagggagactagtaaggaaggctggaaagagccctgggtttggagttcagagatctgtgttcagagtcctttgcttcttagtgactatgtgaccttgagaagataacttgagctccctttttcctcttctgtgaggtagaggtaagattgatgtgcatattgatattgtacttaaaagtgtttgtaaaatgctaagtaaaacctaatgctatgctttgaatgtagtgggttccaaatatttgtttaatgacaaagaataaatgatattgactaatgaaaataatggagccactggaatgtcacctcctgcatctgccagtaaacctgttaacacaggggtggcgggggggggggggaagtaaatatgtgaagccaccaaatctcatgatcaggagaaaaactttggaactcccatgagactccaaagttatgtcacaggtg

SEQ ID NO: 66977 - DNA, 2867 bp, Homo sapiens
ctgcctgattgtaggtaattacgtagggcattatagccctttctcaagagtaggactttactgagtgagctagcaagcaattaggattcagatcaaagcaaggatggaagcaggtagtagtaggaagataatatggtaaatccaggtgacaaatggtacaatttgagattaagagtaatggaaataataagtggtcagattctgaatgtattttggtggtagcaccaaaaggatatgctgatagaatggatgtgaggtatgaaaaaaagaatgatcaaggtttttggcttgaagaatgaagtgggcattaataagatggcgaagactcagaggagcaggcttaagcgggtagattgagagtttacttttggatatgttatggtagacttgtctgtcagacgtccaaaggaaaatgtagagtgggcagttggatatttgaacctggaaaagtagaggtctgggctggagataaatatatttggaagtcatcagtgtgtaatcttattttaagtcaggacatggatgaaaccacttagagagtaagtgtagccagaggatagaacttaattgaagacatatgatcgatgaaattcaaggccaacttttgtgatttttcaaatagaaataaaatgttaacattttctaccacacatatacaaaccattactttctatagtgttgtagaagcactaagatttaaaaagcaagattgataatagttgccaaatatgtaaacaaatggcaaattaaattgaggagggagtgtcactttattcttggaataaagtttttgttttgaagtaatacagttttttatattaagaataacaacatctggagtgctagtttctttttctcattgttggaaattgctattccaattcaatttgacagttttagcactagagggcaggcttgcttctagattgtgaagagttctacatgaattaatatagccaaacagcgcaggttgaacatccttaacttgaaaatctgaaattcaaaatgcttcaaaatccaaaactttttgagtgttgacatgatgccacaagtggaaaattccacacctgacctcatatgatgggtcacagtcaaaatgcaggtgtacaacagtttactctgttcccaagagaaaaataaaattagctgcaggctatgtgtaaaaagtgtatatgaaacataaatgaatttcatgtttagacttgggtcccatccccaaggtatcttattatgaatatgcaaatattcaaagatcaaaaaaaagaaatctaaaacacttccggtcccaagcattttggataagagatattcaacctgcacctacattcaatctcaattaatgaatgcagttgtttcttatgtgacaggtttgccatctactatgtttttttctagtgctaggaaagcataaaataaggctaattgattttagtacatctaggactggcagttgacgctaatatacatttgaatataaatgtatatttatattccaaggagtttccaaggaaactcaagtgtagcttaattatactcagatttgatatagagggtcttccaccacatatatgaatattaaagccagtcagaagaaatcctggacatgaaaacattttttcaggaaataattaactatgtgctgggtattattatatgagcgtggctacaaagatgaataaaatatagtccctgcctaaataagctttgttgtagcatcttacagcacttaatatcttgtgctgtatctatttaaatgtctttttcccttcaataatagaaatcctgactcacttatttttggtgcctccaagtgcccatcacacaattcagtttacagtgtttgaacatgtgaataatgagagagagaaaaataagaaaacggtcagggaattggggcctttgaaaaaacttattttcacatttttacccttagagagatgcttttcctattaacacgtctaaagattatggagacaattctaaccttctatctttgctcccactacttcttcaagcagactttaaccccattcctcaagagcagttattggcagccatagagagtgggaggtcaagccttttttagtcattggagtaaacaggagacatagatgtggaaattgggaggttctctctatctggcttacgtcagtttgagaagtttgacatgaaatggaaccttctggaatgaggttctttttcctgcttttcacctggaaagttttcccatacatggtcctcttgcacccctagtccttttagggtacctatttctgtgtgctagttctttcatttccttgtctgtaacatgaggataataatagtccttatctaatagcattattttgaggatgaaatgaaatacaggcagtaaatattagttactctttgctatctggaaaaacatcaattgaacctcataggatggacttgtgttcaataagtgttatatatagtagagtcaaatggaaaaattgaaccactcagatacatttttttcattgatacataatagatgtatttatttggggggtacatgtgataatatgatatattcatataattaaaattcattgatacatgatgtatttatttgggggtacatgtgatagtatgatatattcatataattaaaattcattgatacataatgtatttatttggggggtacatgtgatagtatgatatattcatataattaaatgaagataattgggatatccatcaccttaaatatttatgttttctttacactaggaacattcgaattctctttagctattttgaaatgtacaatagtttagtgttaatagatcagtcatcctactgatatatcgaacaccaggtcttatttcttctgtctacat

SEQ ID NO: 66978 - DNA, 2203 bp, Homo sapiens
agtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaagtgaagatgtcccttgagtgtcagagtggtatttatttttgtaaatttgaattttttgatttttgaggttccaattcaccgtgaatttacagaattttcaagattttaaacagtcttaatatttggcaacatagtctgctgatggtatggctcattatagtcatctctgcacaatttggaagactgttggccttgacttctgggataatgatttgctgatgcagctaataaacatttctaggtattggaaaaatgctcctacttttagctctgggtttctataaaagctgccaaggtcttatgcagatgtcttatctcagagagcttagaattggaaagattatgtccagttgttttgttttctaaaaaagttgtattattaagttgtatcatcattattattgttgataatagcatatttatatttttaactgtcattatatagggaattttgtttaaagcactttttttttttttttttgccttaagagaacgttagctgtgatatggatttaattaagatacacataggaaaagaagacaatagaataaggaatcatgagagaactctgggtataattaattgtgcacaactcaatagagccatttacgttggtagtattgcagcttgctaattatcacaattttctgcctgttggtaatcaagtgtcttgaggaaagggaaggctttcctaattcatgtaaaaggcacttttgtactagcagcaggcctgtttgtacattccttttcaaaccatccagtatcccagtgatatgaaaactttgttcatattcatagcccagtcacaacttcagaaacatttctagtgtcattgtttgagtagagagaagtaaagaggttatttttccataataagggagtgtttctattaggatttaaggtaaaggttgatttttcagtggtgaatttgtttaaagaatgatttctccatattgattacctaagagaatgacattttaaagtgttttattgtttgctttttagttaatcagctgggaaaaaaatgattgccactgttttacttgccttcttaataagattactttgtacagttttctgaaacacccataatagtgggagacagttttcctaaatgtcttatagaaaaggataatacagaatgctcctcttaagtattagaatcactgagttatgaactgagcataccagtggtgttaggatttaatattatgaatgatgttttaatatcaaatttattataaggaaagcatttagatttgtagacctttaaatttataatttagttgactcttcaaggcacatctgaactgaagaacatatccacttttgttaaattccaaaacatataagcaaaatcttataaattgtccatttgtaacctgaactaatggtaatatctttttcatcttcagtatttgagtaaaatagggaacacttaaagcttatagatgacatgttttttaaaaggtatatttatgaaagcacaggcatccttggtatacgcaggagattgataccaggacccttgtgtatacccaaatctgtgcatacttaagtcctacagtcatccctgtggaacctgcctgtataaaaagtcagccctccccgtgtatgtaggtgtcgcatcccgggaatactgtattttcaatccatgtttggtttaaaaaaatctgcgtataagcagacccacacagttcaaactcatgctgttcaagggtcaacagtatttactttgcatacttatccaaagatacctttaagactttttgagtctgaaaatgaaatttactttattttttcccttaaagtcaactgtcctatcctaccctagccatactttggagtccagtaccactgaggccacgcttgctttactctattgctccatctatttctctta

SEQ ID NO: 66979 - DNA, 1079 bp, Homo sapiens
taactttcccaaaatcactcaattaagtggcaagggtgggatttaaatcgaagcctatactctttcacttgtttccaaagatgccaaactcaaaatgtggctaaacagtaaatcttgagcaaagaaatgatttactaggaagcagcacaatagaacatactggatgtaggaaatgttatatatcttgatctcattggtggtaacacaagtatatacatatgaaaaagttagttttatccttactgttagtactcagtgctcttattattcctcaaaaatgaaaaaaaaagtaaaaaatagattatgttaatatgtaaatgcccatgaggaatctcttagaaacacaaataattaaaaaaatagtaaatgttttagaaaaaaccaaatcacaaaaacagttaaaacttagtttactaaattgagtaaatgatgtttgtttaaatatttaaatacaaatatttaaatcatttttgcagcaatcaaagtatcgtgttatgaacaaagatcaatggtacaatgtattagaattcagcagaacagtccatgctgatcttagtaactatgatgaagatggtgcttgtaagtataacataacatgttcctttgaaaacaaaatttccaaaaatattaaatgagagtatgcatttgtgtagtattagcatagaggttttaaactttgtaatagtaacttatttaattgtgtgagggattgtgggagaagtagagagagagcttagattcagcagtattatataaaatctatgctggtaaatgaaatgttttcagttcctcggcaaccaaacattttagctaaatttaaattataatttttgcatccagaagctaaaattcagctttgtttctgtctttcctggcatttgcctatggaagaaaagtacagtcatgattttaaaaatataacagcaaaacaatcagccacaatagaaaaagctttaacattattgtaatattatgctacccattaacaatatggcaaataatgtcagtataacttctctctgaaaactataaattgattgtgagctaactgatagtgaaatagttataatttttcaatc

SEQ ID NO: 66980 - DNA, 1063 bp, Homo sapiens
gcatatctttatggtaggatgatttatattcctctgggtatatatccaataatgggattgctggatcgaatgatagttctacaaacaatacttatcaaaacttgtggttgcagctaaagttgtattaagagggaaattatagccttaaatactatattaaattaattaaattctggtaagattggtcaagaaaaacaacaaaaaagggatgaagataatgctaatgcaaattagaaaatgttataaattttaatcatatttaaataaacttatatgtaaaataatcagttatgagaaaagtatgggaccaaaacattcaaaaagaaatagaaaatctgaatggccctatggccattaaaaatgttggtttattagttaaaagttttccttccctcaatactcacctgagtttggacagatgctaattccagggttacataagctttttcaaaaaacgggggggaaaagtagcaattctcttttcattttctgagtcttatgtactacaatcttgttaaaaaaactagcaaggagagtaagaatgaaacttaaaagctagtctcacttaggaacctagcaaaacaaccccaaaatccagcaatgtataaaacagataacatgaccaaatttgacttattctagaaatgcaaggtttaattaatattagaaaattgtccaaaatatttacacattaatgaaattatgttactacacattataggcctttgcattattgatttagtatagtcttagttaaatctgagaatgccaggtggctggagagcatgttgaataactaaaattcagttttgagtggaatactgtggaccacagtagatggcacaattaatttgattaaagggagtcagatggtctctcagaggtggcaaaatgtgagttaggtcttgatgaataatatttttatcagcatgtttgagatttcaagtggaaataatgggtgctgaagtatggcagtggcatttgggaatggtaagtgatataattagagcatggtaaggttatcaggaagtggcaggagatgaaactagagatttgtgccaaa

SEQ ID NO: 66981 - DNA, 1171 bp, Homo sapiens
ctgacaggaggtggatatgctggctcactcgcctgccgcttgcctcctgctatacagcctggtttctaacaggccacaggctggtaattatgctcagcccagacattgggcaccttgctgtaaccataaaccaaggagaacgtgacatgtgctagagtggaaatacaagatactatgaaagcacagatgagtaaggttaatttcagctgagtaggtaggtaaatgtaggtgtggcctgtgaactagaacatgaagaatgattaggattttgtttgttgaggatacaggaaaatgtttcagaagagggaaattgtgagcaggaccttgaggaaggaaagcatatgtttgaaggaagtagtttgatttcttaaaattgtaaagtacataaaaaaattgccaggataggttttgaattctaatattttgagtgatggcttcactgtagagtgctttagctaatacgttgagagagtttaaatctatgttacagatattgggaaaccatcagagattttaaagcacaggaattttaaaagatttgggggataattttcaatgagcaattgtttttaatattttaaagtcacagtctcttttgagagtcttatgagaactatggacctcgttcccattaagaggcacatgtactgctagacacaaaaatttgatgtgctctcaggaggttatggaatttctcttccttcgtctatagatacgaggtttcaaggatacttggcgagtttttgttctggcatagtgtactagagtggaggtcttttctcatatctgctagctgaaagtctggtgttggagcaagggtgaaatactataccagtggagaaaactgaatatagacctttgaagaggaccgtacttgattatgataatgaaaaggacaagacaagagcatctgacaacagtgatagtaattaagctgcctgccggtaggttgcagtttgtaaatctagtctctattgagccccggactttgaagtgtaaaaggaatggcatggcttgaccgtcttagcgagaggggaatagggaacatttatatgatttttttttttggtgggggtggaagaggagagtaaatgaaatgccatcgtgtgtgatgtgactgtcattcatttagcatttggggcccaactactaattgccattagcatccttt

SEQ ID NO: 66982 - DNA, 1052 bp, Homo sapiens
atttcaaaagggtaataaatggcctgttttataggtaaatatattccccttctgattactgtattgaactttgtgttggttctgatattccagtagattaagaagctccagctgccttatgttttttcatattcatgcattgtcaaaaattttattcagagtaggctctcagtgaattttttttttaatggattggtttgagtttttgtactaacttgtgattgatactaatggagtatttctttgctgctttttaaattttcttaatttcatattgtaatctggtgttcaaagaatacttcacaaattttaaattttaaatcctgtagcaaatatttatacttatcaaagctatgccaaaattcaaatttaattatttgcaaaatattatggtgtgttcatgggtacctttagcatgacgatttatgttttatgttgatattataacaaaatatgttaattatttttgtctttgaaggtcctgatgaagttgtagggccagaaggaatggaaaaattttgtgaagacattggtgttgaacctgaaaatgtatgttttatttctaagtagaatggcatataagtggggtatagcatattcgtaaattactaaaaatcgagacactttaatcttgtatgaagattttatttcttcatgtttaatattgtaaatttgcatttaaggtatttttaatcagtttaagttgggcaaatgtattctttcttgatacaaatgttatatgtaatagaataagagattctaccttcagaaactgttagaactttttacttttaagaaattggcacatctcaatttctttgtatatagttaataattccagaggttgtactctttaatagttgaaggatggaagtagttgtgtaaaaatgctctccatgataaatatagacatgattatctctatgctgacttttcccctatcctttatgttctgttctttccagattattatgttagttttagcgtggaaattggaggctgaaagcatgggattttttaccaaggaagaatggttaaagggaatgacttca

SEQ ID NO: 66983 - DNA, 1378 bp, Homo sapiens
acaaccgaccctcgatcccctactcccgtatcgctcctctgcctttttctagacttagaagtgagtacatatccgcagaagggtcacttctagaatttctttgtagagtgtgaagaaagcagaacataaggaatcttgacaactgtcttgggaatggtagaaaggaaaacttgtatgctataattggcctccatatttagtatttggagtggcctaacccggaaggtcccagcaggaggccttttaaattgcaggagccccattttctggaagtatagtgcctcacctatgccaagtccctgtgtgcagagttggaaaggccctgcatgctttttgtcttctagcattcaggacgctgttagctctcagcataaattaaataatttgtgagctcttgtactctgtcctactggtaagaaagaagacaaggcagaactatatagtagtagctctttgatccccttgtagcatatcatggaggcatcacagcaaaatttatgctacaaaaaaactgcaattttggtttgagaaatggtttttttgtttttttgttttgttttgtttttctgagacggagtcttccactgttgtccaggctggagtgcagtggcgcgatctccgcttactgcaacctccgcctcccgggttcaagcgattctcctgcctcagcctcctgagtagctgggattataggcgcccgccaccacgccctgctaattttttgtatttttagtagagacggggtttcactatgttgactaggctggtcttgaactcctgacctcgcgatccgcccgcctcggcctcccaaagtgctgggattacaggagtgagccacctcgcccgactgagaaatgcttttttaaaaaataaccatattagctgccttttcatcaatggttggcacttgatatgacaacttcagatgctactattgaaaggagactgtagccaggattataagaaggaaataatgatagagctctccttaaagagagatctgcttaaactgtgaggtagatgacttacatagtctgcatcttcttttttgtaattggtcgacttttttccctcattactgtgttttggtaaaggagtctatggagtattaggctattaatgtgaacgatgatacatacacctcttgtttgtcaacattagaatttgacatggttactttagtagctcacatttttataagatacaggcaaattattattcatttttgtactatatcatggccatcttaagtatataatgtattaaaattatttaagttaagtacattaagatagctgagcaggcagtattattagaactcaggtgatactttgctctatcaatttaaatttttaaatatgatactcttactttactc

SEQ ID NO: 66984 - DNA, 1063 bp, Homo sapiens
ggctagatgtctctcttctgattatgcgtgataagaaatcagtaagaagaataaaagacatgtttgagagccaacataaacttgtccgaaccccttacaatcgatgaccgcagggagccgctgaagagctccgaggcggtcgatagcctccgcgagctttgcgtgcgcgtgccccgagagggcaacgcccaccgcgcgccgccagcgacgccgccgtagtgctccgtcgccatagcgactacccctggcaaccgcgaagctctgcggtcccgcggtcgggctacgggtttgagcaaagctcctctcttcccttcacttccctccggactggtttcttcttccttcccccttcccccaacttccctccaccccttccaatcatggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacggtacggttccttgcactcctgcctgacccctgaccactcttcaagtccccaggcccagccagagggacgtcgggtcacactctttagctttaccaaccagatccttttcaggaacccaaggctgtctccacttctcctgcattattggcttagatgcgttggcctcgtgcttaagcaggtagtttccaagctttgcatcctacctgaccgaagcatgtttcccttccatacatctgaatagaagcaattagattgtgttttattttaaatttttatacggagtttcgttctgtcgcttaggctggatggagtgtagtggcgcgatctctgctcactgcgtcctccacctcctgagttcaagcgattctcgtgcctcagcctcccgagtagcaggcgcgcgccgccacgcctggctaatttttgtattttcagtagagacgggggtttcaccacgttggccatgtgggtctccatctcctgacctcaag

SEQ ID NO: 66985 - DNA, 1032 bp, Homo sapiens
cagctaatgaactcattactatgaactgacctattttaaacaagattgctgtagtgaattccaattgagttcatctggttccgatttaaaataatctagctatatgacaatttaacaaagttttatgctcttaactctttaaggaaaaattttcagttaagataaagttaatttcaggagatagacaacttaagttcattttggtagttttgagtgcatgtataattttaaaagcaccttttaaaatgctttttctaagtaagagggtaattaattacattttgttatagactttctgggttactagagaagcacactactcattgtgtacctggagcctacagctttcatctgtactattactgattctggctagaatggactctggctggaatggaatctggctggaatggaatctgactggaatggaatagttagcagtcaacaacgtatatattgttttatgtttataaataacttatcaaagtgactttatgatctaatgtaagtgggaataagtttttaaactgaagtattcttaaggaaagaagagataaattggttttaatatatttatttttaaagtaactatttttttccaagaggtataattatagtgatagaactttgtctacatttttttcaaatattaaattttatgaagataacattaaaaatcatttatcactttagattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggtgagaaaagaagctgtcattttttttaactgaggtatttggataaatgttttcatataaacataaatatctattttttactgttaatgttagtagtgttttaattttaattaaaatatcttttcttaactttttttaacttaaattttaatgtaagttgtggtaaaa

SEQ ID NO: 66986 - DNA, 1380 bp, Homo sapiens
cctcactcgagtatttgaaccttttactggcctgaatcctgtgcaatataatccatatactgaggttgtatatatatttgtttatgtctgtacagtttcctgtttatgttgttctttttaaagacagatttaaaaaatactaaagtctaacaatgttgttaatgtatgtagcccttgtggaaagctgcggtgtctcaatatgaaaagattattgcacctgcggaacaaaaaatagcaggaaaattgaaaaattatatttcagaaattcaagacagtccacagcaggtaaaacattgagatatttcacttttaatatttctcttaagctaatatatatataaaaatatatatatatttactgagttgatccgttgggatgaacatgtacttattttattttatattagcttcttcaagcattcctgaaatataaagagttggtaaagcgtccaactataagcaaagaattgatgttagaaagagaaactttactggcaagacttgtggactcaattaaaggtaaaagtttatgagattatagtgtttgcttgagagaatatttttgtatattacttttttcttcgttgcataccatttaggattaaagatacatttttctgacattttcatgctgaagattaatttacttattctgttataaatgacagatttttttgcattaacaagttattataattcgctgtttcatttgatacatggtacagtccttggggataaggaccaactcattatttttctttctacagcatctgacatagtgcttggtacgtggaagttatttaggaaatctttgctaattctttgtaatcatttatttgatttaaattttatagattttcgattagactttgagaatcggtgccgaggaattcctggtgatgcatctggaccactttctggcaaaaatctttcagaagttgtcaacagtatagtttgggttcgccagttggaattgaaggtatttattttaataaaagatgaagagtactaattataaaatctgctaaattaaggcatgtagaaggtactctagagctgtagtaaatatattctctgttttccttggcatgtctgtctaattttcatacaaaatgcagaacactgaaaaagtatgcagaggagtcgtaatggttctattccttctttctgtagagataatgcatcatttattccaattgcagttgttccaaagaaatacctgtattcaggaggaaaacatcctttatgctgagtaaaaaaaagaaaaattattgtttacaaaaatgagctggacatggtgctgcacatctgtagtcccagctactcaggaggctgaggtgggaggatcacctgaacctgggatattgaggctgcagtgag

SEQ ID NO: 66987 - DNA, 1035 bp, Homo sapiens
cttatataaccggagtagttatcaaaaccaggaaaaagactgttttgaattttacaattttccactaacattcttttttttttccaggatacaatctagaatccaactctgcccttagttgttgagtctctttagcctcccctcctcagtcttttccttgtttttcatgactttgatgagtactgatcagttattttgtagaatctctcttgatttgggtttatatgatgttttcccatattagattggggctatcttattttggcaggaatagcacagaagtgatgttttgcccttctcagtacattggtcaagtattgatatgtcttgtatagattaagttaaacttgatcacttggttaaggtggtatctgtcaggtttctccactgaaaagttactatttttccagcaatactttgagactagcatgctctaatttttcataggtggttgttcttatgaatattgatctgcttcggcagcaacagcgctggaaagatggattacaagaattgagaactggcttagcaactgtagaagcacaggtagagtatgttttattttgtgtgtatactttgaaatatgaccttttcagaatgtaagtacaatatatgaattgccgagaagttcataaaagttatctttaaatcttactaataaatacctaatatatttataatttttgactgaattatatataaagaccacatatgaacaatcaatttacatttaaaaatataaaaataagttcctgtagtgtcttatggaatgccaaattcctcaattcagaatttgtaggtttttgtcttggtatttaaatatctatcacttattagttctcttctaggtgatcgtgatagccgtaaaaaacaaagttaagtttaggtagaatcctaatgattggaataattttattccagatttttttcctttttggaggtaaaatttgagttctattcatattttgatataatagttgatgcatataaaggtggctagcacaaagcctgctacatagtagatggtaatgaaat

SEQ ID NO: 66988 - DNA, 1046 bp, Homo sapiens
gagtaacaaggatgtaccagttttacatatttgaaatgagttggttttatttttgtgattataattgtgcattatgtgacatgaaagtattaaatgaaaaatccattctactgcctaatttttaaattaaaaatgtgaatgtaacatattagggattccaagcaagtgacatgcatgcatggaaacaacactggaatcatcaactgtacaaagctctggagcatcagtaccagatgggcttagaagcacttaatgagaatttgccagaaataaatatagacttaacttacaagtaagatgttttttcaaccccaatttaatgttcattgtataattttctaacaatttatgttttaaagttatttatttacttttagacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaagattgtcagctgttttacaccaacataaggtatagaacatgtaatgttccatccttccatcataaaattatttctgattgattgaatttacattaaatgtatacattaatagtttaccttgtgtggcataacattaaaatatggcaaagcagagagctggattcgtagatacttatacaacctagatttatacttcagaagagaaaaaagttatgggaaagattttttttttgtctttgattattttgtgacaattgagaaacttgttttttttggttttttatttttattttttattttttattttatttattttattattattatactttaatttttagggtacatgtgcacaatgtgcaggttacatatgtatacatgtgccatgctggtgtgctgcacccattaactcgtcatttaccattaggtatatctcctaatactatccctcccccctcccgccacccga

SEQ ID NO: 66989 - DNA, 1039 bp, Homo sapiens
ttctatcagtttgtgtcttccaggcttcaaacctgcaagcagtctttgatgtttctttctttcttcctgactgtgaggaaatgtctaaagtattcttcctagataaaatggggaagatacttgaaagtaggcattgaggatacacaaaacatttgttgagcaccttttcttgccagtagtagtcctagggatgtaaagatgacttagtttattttcactgaatgttcgcagtctaatgaggggctgagtcatataaataagctattaatgcagtgtaataaatgtagcaataacagtatgtctaacttacagagatagcacagaggaggagtaaataactttgttgtatatggtagttgttaaggaggaggtgaagtttgatctgagttttgaaaaattaatagaaattcaccaagttgctggaggtgaaagaatgtcttcttagataaagggaatagcgtgtacaagttatagacatgtttgtggaagatgctttttataatattggagtagaagtggggataggtaagtttaaaagcaagaaattcctttttttaaaaaaataaagatgttaagtaatcaagatcagaataagagtaatggctctgtccatagagaggaagggacaggcattttaccggttggttgtatattgaagagagatactttgatttgttcagtgacttcttgaacttaaattgttttaatggttcccagcattaaaaaatgggtcttacctagacctgtgagtaccttggaattgcaaccatcatatttaaaggttaggtttgtttttattgaattcttctgttcagcagggctttttagcctttttttttttttttggccatctgttgaagcctatgaacccttcttagaatatatgtatatatatatattttttttctttttcttttttttttttttgagatggagtctcgctttgtcgcccaggttgtagtgcagtggcacaatctcagctcactgcaacctctgcctccttggttcaagtgattcttctgccttagcctctcaagta

SEQ ID NO: 66990 - DNA, 1050 bp, Homo sapiens
agcatggaagtatcttgtataaaataactatcattaggatattttctcttatttttaatgaatcatacatataataagttatttttattttctatttttttctagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggtatagtattggtaatcttgaattattttatctatatataggaaacaagagttttgtaaatcacaatgctatgttgcgggtggcatatatctggtattaataaatgtactgtattaaaagccttggaaaacagtctcactttcctacctatattgccctgtaggttttagtgatgatttgtattttttttaaaattcagtggttatttcttttcttcgctggttggcatttatggatttttgatagcttatggtactctctttaagagtctctttcacatgaaaacatttttagaaattaagaaaactctgttattcagcataagatgatacagtggactttggggacttgggggtaagagtagggtggggagggataaaaggcaacaaatatggtgcagtgtatactgccctggtgatgggtgcaccagtatctcacaattcaccactaaagaacttatgtaagcaaataccacctgtacccaataactaatggcaaaataaaataaaataataataaagaaaaaagaaaaccctgttattaactgaaacataatatccaagattatattttataataacctttaaaattaagattatattttataaagtaatgttttcatccatgtcacctcacttagtacattctgaacagttttctttccgtatttctttaactataaagctttaacttaaatgtgacattagaatgtcagcctctgaagttgttagagaacatttcctctctaaagttttagtttccctttgttagggtagtaaagtaggctcca

SEQ ID NO: 66991 - DNA, 1049 bp, Homo sapiens
taaaattttatgtgagtttttacagcatcaatttcaaagttattgttcatccttattcatcctgcagcacatgatttaagatcattgaggttcccatattgagaatgagaaaattctttataaggtattcttgtcatattgttttggggctggattgataattataatataaataattaaaatggccttaacctagattgatgtagatagtattttaatgctgataggagactgatataaaattcaacttatattgtattattgggaattgattgtaattttcatttcttgaaagctttaactctatacattaaagaaagatgcgtcattttttaatattatattagtatacaagtttaatgcacttgtttagtcccttgaatttgatggttaaagatacttgtttcagaatcagctttgaatctggaggaacaatttataggcgtactttttaaatgtttataaatttcctaatgaatttccaattataatctacaggattctgaaaatacagaacagagaatccagtcacttatcagctcattacaacatatggtatatgaatatatatgtcgttgtctatttaaggtaagaagcatcatatttttcaaatataaaatactacttgttctgtgatttaacgtaatatttatagttatagtataactctttccctactggaaaggtattaaaaatggtatttctggtatttttccagaacatttaactggaatgccttatagcattcttggttgtagtggggaaaaaagtgacaagtgaagaagggacagcaaacactgcgttagctgacttagttctaaatattccagtggtcaccaaaagagataatgacaatggattatgtatctcattatatagctagactttctcatcctcagcaactgacattttgggctacataattctttgtgtgtgggatgttgttctgtgcgttttaggatgtttagcagcatctctgccttccagcattccttcccatcaattgtgagaataaaaaatgtctgtggacattgtccaatgtctctggg

SEQ ID NO: 66992 - DNA, 1050 bp, Homo sapiens
ctgtttcccttacttcttggaattaatatcttagatttgaaatggcatagaaaaatggtggaatatgaggagaaattgttttcatgcaaacttcttgaaagttagtgtctgtgccgctcaccttgcctccatttccatatgaatttgtttgttgatggagtaaaattcagatatatattatgttttaaagtataatattactaacctcacatgattgtatttagtgtgcaaataatttaatttggattctgctattttttctgcgaagattagtttttcttatatgaaaaagtggaagttctgtggttggatgtttagaaattttataacttgtggctactaaagtgaatcttaataagtgacacaattttcttctgcttaaataactttgaaactcctagaattgtatctaatcctttgagttttctgaaaatacagttgaatgtgcataaaattattcatgaaaatgagtgatttagtctcaagcagtatgtgaatgcccaagttcaatgttatataaactgctttgagcttaaagcatgacttctcttcacaaggtaacatttcttttatacttttcattgaacatatttgaaagcaataaatatagtagagtagaagtaaaaggaatgaattacttagattttttactgcttccttagtctctttgaggatcatggggtttatggaatgttttggaagtaaatttgatatgactattatatagtatatcagtttactgtatatcaggtagttattttactgatcaccttttgttaagtgccttacatatactgccatttaatgcttacaacaattctgttatacagaggaataaactaagatttacagctaataatctttaacttagatctagaggataaaagaagacatttatgcagccaacagacacatgaaaaaatgctcatcatcactggccatgagagaaatgcaaatcaaaaccacaatgagataccatctcacaccagttagaatggcgatcattaaaaagtcaggaaacaacaggtgctggagaggatgtggagaaat

SEQ ID NO: 66993 - DNA, 1340 bp, Homo sapiens
tctcggctcactgcaacctctgcctcctgagctaaagccatcctcccacctcagcctcccaaatactgggactacaggcacacaccaccatgggcggctactttttgtactttttgtagagatggaatttcaccatttttcccaggctggcctcaaactcgtgagctcaagtcatctgcccgcctctccctcccaggatgttgggattacaggcataagccatggcacccagccccttaatttttttattcttaattttaattcagtttaactggaaataatgcagccatgcacttgtgcgcatgttctttttctctttttctgtaaattgtgtttttagtattattcttgaatcattattgttctgctttataatgttattgttaaatacttatggctgaagggatttattggtacaggtaggcaaccagatatagggccaaaagagctttctttgccatttccagcttagaaaattaaggaagaagatcctggttggcctgtctgaggtcacatggaaacccttgtatcaatgtctatggagtgctgcgatgtgattgagcaacaccgtaattatatgctcattcttaaggtcaggatatcttctgtaaccagataacaggagaagggtaaccaccattacccacttattgtctacatattatgtgcctattttttgacaacattttggagttttgggctcagtaataattagcaattagtttactgactccagtggataatctgaggaccatagactgacaggggctttgcttctgttcttgaacctagagactacattgttcttcctcagtacaagtgaagaaatggctaaaataaatgtagtagtactgtgtgtacatttgtttgtgtgtgtgtgtatatatatatatacacacacatatatatatatctgtgtgtgtcacagatatatatatctgtcataaagaattaactaggccaggcatggtgactcatacatgtaatctcagcactttgcatggtcaaggtggaaggatcacttgagtccaggagtttgaggctgtagtaagctatgatcacactactgcaccccagcctgggcaacagagtgagaccatgtctgtaaaaacaaacatcaaaacaaatgaaaagaatttgctatatcattaaattataagtattgaacaatatcattaaatgataacgtttttgaattaatacatttattgtcttatttatctttatcgataattatgtatttctttaccttaaactatatgttattataatcattttaaagattcattaatttataaaatattcatcttactagcttctccagctcatcattatttaac

SEQ ID NO: 66994 - DNA, 1088 bp, Homo sapiens
catacggtctaacagaatgatataagaaattttattaagacttttgaattgttagaaagtttagataaatattagaggaattttgttaattgttgatgggtacatatcctttagagatctttaattcttaaatctgctaacagcaaaatttaaatcttttgttttcataatatccacaatgttctttttttaaaaaagtatccaaatgctattgaccccaaatttacacatacagctcagatcaattttctaggctgtatgtttgcatatctggcagttgacatatccagttggatgtctcaaacatgtctgaaaattcacgtattctggatcaagcactagaatttaagcttcccaagtgcacagatatttgcctcttgtttattgctatgttttaattgacgaaaacatggcctggtatatagcagtccaaaacttatgtttttgtttaatgtgtttgtttaaatgctttgttaagcttttgtttggtgatctcatgatattccttcccaaaccttgtattctttcagtgtttcacttattaagaatgacatcatccatcatcaatttgaatgagcgataagcttagaagtcattcttaacagccctctttttcatgtcttcatactccattacaatccaatacaaaaattctgttagttttattttcctaacgagttcttaaatctgtctacttttatctttgtatgtcacccctctccccattagggtgactttccctctcctctagattaggtcagatctctttcatatgtgtgaaacatactaaatgtttctctccatcaaagttattatcattttacagttgcatatgtatttgagtgattgtctccagcccactctttcccacgttttactgaaagctacatgagggcagggataatttttttgttcattcttatattcccagagcctgacatataatacatattttaaaaatattttttgagtgttgaatgaatgaatgaaatttgtatcagtattcctaatatccaagtctaaatatattttaatttgaacttattttattacttagaactaattagtcaatagaagccatatagaaa

SEQ ID NO: 66995 - DNA, 1040 bp, Homo sapiens
ctggaggataaaattttaggaaatatcccaatgtatatatagcaattagaataaaaaatgtagtatatcagtttgttctctatgattgtgttgccacataactaactaaaactagtatggtattataaagtacttttcatgctatggccagttaattttttttaagtttactgttactttagatttattatgtgttggttttattaaaaattctcaggagttatatatttttaagtctatattgatcatttaatttaaagacagtgatacatacatatatatctttgactactgcttagttgtttacttaaaaaaattgttttttgacagggttggacaaagttttatgaattttctttatcagatcttcgggctgggtacaacattattgacagactttttgatggtaagttctaacaaaaattttaatctcatattaataaaatattttatctgaggtcttattaactatgttttcttcagaagtggcttaacttcctatcacaaaatttgcttgtgctttttattttattttttatttgacttctatacctgtgttatctcagagttcttatatggatctgtttttacatggattcttctttctgggagcagaagtctagaaagaccttgttttcactttgtggctttcaaaagtttcaggcactaactgaatttttcagatgtctttcaggggaactgttaaaattcaggagtatagcagactaagattagtaccaaggatctgtggagtcataattgaattactaagtaggattcaggaaacaaggtacaaataatagattgaaacacagcagcaaataaagccatttaatctgaccccctaaggccatctagctatcagcctccttgaaaacaggaacagtctaatctctaaagtttattgtgcagggcgaagggagggggacactagagtttagaccaatgatggattagagaatagagtatgttgatagtaatctcaaacttaaaaatatcacaaacaaatctctcaattcctgtctcctccccacccccaa

SEQ ID NO: 66996 - DNA, 1027 bp, Homo sapiens
aattaaaacattacaagtgtgaggatataatgaaacccatgaaccaataacttaacccaagaattaagatattaccataacttgcatcgacttatgtgattttcttctatccagtctccctcccgttctgctgaagtccccaccattctgttttgtttaaaactctttttgtggttttacatattttttagtagttctattacgtgcatgcattctttcaatctctcacacatgcatttgtgcccaaaaacatattgttttgcttatttttcgaacattataaagcagtgttgcaagggatgtcctaggatttgcttttttccttcagctttgtctgagattcattattgtggttggtttggctgttgtttcattctttattgttattgtacaatatttcattatgtaaatataacacaatttgtgtatccattctcctattgatggacatttgggttactccagttttttttttggctattgaaacagtgccactaggaacgtttgtggctatgtctccctactgcataagctcaagagtttctctagagtatatgcttaggaatagaattgttatgtcaaattgtttttagtggttgtactaattcactattgtgcgaacagtatgtaatatctgcatccttttaatcctactagtacttggtattttgggatgcctttattgttgccagtctggtgggttaaagtggtacttcattgtgatcttgattcacattttttattgctgtggagacagtatgcatctttccatgtgttcttcagccactcctgctttttctattggaaaaacagcaataaggctgatgtggctgaagcacagtgagggagaaggggagtggtgggacatgaggatgggaggtagctggggtggaggtggactaggtcataagtcttgtgagccatgaaagtaaatagattactctggcagagtatgttttctagaaaatagactactggggagtaagacttaaagcaaagagagatgttagaaaacagttgcagtagc

SEQ ID NO: 66997 - DNA, 1050 bp, Homo sapiens
gactcatcttgcccacttaccatcctagagcataagggcaactctccctcaggaagaaaataagtctgcgtgccagtggtgccgatgaccagcacatttttcttcaaatcgatggaacattgatgtctccggagcatatctaggcctagaagcatatccatgggttgatcctcaagtatggagaaagagcactgtaagaaatcaccttcaatttgaatctgagctagatgaacacggccaataattctctgtgtgcccactcctttagcaaccccagcccaccgtcggtccaccagcctcatgatgttacatcgctcggcacaagcctggctcataatggtcatctgggcgcccgagtcaacaaaagccttcaaaggatgcccattcactttgcagttaatgtagagcatcgtcacttgtccaaaactctcgggggcctcttctatcgctatattcatgttttcttcaatgttttgctgccggatttcctcttctattttggcctgagcttcccgatccagtgggtcggctgtgtagagacgaagcctctcttgctctctcaaggccttttccctttgctgctccatcagcacctgagaaaaggtctcaaggcttccgctgagcagggcttccgccaagggagggttgcgttccttgagcagggacagatcgtgggggttggagagcagcatgctgcggatcagggcggggctgcccagaccttgcaggccggccaccttctctcctgacgccaagccctgtgaccgctgggcagcgggtgtgcgctgctgctgctgtccagggtgctgtggacgggagctggacgtcccaggcaccgcaatgccactgaagtctacacgaggctggttcggggcacgccctggagcccgaggtcccacattgtccttctgcagtaaaaccacgatatcgccatctttgaggccgtaggagcccagggaacagtggtcctcgatgaggagtcgctccatgtggatgatctggatctcttcgacggggactctggactccgcttcgcagaggaccttgaag

SEQ ID NO: 66998 - DNA, 1048 bp, Homo sapiens
agtcaattctatctgttagttcctcctcatctttcaccatctcatcttgaaagcctttctatgttcccttagtattgagataggtgcccctgcatttggctgccccaggccttttggcttactttccacataacagccaataccaggtgctgtaatagccactgaaagggtaaccactatctatttagaacttattttgtgccagaaactgtgttaaatgttaaatgttaaatgttattatattaacaccatctaagtgtgattgtctatttaatataacagatatcttagtcagtttgcctgccttccacccatggttattctcagagggactaactgtagcccctactgagagggcagtggatgccctgctcctccccactggcctcagggcactggacaagggcagacacatgactcagccttggttagccagatttcctgtgataagtagctggaatttgaactcggagagtcagtgaggtaggaagtcatgaaagctaagctgagaatagctacattccagtttgtgccttcagaaggaagaggcagtcagaaaggagactgcagatgtgcagcccagggtttttcaggagggtagacctctgcttcagagtttgaggtgtaggcttcagcccctcctgagacctgaataaacatactgcctcaacttccaggagacatcttcgtgttcttaactgaaatactgactttgcacttcttgaagatacagtgtgtgtaggatctcagagcttagcacatgacctgacacattggaagtgcttaataaataaatgaatgagtgagtgcatgagtggatgaatcagtctgtcctatggactgggtaccaccatctgatgctcaaagccaggtaagactcttcatacccagttgtttctgaagctgtatgacttgaattaattaagctttttttttgaggtttattctcccagtttggaattccattttgtatatgtgatcaattttctaatccaacacaataatttcctttaatagtatacttaggatattttaactgtgattaatg

SEQ ID NO: 66999 - DNA, 1048 bp, Homo sapiens
gtgccaacagttctagattcaggaattttttatgtagactctttatatgcttttatttttattattttgttttattttcttacagaaggggcagggtcatggtagaaggatgttctagtcagatgcaaaaaaagatgtcctcaaaatgtaatactgatttatggagctcatagagctagttgagtaattttttaaagcacgagttatttagaggagcatagatattccacaccagtcctggctaatgtccaggtaaagataggtgcattgtttgtcttgtgcagatatttggaaattctagtaaatgaatgatacaggaaaacactgctgttcattttaccccaatgttttgtatttccttttcttcacctctcataggtgttggggggaaattcagaaattatgtgacaatctgcttagtctttgaaagacgcatgagattctgctatactctaaagagaaagaaaaatatttcaggtagagagaacagcattacaggaaaaagtgtaaggtgtatggatgacattggagaacgataatgcatctggagaatagagtaggggtaggggggatggcaggtaggtggtggagtggaggggttgggagagggactggacagcactgcgaggcagggaggggccttgtaaactgccctggaggataggataaggatgttatgccatattcttccacagaagacagcaagaattattttaagcagtctataacataattatgtttgtgtgttaaaaagacttctaatagcacggttcatcattcatgtatatagcaaaatgtggttcctttcccatatcaaatacactaagaagccgtttcctagacaaggaatgttattttgttacttcagttgctgtttgtaagacccattttggtatgtaattctgctcactgtttttcagcaagaactgttagttctagcaacaaatacttagcttatcattgcaaccatgtatcttccgaactgcaaaccaagtcggttataataaacaggttggaaaagagctggcatttggtgggaggaaagtaa

SEQ ID NO: 67000 - DNA, 1070 bp, Homo sapiens
tagagttcagaataactttataaatcactatatttgttatgcatcatatatcagatctttcatgtacatatataatatatacatgctgatacggtttggctgtgtccccacccacatctcatcttgaattgtatttcctataatccccatgtgtcgttggagagacccggacgttggagttgaatcatgggagtatgatagtaagtgagttctcctgagatctgatggttttataaggggatttctctctttgctcggcacttctctttcctgtcttcatatgaagaagaacgtgtttgcttcctcttccaccatgattgtaagtttcctgtgtctccccagccatgtgaaactgtagtcaattaaacctctttcctttgtaaattactcagtcttgggcagttctttatagcagtgtgagaacagaataatgcacatgcctttagcattttattctttatttcacaaaatttgctaatgattgtatgttataaaaacaaagtcactgtgaaaataatcctcatttaacagaattgataaaatcacagattagaaaacaagtttcaatatttttattgagaggacattgttgctaaaatagtattttattttcaaaaaagcaatgtcttaacctctttatatttagaaaacgccatcatctcagcccaaaatctcttcaagctgataaggaacttcagcaaagtctcaggatacaaaatcaatgtgcaaaaattatatcgtatcatattttaaagggccagtctgggcaagatggtgtgaaaccacttctccaccaaaaaaaaaaaaaaaaattagcgtggctgccactgctatatagtcccagctactcaggaggctgaggcagcaggatcccttgagcccaggagttgaaggctgcagtgagctatgattgtactccaggctgggtgacaaagtaagacactgtctctaagaaaataaactaaaaataaataaataaataaataaataaataaataaataaataaatagagacattttccatttccatttagtgatagtaatactctagattttcaaaattattagac

SEQ ID NO: 67001 - DNA, 1051 bp, Homo sapiens
tgaacaaaactactggcctcataagacacttggccttagcctagatctacattggagtgagtagagttctatgtaggtcaaattatttttcttccactttagagaatttgctggggcaggtgtattaaacttagtatgcaaattcatgtgtgaaaaatgttattatcctaaggagctactttcacatataaaatttgtgggatatatactttagttcaggagtacttagaaggtttgtgaagtacttagacggtttaggaaaaagcagtttgctggatattttgtgtgagaataatattttagtctttttttggtattataaacaagtcaactgatagtatttaaagtagatactagaaaaacgtaaacgtacagaaatctaaagctgagtactgagtatactttggcctcaaatgaagaaacttttaacatgcgttgtggaaattagttgcagtgggttggtacacaaacacatttattttaactattatgaaaagagatatatctttgcttatgaatacccttcatttttagtgccatattaaaagatgctatagataacttattttttgtaatcccattatattttgagatacagtctgttgggctaaggattagacaaacacacacaacaaaaatcatttgcatctctcaacatacacacacaagcacacataaatcttttctgagatatgcttacaagagctacctagtttgctattaagtatactggtgtttattgtgtgtaccaagtattttgcatttacaaactaagacatcgcatggtaaaggtatcaatgccacttgtgtcccagggaaaaataattgcacaatagaatctatatactgcattcctctctttccagatgttcactacactaggaaggatgaaacttaccagggccattttgaattctaaatttttcatttaaatccttcctatttaattaaaagataactaaaattacaactcctcatgaagaaggaaacaaacgttgctttttttctacatttctttaagactcacaaggcattatacatgtttgtgatt

SEQ ID NO: 67002 - DNA, 1530 bp, Homo sapiens
ggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaaca

SEQ ID NO: 67003 - DNA, 1074 bp, Homo sapiens
taagtagatttttaatataatgttgatcacctcaaagtaaaataaaataaatgtgctgtgggctaagaagcagccatatggctgagacagaaatgactgtgcacatgatccccaggttggtggtagacagagttaatgaacctgttgtagagcataggatgttctgtgtctgcgaatgttcctaagttgatctgtgaacatgtacacacacagacagatgcatttcctttgccaattttgttggcttgcatcaactatagcatctacgtggggattatgtgctaagacatccatactctaacatgacatttattgcatatattccattatgtgacttaatagtttattcatccagtccccttttgataaatatttctatttttaccatgcttttaccttaaaaatgtgatagtgatttttaaatggctcaaaaggctatgtaaatgctctgaaacattctgtgtattttggaaaccaaaatttatctttatcacatgtaggcatttgatttggtgggatgtgatatatctttggctctctgttctgttttttgaggacataaaatgtgctgattttattttttttaatgtccttgataacctatttatggttggtcaatatgcctgactagcaatatagcctgttagctgaagatttttcttcagaattttgaataacctgttaactgtctcattgtttagtgtagttatagggtggacatctgttcttcacttacaggctaactgcttcttgcctatgttgacttgcttctgttttcttataagcatatgctttgtgtgcctatggaaacttcagttttcctgacttactttccttgaattagtttctgtttctctttctataccctttcccatccctttatcattttcttgttttgagttcatatttttacctcctcctatttgttaggcacagtgccaggtattgaagatcctgtttttagagcagatgggcgactatctcctaggtccttagaggtggggcagattgtagaaggaaaaagccaagttttgaccaataattctttcacttgtcctgcaacatagggtacta

SEQ ID NO: 67004 - DNA, 1026 bp, Homo sapiens
gcaagaatcatcacctaaactcacaggaccattagagattataaattgttgtcttaagccactaattttagggtgataactggaacagaaatgtcgaatcaaggttttctatttttctggttctccaagttcccaatcctcttttcctttctgtttcccacttccttgcttttgatgatgcaacttttatgtttagagctgaatttgcagttcatgatattcacaattatctgatctttacctatcttggatttctgacctcatgtttaaaaaatctttcttaattaagatatatgtgattttcctttctacttttaaatagcccaacttggaaaagtgcttgcctttttcttcttcactaaagccataactaattaatgcaatctaacactgatctttttcaaccaattatcttgtaaaagtctaacctcagaaggcatatagtctatggtccaagatcagcattttaacagctactttgttaccagaagagaatggattggaaaggagggggattgtgttgggcatatactcaaaactatgttagaaataatacctcttatgtatagtaataatattaatcatgtagtgaaatcctatataagctatttatacaacttgtacattttgctatttaacacaattatatagccttcaatgttagcccttatgaaaaatatacttttattccaatgagctcaacatttatgaaaattcaaaaggaatttaatattaaatgtcaggaaaacaaatgtttaaaacaagttttactgtcttattatttttcttagtggttatttttgtgtatttgccatcaagagggcgaattttggagtctgaaacttgcattaggtctctactacatcggtgattttgtttttattctagttctaaggacatatggaattggctatggataattcatatgctttcaatcaacgaagcacatgtaatggaattccatctgagaagaaaaacaacttccttgtatcagaagatcatggacaaaaaatcttaagtgtacta

SEQ ID NO: 67005 - DNA, 1014 bp, Homo sapiens
ttgttccgtgtaggctgttgttgactctcgtatgaaagcccacgcgatccaagtgccctgcaggttttggtccagggaaaagttggtctctgcagatgactgtaaatgactacctggaggtcgattaaagtgcggtactgcgggattcagccgatttccttcttcctctgactgcccggaaatatcagccaaaggccagcggtagtaattaacacaattacctgcctatgatttctgtcctatttaagatgggttctattatgtttttatctatacttgtcttcattaacttttcgtgatatcataagccccccgaatccctcgaaagtagatgggattctgagcacacacacacacaaattcagatccccaaaggacagtaaaacgaattattggcttaatatatcatcttagctaaccaaaagcctgtgtcagctgccatgttgaaaatctgcttaccagctgcagggagcttacaatctggtaaggcaaataaatcatacgcataaaaagtacaataagagacagtgtaaagatacgtaagtgatactaatacccatatcagcaatgatcataactcacttctccatttttaactaagaatcatataacctttccttcttgtcgttttaaactgatttttataactttgatacattacgtttctgtttccaaaacacttctgtgtacgttattgcacatgttctgtgcactagttattactgatggagacaatgagctcagaaagagaatttgtttaaattcaggaattcatatcccattattttaccatcgagcaagatctctgtgtattagatctatggagcctaatacacagacagtaacgtagggattatttgtacttggtctagaatctagaatattctccccttctcccattatcacattccttgtttcctctgtatcattcaggcccaaatctcataccaaacagaatgtctctgttcacctagtctaaaatagcttactctctccacttccaaacctcagccc

SEQ ID NO: 67006 - DNA, 1090 bp, Homo sapiens
gggtgatcaatatatgggatctagaaatacatatgcacagatgtaggtacagtagggttgctcactgcagagttgtttttgacagcaagtctagagccagcctaaaatgtccaataaaggggaaataatattatgaaatatgctacagttaaaactgcatggaccagacgtgtgtgtacagacataaaatacttcccaatacttataaatttaaagcttatatgtggtagaatactgcataagtataatctcatgtttgtgtttatatgtagagttagcaaaaacatgtaaatgcacatatatttaaatacagaaaagactgacaggatgccagctgttaactttggtcactagcaaaggagagggaattgctaaggcgggctttaactttttatctacttaagcattgcttaagtcttaattaacgtgtgtttaatacttaagtattttgaaaagttttaaaaatgaaaattttagaaaccaaaaaaaagtactattgcatacagtgtgcttgtatctttagtagacatcagtacataccaaatgttttatgtacttaacaggctggtcgtctgatgataaggaaattagttgcagagaaattgaatatcccttggaatcatattcgtttgcaaagaactgcaaaaggaaaaccagttcttgcaaaggactcatcgaatccttacccgaatttcaactttaacatctctcatcaaggagactatgcagtgcttgctgctgaacctgagctgcaagttggaattgatataatgaagactagttttccaggtaacgttgcatttttctagtatggcagttaagtgtctcgatgcctcagttctattgctattgagtaatctcaggccaggagatgtattagagatatttcagtttagggaaaatgtgcttagtacacaaaggtaatggagagcataaatctgaaaagggtatatttccatgaatatttacagacttacacataaataatagattatccgttactggggatccataactttgcctagaggtaaagtgaaatattaagtgaaattttttttgaattatacttcaatttatttcacttaaacat

SEQ ID NO: 67007 - DNA, 1096 bp, Homo sapiens
aaaagaaaaataaatgatggaaagacaattgagcaaaaatttaagatttagttttcctgttaattgtgttattagacctccccccaccagttttttttagttgatcttacttgactaatcacaatgtctaggccttttccttttctttattttgttgtgaaaaagctgttgctatgtccagtaacacagaaaggaagagagattttccaattgtcactagtgttgttaccatgctactgattcctgaagcatcaatggacacagcatgatttcttaatgaagatgggaagtagacactgatttgcttcattggagattctttgaattgctctacttattgtagtaagtgaggagattgagcaagggatttttcctaagagtcttgctaaatgatgctaggcaaaacttaggagagcagcaaggaaagtactctgttttgtactaggcattgttactagattgccaactctaaagacagagttggcttttgggggttatcattagtgcattgaaagagtcaattccattactctgtcttgtcctataggtaagaatccactaggaactcagagagtctttttctttcatggtgcattaaccatttctgctgagtgcagctcatttccctccctctacctgttctcccaactgttgctgtggacgtgcaggagagaacatacctagtatatagcctaccatatgccaggacggtacattcttactcttaggaagaatggtgttttcctggtcttcatcttaatttattaccctcttttggaaaattttggttggttttccctttgttttctaattttttctaccattaaaagtgtttgaagtgataagcataaagggtaacttttgaattgtttagttttgtgaccatatttacaaagtaaggcaaaataaaatagacaaaatacataaaaattatgattgaaatttgggaaaggaccagaattttccccctatggttttacatgttcgtctttacatttttaaaataaactttgctggacttttttttttaaatgcacttgggatttaaaacctgtaagtagttttagaaactcacacatcactttgtactctgaat

SEQ ID NO: 67008 - DNA, 1097 bp, Homo sapiens
gagactcttaaaggagaggcaatttccgtaacaaacacctctggtttaatggaagccacatgatttatttgactactggtcactcatttttaaaaagaaaagagaaagacaaaaaaagagaaacccttcacaagccatttttagttttcctaggaggtagtgccaacctctcggcagctgcacatctcagtgaagctgggatagaagcttacagagctacaaatagatgctttctgaaggtggcagatagaactagtcttggttacaatgattaaggtaaatgaaagtgtcagaacatctgggttgaaggaacaaagaaggcccaataccagctctgccatatgccacagaaaaccctgctaaaattagcatagaaaaacagactaacactatgcaagtgatattaaaacaaactatattttttccttttataacatgcctggctgagctagcattcagtgagaagaatatacttttgtcttatgaatcatttaaaaacatttgttgttgttctgacattaaataaattacatattcccttagttgaaaaatttaatcacaaataataggaaatatttattttgtgtcctgaaatttttaaacttttggcggctgtactctacgccatattcttcttcacattcttctcaaattgggtttggctgctagcaaaacaagtgtggaactttagagcagaaaaatgtccatctgtctcttacagaatgtgccagagtatttgagctggagagagaatcaccccatagcatttaatggtattctgtgagacacgaagactctagtcttctaaacttaaaagtggttaggtagtaccttaatcatcaaagatttttcacttacatgtaactggttaattcatatagagtttgtttagaacagaaactttaaaaggagggaacaaacctgagcaatttttaatcaaaattatcagttagaaaaagaatttaagacaaagatttattgtcctgaaagagtcaactcactcatatccaaaacttagaatgtcagagacttttgaaagttttctgaatgtgtcaacttcttcagcaatgagagattcaattaatgttgtttctagg

SEQ ID NO: 67009 - DNA, 1922 bp, Homo sapiens
gtcaggctatactgagatagtgtgcaaaattccttcctcacacttgatccaaacaattgaaacctgcgtatgactgttcttccatcccttgttttcttccttcctttgttccttctttcctttaattaaaaaaggtcactgatacatttataacacaggaagtatcacagctaatcccatattctaaaatagttttataaagtgattaatatttttagtttgtgtgtatgcatctgtgtttattgaatgtagatgtttcatgattgaaagaagtaagtttctttggaaggacttgggaatgcagagaagtaaagtttgtgtctttatttctaatatgttataaccagatcacggtttcagttaagtacctcattgccatcccatccttaagaaatgacctagttcagtggttcagctgatctgcttggaagtatctggctggcttcataagaattccgtagggagttttaggaatacagaagactagtctttaccttcagagatttggattcagtaggtctcaggtagggcctaggaatctgtgtttagaaaatcactctaagtaatgctaatatacagccagacttgggaatcattgaaaagtattcaaataatcccaattactaggaataaatacaagttgactgggatagtgatgttatttcatttgtagttattttgaaaagttaaatactctaggcctcataccattatttctttcacaaattttaattttagctttgatttccaatttgtggtcttctttctgagcatgaatcttcaaacttagagacagacgtcaacactgataagcatgagggatgaatattgctcactatagggctattaggcatactagatacagtaccattttcttagttactgccagagctgtgcagtatattacaacatttgctaatcctcaccaccgaggtaaaaactatgacctttgggacacagaagcaaatatcaaagtgacagccttacttctgaatgctttgatttttatgtcatgaaaagacatcaacttaatacttagtctcactatgtacttttcatattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggactttttaaagatactcattattctgtagcaaaatgagcagcaagtaatgactcagattaaaaatattcgggcaaatgacatgtttaatctatctcagaagttattcatttgcaaacatgctgtaaagtgattaatatacatcagattatttctggtgcataattttaaacatggctataaaaatatgatttctattcctgtcaaagagatttgtgtattatttataatgttgcccaatttttggatctttgtagtatataatagtaaggaagaagttaaggatggataaatgagtggaagtagagcataggttggaagaggtgattgagaaagtaggctttgcaaaaatatagatgggtcttgcggcagatttattcaaatgttggtttgatatggtcttggaagatgaaagagtaaagataaaagagctcattattactgttttcaatgatagctacacaagtttttggtaagtatgatagtattttgacttcagaatatgattgactgaaagtcacctgtagcacaataaataaaagtctgaaaatgattattcagtaatactgaaaaaacactaaagctttcagatttcgaaatgaaaaaatcatgtttttagtctacttaaaatacaattttaatagaatgtggcatagtcaatgataatcagttctttagtagttaaattt

SEQ ID NO: 67010 - DNA, 1027 bp, Homo sapiens
agggaaataagatgtgtccattcatatgagtggttttggtcatatatatacacatatattttaattacaagtgtgggtcccctttcagaactaaccaataaatagattccatgttttcttgtttatcacacatacaagtatctttccctatatatttgtaccacttttgagagccagttttgattatatattcctacatttagtgagttggtgggtgaggaatattttctaagtttctttttctgaacagacatttcatacatgtatcatggcagtgtggtaaacttcccaactggaagaattgtaactcggcaaaatattttagggatattacctatttttatacatatctcttctagataactacatttcgcacaacattattagattttcagaatctgcttctgtattgttagtatattatatataatgctaacctattaatctaatatagtttcccttatttagagagatcagtgcttcgactgagaatacatataaccaaggatttcagataccaagaaagcattatatgtctgcttagtaaatatatcttttagatttaactaatgtagcatggaatccagaggaaatggaatttcctaacaccagatgtatctgtaaccaagattaaagaaaggtctttttgccaccttctaacaaatatcagttaaaatgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatga

SEQ ID NO: 67011 - DNA, 1050 bp, Homo sapiens
aacatctccaggtgattctaatgtacagccaggattgagaaatttttgaagaacaggtaactccatcttgaaagatgggtggaattaggacatgtggagattgccggaggtaactttaggtgaaggaaataacataagcaaagattaacctactgatggcaaggatttgccattcttttccacaaatgaagccttttttttctgttatgtttacctgaaaggtaattggaaaaatgatgccttaaagttcactaatttgtgagaatcataggcaaaagctttcctgtgatattagagaagagtaagatattgttcttgataacatcctgcaactcatcatttatagcataataagcccttccactctgattctgttagacaggcccatccatggcaagatattaaacaaaacaggatttattgaaaacatgtctgataatagcaatgatattgaaaaagagcaaaacagtacaatcctggtttttatgtttctgctttgaccacaggcttaaaatgtgtatttcaagcctataaatattgattgtgagacacaagaaacataatataaatattttgaaggaatagtaattaagagcagtgagtcacaggtagctaccagatgaaaataataaacccaactttgtcagggcttcagatcagagtaaggtttcaattttgatatccacggagaagagccaaattgaagatgaatatgagtaaatattgatgatccatactactgaatttgtctggtgataaatgtttcttaggtattgcacatattccgaactcataaatacatatactacataaaaacatggaaaaaacccttcagaaatgttttcctgtattatattttcagaaagtcacaagttttagagaaatcatataagcagaatggcagacagcatgggccatatttccatgtcaaaagtaaattgaaaatctaaattagtacctgaggttaaaaatacttatgtccacagattccagaatacaaaggaaaagtaatgccagccaaatctgaaacataaacaactataagttttc

SEQ ID NO: 67012 - DNA, 1029 bp, Homo sapiens
aacaattccattggacatgtaattggaaaaagtattgtactacaagttaccccaagaaacatactttttcaaagaatatatactagtaagtcactttcaagtatgagtcaacgaaatattaccaattgtataactataaaatatgaatccgctaataaggatctacaaataagatcaaaccaacacattttggccattagataaggtattcagctactttgtgtgattataaatccacaaatcttataaaccatgtaaagatgttacataacatcaagaaaacatcttaaaaacctaaaataacaaagtttattatggttttgctcttccagagtgactaatagaaatgaatcatgggcatattaaagtcaagcctatcagtttctgccttggtattttatactagttcaacctctgatatattatggattaaggttacgaaaatgttaagtgggggcatttacttttagtaatccttattctctctctctgtctttattcctgtatcagaacctcatgccacaaaaatctgctgtaagactctcccagataaattgtactatgtacattttaaatacctaatgtaaaattattaattcaaaagaacctctcttgattgtaaggacctgcataggagtggaaagtaacctttttggaggaacatggggttgtgggtgggatggagatagctctcctggtgctcctaaaatcaaatctagtgtctggccccacaagactctgccacgtagtgatgactatatagcagtgatgcttctgggatctctcagtcagccatctggagatctcctttgcgacggtaaattatttaacgttcttggtctgtagtgataacatggatacattgggaagtaaaaacaaaataataatatatagcatttttgatgatgtggcattatacttttaaattttggattataaactgttttttttttaatgaactattactgctactttagggctcattttaaataaggttcaggaccaaatggggctgatgttgtccttatg

SEQ ID NO: 67013 - DNA, 1348 bp, Homo sapiens
aaaaaaaagtgctcaggagaagtaaatacatgtttttgtttaattgttcaattttattaatgtttcttttgtgtttaatttttttttggtggtatatttagttccatcaaccaaaatatttagatttttcatccagcctgtgatagacatattcaagtatgcgaacctgtttgaattttgcttacacctgctatttaaagcaaaacttcggaaggaagtcgttttacaaaaagagcagatggaacagtatcctcctccttggactctttgagtcgtccatttatataatattttaagaagttaggtaaatgtaatgactcttctacagtctggattgcttatattttctgcccaattctctgtcaaatgagaagaaatgtttgtcaacaagtaggctactgttgccaaaaatgcactactaggagatggaaatgacataattatggcccttaaacatcacttcaggacaggatctgaagatctagaattatgtgctgttagctcagagtacctcataacattgagggctagagtcatttaggaggtagggcagtgggaaatatcttggaaggcgggaaatttgctggggctgttgtagggaaatgagaaagagtaaacattcttataaatagtgagaaatcacttccagagcaggctttatttgaggcttattaaacagttcttcatttaatctagtagctctcaagcttcattgaacacaagacatacctgaggaaaattgttagaatgcagattcctgggtctcatcctcagaggatctggttggatagttccagggaggggcccaaactacattttgaacaaaactccaggtaattgctcagcatgctgaaggtatgtctagaggtgactgaattccagaccttgaggactactgagcagtgagctctatgggctgatttttgggaagaatgatcctgaaagtcgcttcctttgggattaatgtatcccagacaactattacctttactgggttagggataaaggtggtgaattggtgctgttatccccacatcctatggctgtatcttttgtggtcgaaataatcttactggttgtatggtagaaggtatttgaggtttcaccatttgtagctttaattatctgtggactctgcccgtttttcccgaggatgttttgttaactgcttatgtttatgttcagtagttcgcatgtcattactataagtatcttgtgacccctttttccaaaacagagaaacagatatttgaaaaggttggggattgtagaaaaaaagaagggtggttgtgagggtgaatttgacattatcaccagcatttgtgtttttcagagtgagattgacaca

SEQ ID NO: 67014 - DNA, 1035 bp, Homo sapiens
tagcaggtcatgatgatgcacgcctgtaatcccagctacttgggaggctgaggctcgagaatcgcttgaacccgggaggcggaagttgtgatgagctgagatcacaccactgcactccagaccctgggtgacagcgagactctgtctccaaaacaaaacaaacaaaaaccctcaagaccttaagacctgattgaagatgtataaatcatttattacattctttattttaaaataatataatagttgggaatacatattaagcaacagctggggatttcacatcaagggtgaacttagcgacttatttatttggattttattcttaaatgagagttgcttagttaccctatcactgcgacatcaattttgggtttgctggtgtcagcctgtcagtgaagatacaccactagagtcatataagggcaaggcttctctaggtttcttgacagagaacattgcaagtggctttgaagacctcagaagctttagagagcagaatgtcaggaaaaaaaagtaacagaattggaggagtggcaaataaggagaggagagctactgacctgtggagttgttcaagaaacagagactagtgaagaggaaaaaatgaaggtggaagcttagattcaagtgacaaaaaagcataaattattattttggggaaggaaattatcttaatacatgtcaaggaaagaatgaaaaggcataaaatactttagcttctgttgatattaaataaaatgagctctctgacatgtataaaccttgaaaaaaaaccttagaaagtatgtgtgtaactaacatgtagacaatgaaaaatgtaaaaaatatattcgtaaggtaggctattggacaaatttaggtagtttaattaaagctttttaaatttggggcttaatttggctaacaaagttatagaaacagattcattaccattataaaattatataaagtatatttcagttgtttaatgttttcacatttgttgaaaatagatactataatctgaaatcagaatttaatggcaatctattgcct

SEQ ID NO: 67015 - DNA, 1068 bp, Homo sapiens
tttatgcttgaacattgtcatggagaagaacttgttatattttatagcagaataaacagaaatagtttcatttctgttttcattatttatacatgcttgtgtttgtgcttttctctttctttaaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaatttgtttttatttctggatttttaaatagtatctttgaattttggtggttctaaaagtaattcttccaaataacatattttagggttgtttggggtttgcatgaaagttaaaatttatagccaaatcattggttttgagttgtactgattgtcgtaaaatcttaagtaatgagagtttttatttatttatctttttgttttgtttttatttattaagacagagtctggcttt

SEQ ID NO: 67016 - DNA, 2623 bp, Homo sapiens
gccctagaaagaatccattcctttgccttttctagctgttagaagccacctgcattcatggcttatggccccttccttcatcttcaaagccaagagtgtagtatcttccatctttctctgactctgaccttcctatctctcttattagtgtccttatgattacattgggcctatctggataacccaggaaaatcccctcatttcaagatccttaataatatctgcaaagtcccttttgtcacctaaggcagtatattcatggcgaattgaggactagggcatttcttcatgtttctcatgagactcagagatgttaattaacttgtctgaggtaacacacttataagaatcagagttgcaattggagccttgtctatctcctttactttgttttttcctaatagtcaaggtcataacatgattattatatttaaaaatgtggaaatatagaaaaattaaagccacaaatggtatcccatttctccatatttaatgttatatactatttcgtgaacagatttttacgtgtgctttttaaataacatgaaaaactttttataagccctaattttagttgccttataatatttcaaggtgaccactctccactatatcatactgtgcccttctacattgtgcctttttaaaaaggacacaatacacaatttgtatggttaagtaggaccatgtgattcactgcccaaataagtaagtacagactatatgagggaattagagaggagaaatgttgctataaatgacccacttggataatttctagtggcaaagtttgggctttgaagcaaaacttgcaaggacacaaaatctacttaattgatagagaaaacaagaatttgtggcttttcctagtcatgaaatagtttaaagtgtgtgtgtgtgtgtgtgtgtgtgtgtgtgtgtgtgtgtgtgtggtggggggggtgtgtgtagagagagaaagagagagggagggaaggaaagagtaaggaagggagagaaaaagacagtagggatttaatcctggagatattttgaaataaggctggtaaactaagtgttgctgtatccacttcaccagctcgtaaaaaattatgattgtttttgtataatttatctttgataaatatataactgtaaagattcaaggagagctctaagtatgtgcaaggtccctcttgctgttctccattgtgagtggaatacaagaaggcatatacttattctctatttgtgtagtctaagggaaattattctttgcatttgtatttttaaaagtataatttcccccgttggttttccccaaggacagcaaaatagttggttttgattataattcatagataatgatgaactatctggctgaaaggctaccaaaatgagatattttactcagaaagttaggtcattgtttaaatatctctagaactggaaattcattttatacatttgtcttgaggaatgcttaagattactgtccttccagagaagaggggagggattaaacataactttctggtttcatactgtattccatttgtgatttgtctgtttatttaggtacccagagggttaccttacttctctgtggattttggccttcacggagggtttgcccatgtcattgaagatcagcacaaattccctcattactttggaaaggtaggcttacaaatttgataaaatcccagagttagcaatttggtaacatttttcttttgaaaggaaataaaaactttgggcacagtatacaaagaaattggtgagtactgctccacccagtttttagagagggaatacctagcaactattaataaaaatatcccagaatgtatataacagagccaggaatgttactttggaaccaaacatttcttgacggtgtcaacaattactataatggttgtttttggaggaagccaggcttgtgttgagaatgatgataattgttaaaacttattaagggcttacagtgtgccagctactgttctaagcattcatttaatgctcacaataatcctattgtgtggatattattataaatttcactttacagatgaagaaactgagctacagagagattaggtaacttgcccagggtaatgcgctaataagtggtagaactaggagtacatatagtcatggttgaactagagaaccaattttctcatcttcatttataattaagcaaggcgtagcccaagaagaacacatgactcattttacgctgatagtttctgggcagatattagcatacagatcttttgattcactaccacagattgccttcttatattctgtggggtataatctttaaattaaagtctacagaatagtgtcaggaactggaataaagttaatgcagcaactgaaacagtcaaaagtagtctgggcaatgattgctctagaagtgagcctttaatctagtatagatcaggcctttccattcatatttatccctatgtagccaggccctctgaaaaagaggggccttggtgaactctgcttgggattccctgttctccaccctgctccccactttcatctcctgcagaggaacatcttctgcaatgagtagaaatatctgaagaggaatctcaactccagaggtttgattcaaaacttt

SEQ ID NO: 67017 - DNA, 1049 bp, Homo sapiens
atcaaagttaagttgctatctgcttgaaatagacttatgcttcctggacttttaaaaaataggctttattttctagagcacattttttttcctgtatttttacttcttcattatatgagcagaaatagttcaagaccttggttgctagaaaacatgtaaattactctgttgccttttggaagaagagcagtaaaactaaatgaatttatttagtaatctctatgaatgcagtgctataaatggaactttatgatcacaaattatgtttcatattaaattgattggtcttattaaggattgccatgtaaagttgagctcaagttagtataacagttaagaatgagtaaaagaatattatctttggctaatggtaagatttcaaaaatttaagaagttcttattttaaataactaaaagccttaatcagttcagaataatggcttactatgtataatataccccataattaatttgctatattacttgttataagctgtttctttttatttacttacatgttcttttttcacttaacaaatggatatttcttagaaagccataatggaatctgatgaagagtggtccatgaacaagaagttgatagatctctcttcaaaagatatcagaaagtctgtaagtatgttttttcctggtaaaagaaattaccctagtgctcaggatctttattaatttccatgtcttagttgacaaagggaccatttggttgagtgactgaaggcgaaattactagttcgacaaatgaagttatttttatcctacctggtctagaaaatgcttatttgtttgtagagggtttttatttgttcacatgaatgtttcttcctgacctttggccttctgccactgtagtccctataattggctatggcagctattagagtctgccgtgagaactgctgtggtgagcttctcagcccctgtgggacaaatggtgagaagggccttcctgaaatatattgttctgcaattatactgagagaaaaattttcctagatgttccattttgaatttggaactcattttctttt

SEQ ID NO: 67018 - DNA, 1432 bp, Homo sapiens
gaattggtcttctctgctgctgtgtttttgtggtgattttgttactagctttaatttctgctctttttccttcataatctggcccagcttttggattcagggatttgtttttgtggctgatgctttaagagagtgaaaggcacaacatgggtgaaattgttgctgaattatttcaagacctaataatgaccaggaaagaaaggaagaaaactctttatttttttaatgccagacaactgaataggggctacagggagccttaattagaaaatgtgaaaattgtaagttagcactgcacaagagatgactagtctttgcagcatgctgataagtatgtcaaaagaagagatgttttgatggcatttaatgaaatttagtcttgtataccttgtaattttaaagtttttgctgtcaaagtttaaagggtagattgttttattgcatctgcaaccaagcaaaagtaagaatatgtctttttgatgtgaaagtttgcgttttcctagtagtggatgccagtgccagtaggtaatttaaggtggaaagtatggaaattcagttcttagaattattttagaacatttccaggaagccttttaaaaatttatacatataaaactgatttaatttagagcaaaatgcagtgccaaaaatattttaagtaattataggaatacaatgtgtatatgttttatatttctataagaaatcaagctgcttaatgaaaacagtttaagtggatgaagatttttattcaatttaacagatattgagtacacaaatataatattttaggtgctgtaagaaatgaagagatcaagtaattcattaattctgccaaaatatgtggtgtatttctagtatagtttacattatagtttagcagagtttggaaaccaagtgtactatggaaaactgcgaaagagaggaaaagccaaattgttttatgcaaataatggtgttgtagctccttttgtgtgagaaaggaaaataattgttagaagttatcaattattgtaggctagtgaactaatgaaatatttgaatcctagcttgatgaggtacagtttgctgttgctgttgttgttgttgttattttactttcaaatatgtacaactcaaattaattctaccctagtgagtatctttgattattcacctcttttattggatatattaaaaaaagatttgacttagcacaaaatgttgttgccaaatgttgcaatgcaggagccacttctttcaagtggttttaaaaatcaccagtatctagtaatatttaaatgtaattttagacttcctatttaatagaaaatgcgaagatgttttagcatagcatacttgagtaatcacagatttcaaataagatccaaattgctggttttgtttaatatgtaatgaaacttggttccctctaaatttattgttatcattt

SEQ ID NO: 67019 - DNA, 1040 bp, Homo sapiens
aaaatgaggaaataaggcatagagagagcacagagaaattaaataatatgttcaaggttatacacacaggagatagaactttaccatggtcattttgactgtggaatctaagctttaaaccattatgactttatgtatgtatgatttagttggctttcaagttcaagagtttgaacttcattctgtacacagtatagaactctcataactacctaaggaggtacataaaataagaaaataaaatttgtgtttttgtattttgaaagcatcaatctgtccatagttcatgttgggagagatatggagaaggtacctggagatgtggttaaaaaaaaaaaaaaagttccacattctatatagtgtatatgtgaatttttaaagttacaatttaaacctctctgtgattcagtttcctcatctattagttgaaaatgaaaatgctaatggtccccaccacataggagtataaaacatgaacaagtcatatagaattgtatatagtaaatattcagtaaactttagctgtggtgatgatgatgatagattgactctagaagatcaaacaaatattaatcatgttttttcttttcttttaaatgtattagttttatcatagaacttacagatacagatttaggataccacagtgcagtaaaatcttaatcactaccttctactctctattactgttattttggtttttcagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtaagaagtatttattatcctttgcttacattctcatagaactttttttgtttcttcatagaataacttgaataagtttattattttgtctgttttacttgtttattgggtctttccccta

SEQ ID NO: 67020 - DNA, 1058 bp, Homo sapiens
taaatatgcaaagcaatgccagttcctacctatgtgcagtggggccaatggaagtacaggttgctatggaaatgctgatttcacattgggatttttagttcatcctgcctgataattacagcagagtagcaatttgttttgtatgtttaatgattaaaatcagctctgctaaaaatttgaggcgttactaaaagcctataaaaaaaagaaagtatttgaagtgttggccatttctaagaatactgtgcctaatcctttcactcttaaaagtttatgaactaaagtagctaagttattgaatttttgatagtaatattgctggtatatagtttagttatgtcaaatagtttcatgaatgactccaaaagctcattatcctatgtttctttttattattagttaaaaatgattagtctagtttaaagtcattagaggttggcaaactttttatgtttctttttattattagtttaaagtcattagtttaaagtcattaaacagaggttggcaaacttttcttgtaaagggccagacagtaaatatttttagctttctgttgcaattaccagcactgctgttgtagcacaaaagcagccatacacagtatgtaaatgaatgggtttgactatattccaacaaaactttatttacaaaaacatatggatggcctgatgtggcttggaagttgtagtttttcaatccctggactaggatataaaatcttcaatgcaaatgtatttgaatttagatacaggttgaacatacctcatccaaaaattagaaatctgaaatgcattaaaattcaaaatttgttgggcaccaaaataatgacacatttgctttttgatggttcagaatacacaaactttgttgcatgtactatttaaaacgttgtataaaattaccttcaggctatatgtattaggtatgtatgaatcataaatgaatttcaaatttagacttaggtcccatccccaagatggaatgtatatgtaaacattttaaaatccaaaacaattcaaaatctgaaacacttctggttccaagcattttggata

SEQ ID NO: 67021 - DNA, 1025 bp, Homo sapiens
tttgctaatttagcaagtttgtctttagttgttttatttcttataatcagattttaataggatctttaaatttaaaaaacattacatctactgcataagtgatgggcacatggactattgatacttcgtcatcttttaatattgtctagatgaaaattttatttgaaattttcttctcttgattgcttttttaaaaatactaaaataaacattgggtattttttaccctttccccaaaagattatgttcattttatagtatagagagtaatgaaaatccaggagatttaaggcaatccacaacgttatgtggaaacgttaatcattttaatgctttttttgttattaaataaaaacattcaacattcttcacaataatttcaatagttatctctaaatctttttatagaatgaagaccagcaagaagtaatccttgtcagaacagatcagtctggaagagtatggcctgtgaacacacccggaaaatctctggaatcacaaggaggaagaagaaagagacagatggtatgtttaacatatgtctttgtttattaattcagaattccttcttccccttggggctttctttgtatcagattataaaatattttctgaaatgtggcttttgaatgccaatattggaaggtaggaaatgatgttgttactacttttattcttagttatatctctttgccttttacagaatggaaactaatccaactattttttcaaatagttgttaacattgaatgtttaaggcaattttaattttagtgtacatttctttgatgttgttttcagctgcttttggcatacttgctatagctcttagggaaaactttggtctctcagagctgttactagtgttagacagctaacttgagacctggtgatggggtatccatacacagtaatggcttaattatgtaggtgccatgatcctttataaaactaattttcttttccattttccaactctagtaattagtttttagcactaccttgaggctcttgagctggcaaaa

SEQ ID NO: 67022 - DNA, 1024 bp, Homo sapiens
tttggagaatgtaattaccttgtgtaaactaccaccgggcagtggtaatattttattttattttattttattttttattttattttatctatttttttgagatagtgtcttgctctgtcgcccaggctgcagggcagtggcatgatcttggctcactgcaacctctgcctcccacgttcaagcaattcttgtgcctcagcctcctgagtagctggtactacaggtgtgcgccaccatgcctggctaatttttgtatttttagtagaaatgggtttcaccatgttggccaggctggtctcaaactcctgacctcaaatgatccacccgcctcaacctccaaaagtgctgagattacagatgcgagttactgtgcccagctggcagtggtaatattttaatgtgagatgtgtctgtatatgtgtctgtgtgtttatgtgtatgcatgcttgttttaaaaaatttagttttctatatattctcttacattctatcagtgtgctctggtggaaaaaagcctcgggctgagaccaaggagtcttgcttttattctggactgtgctgcttactgattgcttctgtatgagtcaaactgcttcttaactgtctccttcagaatgagagacttgaattagttattcatttcatataaaacaaattactttggtctatgattaattcatctatctgttagtgaacaaaacaaataaaaacacctacctgcatggaactttcatttgggtagggagggaaacaataaattataaaaatgataagcaaattaaaaaataatacagtgtatcagaaagttaccctatggcagggtagtggcaattttgagtgacaggtgggttggtggcttggaatgcacaggccaattctgttgaaaaagtgtaaggactttatgtaaggacttgtagttaatggaagagtgaatttctgtgtatttgagtgaagagcgcagtagtcatagggaacagagatttaaaggcccaaagatggaaatatgtctgatgtgtaggaagaa

SEQ ID NO: 67023 - DNA, 1041 bp, Homo sapiens
tggcctggttcgaacgttttttgtttgtttcctttttaaagttacgagtatggggatattaaataagaagagttgataagtactatttatctcattgttattgggattttgatcagttattataactgccataggtggttgtggcattgtaacagagaactttatcaatttgtggaaaaatattgagtttaatttacatgtattacaatcatgatctgctattggtactgaatgctttgttgaggtcagttaaaataacatttgagtcttgatgttattgcttgcatcgcacctatatttcatatgctgttaatctttcctattccaatagcagtccagagcgtgagtccattcacatcctgagtgttgatgagaagaacaagttgggagccaagattatcaaagcagagatgatggggaatatggtaagactcttagatgttgctttagagaataatgattaaatgtttaacttcttatgagtaattttagaagttccttagcagtgtggatatagcacactgtgaaaataactgttggttattgattccttaaagaaattctcaggcctggcaccatgcctgtaatcccagcactttgggaggccaaggcaggcggatcacttgaggtcaggagttcgagaccagcctggccaaaatggtgaaaccctgtctctagtaaaaatacaaaaattagctgggtgtggtggcgcatgcctgtaattccagctatcggggtggctgaggcaggagaatcgcttgaacctgggaggcggagattgcagtgagccaagatcacgccattgcagcactccagcctgggtgacgaagcgagactgtgtctcaaaaaaaaaaaaaaaattctcgaacctttctgtgaagaatactatctacttctaaataaatgatctactttctctgtcagatctctgaaattgaagatactaaggaacttcatgcttttaaatttcttttttacttggctatttactttattcctgcatttgtaactcattgagcatatttaagggagataaagatg

SEQ ID NO: 67024 - DNA, 1291 bp, Homo sapiens
ggtaacaacttacacgtgaatgatcattaaaatatgtttaaaaatagcaccaaatgagtgggacactaaaggaagaggttttaggaaataatagaaacacatggttgtagtagataaaagcactgtggtttggggttgtgagtctgataaatcacttttgttaatgactccatctgaagcagtggattataaaactcagtgtgtaattttcggtgggagggagctggcaaaatctgaactgagtgattaagccccagtcaaatggactctggttcacatcagggctttcctcccaggaagtggaaggagaaatccaattgtattgactaaacaaacatggcagggattattgtctaaggctgtatgcatatgtaattgtccagtcttcactccaggtgccctgggtggtagactatttccagttcccagtcactaggggaatgaggctcttatttcctgatatcattaggattgggttagcatttggatgatctgtaggccttcttctgtgactgtagctaagcaaaatgtctgcaaagtaataccacacgattagtattccaaccggttgtctgattgctgcatatttgtatgtcttatttaagttgtaagcttctgatagatacactataatacaggcactcactaaaagctgtgtatgtatataatttttcggtttgaagacagcactcactaaaagctatatatgtgtgtatatatatgtatgtatacatgtaatttttcctttgaagacagtattctttgttcgctgtgttaatttgatggtacagagggtttgaggctttctatgaattctgtgactggctggagagggaaagaaaaatctaggaatcatccaaaaaaaaagattcctgagaatgtagagtggttgtaaagtaggagaccaagacaggaccttgaagaatgcctagttgttacaaataatctttgtcttataagtgaatggtcatgattggaaaaattagttgaattagtttttacttctttgtatgtattgttcatatatctttacctttcttgttatttacaccagtattattttttagaacatgccatttgtaatcttaataaatgtatatgtataaaatttaaacaatatagacagaagagtataaaacaagaatatgaagcataggtgagtataaaatgaaaaagtaaatctccctttcatgtcacttccaaccctaatcctatttgccaggttaacagtgttggtagtgtctttccaaattttttagtgtatttgaaaatgtgtaatatatatatttaa

SEQ ID NO: 67025 - DNA, 1968 bp, Homo sapiens
tatccatatacaggctcacacttattcactccttccctgatctagtccttgtaaaggtttttttttttttccttgagttttgagattcaggtattagggtttttttctgtgtttttcttctttctcccccacccaaggctattggatgagtccttctgagaaatcggctggggaaattttcttatatatttttaaaattaatgctctattcccatcatctttgctccatctttctggaagtactaataaatgcatattagattttctagaatcaattgttcatgtatctttttttcttataacttacatttatttactaccttttcctaaaatatagagaattcccaggttaatttagttttcagcactgtcttttcttccttttggtgtatcttggcagctttttgggacacacaattttttatttccaagtctttcttgttcttgaactattctgtttttttttttttttttggtgagaatctgttttagcaatttaacctcttgaatctcacaaccagtaggaattaagtattttttgcaaagtttgtctctactgttttctgtgttatactttgtgttagtgcagagtgtttggtgtaactggctatccttttggaatctttttgttatttaataatttttaattgtttacacatttttagaaagtattcgtttccgtataggatgattgtatgggtcttctttcaccccgttagtgggcttttcagtgtgccacttggcagtgagtcatacagtgacatgtggggtgcaagtcactgagccgttcctaattttagatatcttgtttaatttttctcctttgtagtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctgggtattttatcattttttaacctaataagttaagatccagagagttcaaagaacagaactgtatttttagaacatcagttattagctgtgactatgatctcacatttcttaaaattgatagaaggggtaagatatgcagatttaacaggcagtattgtggtatggattgcattttatttcataggtttttttttttttaagagctgaaagcagtagctatatttgttcaaaatatgttgctgctttgcaatttaaaaaactgaatgagttaatgttttaaatgtatgtgctgcaggagatattttggtagattttgttaccaatgccattactttctaaggaaattatcttattgttgagtataatcataatcataaatactgcatgtctataggaagtctaggagacaaaaggaaaacacgctgccacggcccaaatataaagtgacaaatacatgccagagatcttgcagaggggagcatgaatt

SEQ ID NO: 67026 - DNA, 1051 bp, Homo sapiens
tatttgtacaattttagagtttatatggcacagttatatatcagcttttttcttggcaaccatgtaaaggacagcagtgtagatagtattttaatattatagctcaataaaccaaggcttagagtggccaggtaatttttctggtagtcgtgttagtagtactagaacccaggtcttctgattcctagtccagcattagttactctagattctttagtggaagactatttttattaccatgtagttagtaggaattcttgcttacagactcctttgatgtgattttgttcttcctattgatttcttccccctttttattttttggctttttctgctagaatgtgagttgaaaagactttgaaaggtggtttaaattggctgccttatcttagagatgaaggagcaaaggtccaaagaagttaatgacatacataagattttacatatatttaatagtagcagcaagactaaaatctaggtttcctgatagtttatcactatttttatgttagtctgttttctgagagagttgggtaatatagcccagattcatttggttgtattaatatttggtctataacagtgtaactttgagttatgatggaagcatatgatggaagtttcttcattttttacttataaataacagatttgaaatctaggtgtatgttaagtgccacatatcagtgaatttatataattatttgatatatctttttctcagcatagaggacctgaaccatgctacattcatgtttgtacttcctattgtacattcatgggtttgttttttttttttttgggtcggggggcgtgtggagtctcgctctgtcacaaggctggagtgcagtggtgcaatctcggctcactgcagcctctgcctcctgggttcaagcgattctcctgcctcagcctcccgagtagctgggactacaggtgcatgccaccacacccagctaatttttgtatttttagtagagacagggtttcaccatgttggccaggctggtcttgatctcttgacctcctgatctgcccaccttggcctccc

SEQ ID NO: 67027 - DNA, 2467 bp, Homo sapiens
ctttaaaaaaatttttttttttgagacggagtctctgtggcccaggttggagtgcagtggtgtgatcttagctcactgcaacctctgcctcctgggtacaagcgattctcctgccttagcctcctgagcagctgggattacaggcatgcgccaccacgcttggctaacttttttgtatttttagtagagatggtgtttcaccatgtttgccaggctggtcttgtactcctgacctcaagtaatatgcctgcctcagcctcccaaagtgctgagattacaggtgtgagccaccacacccagctctttaaaatttcattgccattttgtaaaggggaaatacagtgtaagaatttttttctacgatgttgaatttctaccacttaacagcacagaatttttatatcaaagtatgcaaatttgacaatttcacttatatgctaaatgttcttagagctctgaagatgagtgggttgaggctgttccatcccagactcctgacaaggaaaaagcctggaaagtgaaagatgaaaagtcaggaaaagatgacacccaaattatcaaggtaagcaagccacttgattttccttccttgctttcttccttccttccttccttcctccctccctccctccttccctctctatccctccctccctctctgtccctctctccctccctccccctccctccctccctccctccctcccttccttccttccttccttccttccttccttccttccttccttccttccttccttcctttctttctttctctttctctctctctctctctttctctctttcattcattttagagacagggtctcactctgttgcccaggctgggccgcagtggcacaatcagagctctctgcaccctcgacctcccaagctcgagtaatcctcccacctcgacctccctggtagctgggaccacagttgtgtgcccaccacgcctggctaatttttttattttgtgtagagttggggtctccctatgttgcctagactgggtctcaaactcctgagcttgagcaatccttccacctcagcctcccaaagtgctagaattagagacgtgagccactgcacctggcctatcacttggttttaaagaaaaaagtatcaacttttgagaataaatgaatatgaaaatgaaagatgattaaaatttcttcaggagaacaattagactttgaaaacaatatactttaggaataattttggcagtactgctgtttgctgaatgtttagaacccccttccccttctactgtgagaaagtgagtgttcctctctattctcgttccttagaggctttcatgcttttgattgttgataagaagtggcactttccccttatgtccctaaagccttatactgtatctctgtctgacccttctatagtgagtggagttccatcacagttttttttcccttcacctcatgccttaattttcttaacaatacttaacagttgaatagttcaaaaattttgggctatagttcatctgcctcaggaagaatgtaatttgtccactgttagccacaggtgaaggaagaaaggtgaacaggaactaagtttgattgcttgttgtgtgccaggctttgggctggatgctttagatctgttatcttgtttactctttaaaacaatcctgaaaggtagggattttataccattttatagaggagagactaaagtatagagagatttagaagcttgcttcaagttatatagccatgtaggacttgtttcaggtttgattgcctccaaagtccctgctcttattaccaagtgtttattaaattctaatcagttcagattgaaatgatgagtggatgactgttgattttatgtctttttttttaacagagggatgagtggatgactgttgattttatgtctgttaaaactgtgtcatcatcatcactcaaagctgaaaaggaaactatgaggaaaatagagcaagagaaaaaccaagcgcttgaacaggtaagagaatatttgaaatgctttaactttctaatttacctttaataaacttacaagacatttatataaatgcagtttaacttgtaaaataccattttattttttatagtatttaatacaattagtgagaacaactatgaaatacatcagtttaagaaaaataaatttcctataggaagtgagtttaaaggtttactagatttataaatctagggcatatataaagttgagtgaatattgagtttaatatcattaaattgaaagtgaactcactcaatttttgtttcagtgtacatactgaattagacaccatgaaaatacttccatttcaagacatctagaaattctggtggatataatgtaaaataagcatgcttattttatactttattgttgtcactttgctagtaaggaagcaataggaaatctgtagagaccaaaaaatgaggcaaaagcatgaatccagaga

SEQ ID NO: 67028 - DNA, 1693 bp, Homo sapiens
ttttttaaggcggagttttgctcttgtcccccaggctggagtgcaatggcacgatcttggctcaccacaacccccgcctcccgggttcaagatactctccttcctcagcctctcaagtaggtgggagtacaggcatgcgccaccacatctggctaatttttgtatttttagtagagatggggtttcaccatcttggccaggctggtctcgaactcctgacctcatgatccacccgcctcggcctcccaaagtgttgggattacaggcgtgagccaccgcgcccagcctggggtgctactttaaggatcaaagaagagaatattagttggtattttggttgcaggtaacagaaactaaatataaattggattttgcaaaaaggatttattattaaagtacaaaattctcataagacatatagatgtaggaatgcagctaggcttcaagaatagctggaattagaattgtgaatggtttttgcaattttcttgccatttttcatttcccctaccctgagttctagtttttaaaaaatttttgctgatttctatttctcatgacagaaatggcctctcccaatgccttcccatttcttagttttagataagcccatttagacctgatttcagattcctgtggaatggctcaggttgatgtgaattgggtcaggtacctacgtttgaactaatcagtagtggccagggatagaggtaggctcgtatggtaatcatgtattcactctatggtatatttaataaatattttaaaaatgaaaatggtaggcttgaatatgtgaggtaacatcatcctgagtttctgacttggtttaagtgggtggttggttgttccagataactcagttcaatactatacaaggagaagtagattttgtagaagaagaggatagctttatcttctgttcttactgagtttagcatgccatccaactgcagtagacaattagtcagtgaaactttggttagacaaatttgaaagatatcagcacaatttattgtagttcaggcgatcagaatggatttaatggcccaaagggaatgtttagacattgaaaaatgtcatgggcaaagaatggaatcccaaataacaagatatttaagggctaagcaaaggaggaagagttcatgaaggaaatggagaagaaacagagtgggaggagagctgagaggtgtcatggaagccaggaaagtgagttatcaacagagttgcattaagcagagaggtctagagagctgaagactgaaacgttttgttgagttcggcacagtggaagccactggtgagtttggagaagtttcagtagattaatggggacagtagatgtattgtagagttttgagaaaatgtatgaaagtgagagtgtgaaggcggtgcatgtagactactctttcaagaagttcatctgagaatggaagccggaagattaattcctgctagaggaggaatatacggggtcaaggaaggtcccccttccctccttaaaaaaaaaaaaaaaagggtgggaaatgcttgaaattgtttctaggccattagggatctttggttaatgccgtgagaggagaagataattgatggagcaaggtcctggaggaacagaaagagttatcaaaatctttagagcaagatctgccttaaataggaggagttaactggaaataaggataggcacagccat

SEQ ID NO: 67029 - DNA, 2978 bp, Homo sapiens
caccctgttctttggagtccatcataagccctgctcttttctctgatatcgatttttctgtttggtatataaccattgtattcatcttcttgcctacaccaagaattattatatgcacccagggaaaagctagctgcagaatgttggactacctctccatgattttcccttttctggaatattaactcttctagttcttgttgcttcagcagttctctgatataaacctttaataaattatttttatatttgattaaaaaaaaaaagaaaatgactacagccaggttttaaaggggaagagtgggcgattagtcttgggtaggtgaaatgttggtattgtttcgtaatttcaacatatgtaatgtgtgtgtgtgggtatatatatattattcattcttttctctttggtatttccagcagtttttggagggagtaagtttcgtaagttgagataaatcttatagtagagatatgcatagaatttgaaaaggaccaaactgagctttggagttacagggaaagaaagagggcaggaacgatttcctaggaaaaacttgctttgtttgactatcattgaagaatggataaaaattaccaatatgatcctttctttatacagagatgattcttcctgaggcatttttggggctgggtattggggctacaggcattgcatattgaaggcgtggaggtctaactgttgcaaaagtcttaaggcagtagccatgggaatggtgaagggaaaagggattccaagtcatattgagctagggagcttagagagatgggagggcctggactcagtccctggattctctctgattggtaactcaaatcactggagattggaaatgcagaaggagagatttttgctttgttttgtttatttatttatttttttatttttttacactggagaagcaaatccctggcaaggaatagacattcattcatgagtggatatttttgtataaaaatgacagaggtttttgttttcctttttttgtgaaacccagttgggtcaattgccagtttgtcttttttttttctttggttgtaggctaaagccaattttgaaaaagaagaaaggcgtaaagaacttaagcgacttcggggtgaggatacatggatgctacctgatgtgaatgagagaattgaacagttctcacaggtgaatactaacaggtttacgtgatgtaaggatatctgtccttttttgcacgtattcaagttaatattggatgaataattttatagaatgttttcataagttacaaaatgaatatcacatagttggcattgctgaatagtttcatctctttggcagaggtaagatattgtaatattttggacattatgactcaagttttgttatttgagtttggctagtagaagacagcttcaaatttctggcccactatagcaagcttataggcctaaaaatttatgcattttaagctttatgtatttattttattttatttttttaggtctcaagcctgttttcctataatttttttaaaaattatttttaattgacaaataataattgtgtaaatttatgggttagagtgtgatggtttgatctatgtatacattatagaaagattcagtcaagctaatgaacatatccatcacctcatcaacttatttttttgtggtgagaacgttaaaagtctgttcttcaatggctttgaaatagataataccttattattaaatgtggtcatcagtaatagatcactaaaacttatttctagtgtcatgaaaactttgtaccctttgatcaacatcttccctttccctatccttgctccttcccctagcctcttcctataattttaatttgtgctatcttgttatattttttatggcctaatagtcttgtataaatttttggggagaccatagagggatattatatgtatgtgtgtttgtgtgtgtatagatgcatgtatacatgtttgtgtatatatgtgtttatttgattatatttgtcacattaatctacaaataaagccaaaattttcccagtatttttctggtaagaagtctcagttatatgatttattgatagtgcatatattatagaaggtgtgttaagatttcctgaaagattttatttatttagacatattcttggtcttatttcatcagagattgaaagttttttagaatgtggtttattttttttctctcagaatacatccttttaaattaagatgaaattaaattattttcttgcctgttcaaaatgattgtaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcagtaagtatgtactaaaattaatcaaagcagctatttgagaacattttatttgaatgtgtaacttatgggaagttaaaatacaagaaaacgtaaaaaatatattactagttatgatatgaaaatatctgggatacatctacttagagatgtccagaaaatattggaaatgttgatcttgaatttcagagaaaggctaagaggatagggatatgatttgggaattattgctaagcacagcactggatcttgcccaaggcctgctgtaacaattacctggctacagctggtgttcactcaaggccctggggctctgcaatcagcaggtgatgaagccagccaggcctgcgtctttcccttcagggtggcaagttcccccaggcctgagggtgggtccagaggtgccatcagggacccaggtactggcgtcaaaaaccttagacttgtacctggtgttctattgaactgtggctgagctggcattcaacctatgaatggcagtccttcccactcttcccttttcacaggcagaggggcctcaccctgtagccaccaccatagacccacaggtagtactggcaggctaccactgat

SEQ ID NO: 67030 - DNA, 1018 bp, Homo sapiens
cgtgctcctccttcctcgggtccggaagtcccggtttgtttgttaaattacgaccgtcgtaaactagaattttcttgcggcttcttagctttacgatggcaacaagtatggcggctgctagtggtagatttgaaagtgcgaagagtatcgaagagcggaaagaacagacccggaatgccagggccgaggtgttgcgccaggtacctctgttttggggcttttgtagttatttattgttgtgggagttgagggttcccgtaagctagcccactcaccccttcccttacctcgtcagtactgaatctcaccttaatttgggtgagttctccctttgcaatgccggtaaacccttttgtagctaccgattttttagatgttctggcaggtgccagttgctaattctcttttcaggcagatctgtcgctttttctccaagtttctttaccttttaagttacccattctttacatttctatcactcggactgcacactttgtaggtcccctgcggcttgtaaggactctgccagcatgtctcgcagcctcagtcattgctactgctgtatctgaaatgagattttcctttttcggaaacacattcaagtcacacttgaatagactcagtttgacatttcctcctcctgtctctattggtatcaattccagacttactgtaagctcttaccaatccaaacaaaagttaacaccaatctcagtatatttagcctgtcacaaaagatcgcgaaacattgtatttctcactaaacttcagatacatagaggtaacatacaaagaatggagaaagtaagcttctgaattatctgacaatctattcaatatgtaagaagtgtggcaatgaaagagaaaagttgcagttggagagcaacagagaattcagtgagggtttttgtttttatttaagttggaagagttttaaacaagtttaaatgcaaatgagaaggagccagcagagaagagggagaggagactctaaagggaaaatgacatagtttcaaaa

SEQ ID NO: 67031 - DNA, 1026 bp, Homo sapiens
tggtccgtttttacagagtgctgattggtgcatttacaaacctttagctagacacagagtgctgattggtgtgtttaaaatcttttagctagacagaaaagttctccaagtccccacccgacccagaagcccaaccatcttcacctctcactttggctgtaataaaccgcagacaggagcgtgaatatatgctgagtcctgtgggtcctcctggtgaatcattgaacctagagatggtcttgggaacttgcatcacgctaaagttgtacgtgggagaaatttgtaacagtaaatgcctgtattagaaaagaagaaagttctcaaatctaagggcctcaacttcttttcaaataaactagaaaaagaaaagcaaatgaaatgcatagtaagccgaagaaaggaaacaaagctcagagcaggaatcaatgaaacagaaaacagaaaagcaatagagaaaaccattgaaacgaaaagcatactcttggagaattctgataaaatcaataaacttctagcctcactgagttgaccagggagggaattttatactttttatagctgatgaattcaatcaagaaagcataatttagattcgtatgtacccacttttcaaaactattatttggttgaaaaggtttttcaactaacacattttttgggggaaaaatatttgcagtaggattactttatatgacaattcattttaagtacacgagatttctctaatacatctattgaataaaataagacactatttatatattaaagaaataagggccaggtgaggtggcttacacctgtaatcccaacaatttgggaggctgaggaggaaggattgcttgaggccaggagttcaagatcagtctgggcaacatagtgagacccccatgtctacaaaaaattaaaacgttagctgggagtggtggtgcacgcctgtactcccagctacttgggaggctgaggcaggagggtcacttgagccctggagtttgaggctgcagtgagcaacgtttgcactactgcatt

SEQ ID NO: 67032 - DNA, 2015 bp, Homo sapiens
gaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcattgagcagggtgctaaaaacaacccaaatgtgctcctttaactcctttgtttaaatgacaaaagttagaatgtggtcactcagacctaactgtgcccttagagccaaagctgtggtgtcattattggttatttctagttgattcatagtttgtcccaatccaggttcaatcgggttatttttaagatctgtacaatattgcataatagtaacccagttaacttaccacttaggttagatttcctggaggaacaaaggtagaaattcaaccataggtcaaattatcacatagaaggaaaaggctttttttcaaagaaaaaattttttgaacactttactcccagtatgcattacttttgtagtagtaatgcttaagactgttttaaagaaaaattgctttctgtttaattaatgtttactgttattaatgctagtgatacttaatcttgaagcatcaagttttcagaaacctatagtgatcaataatgggtctcagatgagaggatgattatttttttcatggaatttcagtccaacatcctggtgtactggtccctctgggatgaatttataaggctcatgatataggaaaaggaatatagggctaaaaatagttttatttctgatataaatt

SEQ ID NO: 67033 - DNA, 1106 bp, Homo sapiens
atgtgtataagaatgttcacagaagctttatttgtaatagtcccaaactgtggacttgtaattaccatgtagttatttttaatttttaaaaatccagtccagtaatctttgttctttaattggagtttttaatacttttacgtttaatatattactgataatgaatttaaatttaccatctatttgtttcctcttggcatcatctgttcttttttgttttttttagaattggtgttaattaaatatttattttattttcccatggaataatttgttgtacattcttttaatattattgtcatgaagataatttccttaaatacctttatttctttgtttttccacaatgtctaacaattcagggaatccaatagatatttgtaataaattcttctagattttctctattcacttaacatttttaaaggcctgaaatatttttattaatacaatgttaagtaaatttttttgactattgtttttagaatcacgtgcagaaaatttgatactgttcaagcatctgagagtcttaaaagtggaattatcaccagtgatgttggagacttaactttaagcaagaggggactacgaacatcatttacatttaggaaagtgaggcaaacaccttgtaactgtagtaagtatatactcttatctcgtctgtaaaatggagtcagtttaatataaaagtcctttaaggtcctgtcaacacctaggagagctttttctgaatctctctaatggcatttcctgtattttgccttgtattgcactttcatgcacttttcttaacgaccctcattagagtttacattctttgaaggcaagggtctgcatcttctcatctttattttttccaaacttagtacttgagttgggtgcccaataaatgttttacttattgaagtaacagttaagagtgctacaattgaagggcaataaaatattacttgtttaaaaacgggtattgttgggaatggtttgtcaagtttctaaattatatcttattaatccaacagggaagttggagatgacaaattgttctatagtacataactctagggagataagcgacagtttatgttttagtcaatttgaaaactcag

SEQ ID NO: 67034 - DNA, 1167 bp, Homo sapiens
ataaaaaggaacaaaataatgacattcgcagcaacctggatggaactggagactattattctaagtgaaataactcaggaatggaaaaccaaacattgtatgttctcactcataagtgggagctaagctatgaggatgcaaaggcataagaatgatacattggactttggggactttggggaaaagttgcgggggtgaggggtaaaggactacacattgggtacagtgtacactgctcgggtgatgggtgcaccaaaaatctcagaaatcaccactaaagaacttatccatataaccaaacaccacctgttccccaaaaacctattgagaaaaaaaaaaaagatgaggaatggtcaatttgatacagaaaaagaaaaacatttagcttatttggttgtatatttttcctccttgaaacttggcttgtatatgccaggacaggtgtttcaaaattaactaatatcatgttcatatatctcttgtgagttctaatcacttgtttaagctgaaattttcctatttgaaaatcactactgtccgttgatgggagggaataagtttgaatttcacaaatacgtatgtattgtgcctttgtaaaacatgttcaatattagccaaaaagtgtaacttctaggtggatatagagcttgtctctcttcactcttgtagcctttgatatctcaccaaacgattaataaaatttgtctaacaaattagagtctagtcttctagaatattttcccatcatgacagttttcatctggatatctgggcatggatttcctttaagccacagataattgtctctaataataaatatgctcattattctttcgaggtgtgggccttggcttctattaacaaaactgaaacctatataaattggtttaaaaagaggccactgtggttttcccatttccccccaacaatttattatgaatttatttatttatttatttattttttggtgagacggtgtctcgctctgtttcccaggctggagtgtagtggcgtgaactcagctccctgcaacctccgcctcctgggttcaagtaattcccctgcctcagcctcctgagtagctgagattacaggtgcccaccactatgcccggctaatgttttgtatttgtagtagagacagggtttctccatgttggccaggctg

SEQ ID NO: 67035 - DNA, 1128 bp, Homo sapiens
taaggcttttgtaccttcgaaatatgtatgatatgtgtataagtgaggatgatttagctgcaattaacagcagaaaacccaaataaaaatgattacaaggcaaaacaagttaatatctcatataacaagatatctcaaggaaggctggttccaaaagttttaacttgttggctcaggtcggtaatttcatcaaggaaccaaccaatttctttccatctcaaatactcagtgctcccctaactgaggatgagcttagggaaatatccaaggagtaggctgcatcgggttatatgacaataacatatacctgtgaagtctactaggcttttgtttttaggtaatccttcactgatgaatttgtcctgccgtaaattgcagcctgcctttgctggccaggcatgttttgagagatgcccttgctataaccttttatgataataaactagtaatgttgttgggcagataactcagttcatcaagtaccgtaagagttggtcagctgataatgaaaataactatttaatgtgcatctccctaaaaccaatacctaacttctattataaataaggaagaaaacttttgattaggacttatctgggaaaacgaaactaaaatttatgaagatgatttttaaagaaaaattttatttaacaatttttaggttatattacaactatgtactaattttttagaacaaagaatgagtcacgtgaactttgtttttggtcttgtttttctgataaaatatggtagcatgataaaaattcctttatttgacttttatagcttgattataaagagtgcgttgttgtgttatttgctttatttttctcttcgttgtgaaagtcctgactctgccagattttcagatgtttaatggatttgcatgtgatttaaatggtcctctgacatcccttttatcaatttcgggaagtccatcttttgtgagaattgcaatttcaattagttttgggtttgcattgcactggctagtatttatataatcaacattcactgaaagactgaccaaagggattaccataatgggcagagatagctgctgatattgaagagagagagagctatttgggcaagtactaattttatggaagtccgttcatcagtaaa

SEQ ID NO: 67036 - DNA, 1056 bp, Homo sapiens
atgaaattgggctgatattacccaaataaattcaatatgttgtgaagattatgttaatgaggattgagtagataaaagcttatagaacagtcttgccaaaaagcaagtgttatgtaactgtcctttctcctctccacctctttcattatgttaaatttatatttctgaataatagtcatgttttaatttgcatttatggtcatttagaaatgaatattttgtgaaattggctatttaaacaacacaatttacaatataggagtcctttttattccccaaatttttagtaaattggtttacatactttgtatgaaattagcaaaccaaacaaccactacaaggaaatgctttttttttcttaattacatcttttttaaaaaaaatcttattttaaaacaaatgggttggtatcagttgctcatgttactttctttttgtttgtttgtttgttttttaagagcctggttgttgccaatggtggtttgggtaatggtgtgagtcggaaccagctgctcccggttttagagaaatgtggactggtggatgctctcttaatgccacctaacaagccgtactcatttgcaagatacagaactacagaagaatctaagagagcctatgttaccctcaatggaaaagaagtagtggatgatttaggacaaaagatcactctgtatttgaattttgtggaaaaaggtattatcatacaattatcttttaaaaaatgattcttctgggtgttttcttttcatagacttaagttgggaggttcagttattgtgaaacaaaatgaggaagcaggttagcagctccttttactttaacaaacattctttaagcacctatttgtgccaggcatgggacaagtagttgacagtacagaggtgaataagatacaacctgcctttacaaagctagtcccaccagtcaacaatatatttattaggcacatggcttattttggaaccctcctgcctaattgtgtttttcaaaatttaataatgagggtttgcattactagtttatttcacatatctacccaggagctttgaatta

SEQ ID NO: 67037 - DNA, 1050 bp, Homo sapiens
cctcaacaccaatgaaacctttgctcttccatagatttaggaatatgggaatgtttttgcaactatggccacatataaccaagttattttggtattttaattaataaacctcattaagtgaggtccagggcaagccatctgagactccattttactccatatcatatagtattgtattagtgggcttgtttattatgtatgtatatgcttgcatgcatacaaagtactggctgtcccatgacaaaacagttttactttccttattgtccaatttcataataattcttttatatccttttcaaacaaagttctaggtattcttattttgtgtaataaaccaatacacaatgtactatcactgagcttagtataaattaagggttggcaaactactgtccttagactaaatcagggttgtgaccaaaataatgagttttacattcttaaagtgttaaaaaataatactaagactatctgacagaaacttttatggcctgccaagcctaaaatatttactatctacctcttctcagaaaaacgtcatcaacacctggtataaatgaagaaattgatgagagtaggccatccatggctttcttttgttatattgaaatgtttttagaagtcatagaacataaattaaaaatctttacattgtatagaatggttaagtatagagactatatgggtgctagaccatgaacatcagaataaaaataagagactcctctttcatccctgcaaaatttccttgaataaagtttagtgcaggactatgcaaacagcaggaagtaatcgtgaaacttacaaaggaaaaagttttcattgtgaactgactgaattacttagtctgaatttccttagaggaaaattttttcctaattatgttcaatagaagctataattggtttttctttgaggtaatagtacctttacttttaatttttagtaaacattgtataatggttatattaaaagtgcggatcctggaaacggacagaaataggtttaaacccacccctaatcaccaccttaacctaatttgtcaga

SEQ ID NO: 67038 - DNA, 1373 bp, Homo sapiens
gttagacatgtccattcacttatccccttcctgtcttaatgacgactgactcctaaacctttttaacctcagttcctttcctaggagccactttattttgtcacttgccagccagacattgcaactctgtatctcacaataccttaaacattattctatcctaaatatgactcattacctcctatactgagcagctcttcctgaacctcctcctgactttccagttttgaagtggtagcactcatctcttagtcactcagcctctaactggttaacaagtaatctttgattcctgtctccctcatatctgggtagtcatcgaggcctcttgattccgcctgaacttttcactcacccttcctctttctcctctccccctatttcgcttctttctgttgcccccagcctagatcaggccagcatttctaattaacaagctggattattattattattttttttacctctcatctctctgctatgctgccagccagcctgcctgcctcactggccttacatcctagtatgtaccccctgtgctaggaagctggactgctggcattttaagagacttggcatttgtcttctatactaaagattagtaattagaattttgactgtttatgatttcatgtgaaataagataaataagattttatttaacccccaaatttgtatatttggttgactttgaagactttaaagtccgcagagagtgggaccggtctaaaaaaattatgcctgtgtcttggtgtcttggccaaacatgtccattttggttttagcttctgctctttactgcctcactgaatactttcctttttatttgattctatagtgttcttatccttcagtacatggcacaaatctcctgttttgaggccttcccaacttttccagtttacatactttttttttttttttgagatggaatttcactctgttgccaggctggagtgtagtagcatgatcttggctcactgcaacctctgcctcccgggttcaagcgattctcgtgcctcagcctcccaagtagttgggactacaggtgcccaccaccacacgtggctaattttttgtacttttagtagagacagagtttcaccatgttgaccaggctggtcttgaactcctgacctcaagtgatctgcctgccttggcctcctaaagattacaggtgtgagtcactgctcccagcccacatccatcttatttttgtctctaatttgtgtcatacctaaagactgtaccatcagcattaaattatataaagatgtgtcatagtcttattgtttagtgtttgttttccacaactaagttacaaacttgttgaaagcataaactatgtactttattatggttgcatgctgcag

SEQ ID NO: 67039 - DNA, 1632 bp, Homo sapiens
atgagcctttccaaaggaggcaatcagatatgcatttatctcagtgagcagagggatgactcagagggatgactttgaatagaatgggaggcaggtttgcccaagcagttcctagcttgacttttccctttagcttagtgattttgtggcaccaagatttattttcctttctcacctctaataagattcaggaggaaatatgcacgaagaatagaaggtgccaggggacattgctgaaagaccaaagggcccaaacctgtttgaccttgtccatttggagagcaacagataaaaatatagctgcactaccaattattactactccccccaaaaagacaactgaattttcagtgtaacagacagcactttacaaagacacttggtcgaaaaagggtcactcccgggctctgggaggcgaagaggactgtgggagcgctgttcgttgtcccgcgggctcatgggaaatgtagtgcagttttctccaacatggccgcgcccaggggagatggcgtgcaagtatccgctgcggtgttctggtgctagagtggagaggctggcaaagaagaaggcacacgcatggtgagaatccggcctgagccgaagcggaggtgtgtggcacttcttactggcgggcatacgggcagcaaatcaccgcttcctcttttcagcctcttccggtcttctctatccgccttgccagctagggctgagaacctagggaaaggggatggatcccagaggcgcccttggtgcagtgtgggcagtagggtgtctgcgttgggtggttctctcagtgtttagggtgcatgtgtttgtgtttggttcgggcgctcacgtggtgcctgtgtcaatcttctgttttctttggggttggagaggacggttgcaacatggggcgtgttagtgtggcgcttctggggcttttctgaccggtgacaatcggtctgattgcatcgatgcaaaggcagtgctgatgatctgatcccttgcgcagctgagtcttcctgtgctcttatttgagcaatccctgcgactcctggacctctggtagcgtcagcctgttattttgatagatttcattgaatatttattgtcagttgtatgtcaggcaccaagtctgtgcccttaaatagatgacagttttctggccgaagcccaacacaaacaggcaattataataccatgtgagaactctagagatagaggtccatgctaggtgttaatgaaaacgttgaagaaggccaccaaactcagaattctggaggaggggaggtttaggaggtaagacagcaaagtcgatttaggtttattcgacaaatggttattgagtggctgctaggtgctaaatcctgtttaagtgctgggtgctacagggtgaacaatagagacaaaatctctacttcatggagtgagtgttctttattcagttatggggaaagacagaataaacaaattaatgagagtgtaagaaaatatgtagtaagtgttattcaaagagttaaaacggggtgccgtgacaagtgatggggtgaatttttttctaaaaattttaaatctttattttctttttaaatagatgatgcagtttaaatagctactaacttcaaaagtcatgaaagaagaaagctccct

SEQ ID NO: 67040 - DNA, 1034 bp, Homo sapiens
tatggggatgtgtttttgaaagcatccagtagtgcagaagcagaattgcaatggggagatttcctgtgtgtcctcttatactcatgtagcttgcaatgtctggtggatttgacctctccagcttgcacttgcctcctcatttttactattaagttttggtctcaccctttctttcctagactattgcaatgcttgcctatctgcctcttctgttctttcatgtttgtaacctattctccacacaaatcattccgccactcaacagcactcttttttcactgccacttttcctggtcagccagctattttattgttagtccactgtggtgcactgcagataggggccattgtatcaacaacatgggaaggtgattcctcttcccctacacctttccctccctgcactcacatagctcataaaccaatgcaggtagaaggattatggtacatttatataacaaataacagagcaggaacaactgctaatcatcaccctctcctttgtcttttacttatgatctgttaccagctcttttttctttccctctgccactactgggcttgttaatatttcgttacttttcacttcatcagtcatcttctagtctctcctcccacttgccacaagaagctctggtcatatcatttcatttctctaaccttcctccctgcaactcccactctgcaggcctacagaattctgtcttgcttccttcaccattcttccacacatctttctattactctgtggtactcaccattcccctggcacattcatgcatattcacttccttccctcccgcccatgcaatgccatctttcagaccccaggatcctctcccatatctctgtgaaccctgaatatctgagacaggtctcagacaatttaggaaatttattttgccaaagttaaggacgcccgcccgtgacacagcctcaggaggtcctgatgatatgtgtccagggtggtcggggcacagcttggttttatacattttagggagacatgaggcatcaatcaatatatgtaagat

SEQ ID NO: 67041 - DNA, 1035 bp, Homo sapiens
tgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactct

SEQ ID NO: 67042 - DNA, 1056 bp, Homo sapiens
aggtcaggagttcgagaccagcctggccaacatggtgaaacctcggtctctaccaaaaatacaaaaattaggccaggcacagtcgctcgcacctgtaatcccagtactttgggaggccaaggtgagcggatcacttgaggtcaggagttcaagaccagtacaaatgcaaaaattagccaggcatgatggagggtgcctgtaatcccagccagttgggaggctgaggcaggagaatcacttgaacccggaggtgtaggttgcagtgagctgagattgcgccactgcactccagcctgagcaacagagcaagactgtctcaaacacacacatacacacacacacatacacacacacacactctcacacataaacttctagtaaccagtttcttcttctttagtgtcatttaaatgaacacgagtcagatgaccgcctggaggcacgctgtggaggttcatctgttgacagtgttttgctttctgtggcttgtcttcctgcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctgtaagattctacaatttttttctaaagacaaaataagcaaatatattatagatgataactactaatattcattgtttatttggcccaaattcacatttggaattagtattaggtggatgcaagagtaattgtggttttgccattacctaataacttgctgagtgtctactagaggattgttaaaacatcaagaattacttcctattttcttaaacatgtgtgttgcttaggattcctgattaccatgtggtagaggcatttgccagtaaggagtttttttagttatttccagaaaatattaacacattaacttcctaagcttattcaaaaacaaagcataatatcatattttcctcctatacttgactattatttcagagcacctgtaagggagtcaaa

SEQ ID NO: 67043 - DNA, 1025 bp, Homo sapiens
gctgatatcgaactcctggactcaagcagtctgcccgccacagcctcccaaagtgctaagattacaggcgtgagccaccgtgcccagctgtcatcccatttttaactatgtgtttttggcaactcatttcacctctctgtatcttcattttctcatgtataaaattggattgtaatttcagtctcatggaattgtgaggattaaatgagtgaatccaggtaaagctcttagtacagggctggcaataataaatgctcaataaatactgactcctattataaatactgactcctattatttcttaattacccatcttttagctaatgagagatatgttttaaactgttgattctctttccatgcagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcaggtgagacggtgtcacatgtttgtgcttcaatcacagcaaatttgtttatgttttcacttttatatcaacaaagaaacttgtttactggagtatttctttttaagtcactgtgtaggtgagaacactttgccacactttgtgttgaattcagttgatagtataaaatctaattgaggtctatgaattcatccaatcttcaagtgagttaaacgtctccttggattgagagagaaaattacagttgatactataaaatctaattaaggtccatgaattcacccagtctacaagtgagttaagtgtctctttggattgagagagaaaattatagttgatagtataaaatctaattaaggtctgtgaattcacccagtctacaagtgagttaagtgtctctttggattgagagggaaaattactttgaaagcaggttcccatttttcaaattgacctaccccttcaatgaactccattaatttgtcatgtcatggaatcatttt

SEQ ID NO: 67044 - DNA, 1050 bp, Homo sapiens
ttctggtagcctggcccccagtgtgaagctgccttggggaaatttgtcttggagttggatcatatcctgccattgaagttcattttagtggaggttccgttagtaaaaccgggacaggatatatcccaaggtcagatgcatgtttcttctggcagctttgcttaaacaggaacaggttttgttatggtatagagggttcctctgttcagaattcacatgaaccaggaccttgtacaaatttatacaaacatgaaagtggagctataagtaacaaaaattgttttgaggccttcagtgtctataagtttgagtgttcttgtcttctttcttcctttgctcaatttcctaccccctccccgccagcttttctctctcactcttgctctcctactcctctattatagatgaggtcattatgatttggagccaagagaagtgcattcctgtaactttaaatctccatactcaatttgtgactctcctttttttagaagatagttttactttatagttggaggacagcttgcttaattgtgctattttagaatgcagatatgagcttactgtaggaattctgtcaatttgtgaagagggcttaatgcttccacactttttattctcacttatttcagatttataattgctttcaagtccattatgagatgtgaaaaatgctctcaatttgattaggttatcagccacttggttagggtttctgtgcctggtactttggacatccaactcccccatgatgtacagggaagcagtgtgactactgggaggagagagatcaggccaggttccttctttcctgacagcaaggcgaggtacagggatgctttgaagaagggtgttttgttttgttttgagacagagtcttgctctgttgcccaggctggagtgcagtagcgccatctcagctcactgaaacctctgcctcccaggttcaagcaattctcctgtctcagcctcccaagtagctgggattacaggcgcctgccactatgcccagctaatttttgtatttttagtagagacgggatttcacta

SEQ ID NO: 67045 - DNA, 1052 bp, Homo sapiens
ctgggactacaggcacccgtcaccacgcccggctaatttttgtatttttagtagagacggggtttcaccatatttcccagtctggtctcgaactcctgacctcaggtgatccacccgtctcggcctcccaaagcgttgggattacaggtgtgagccaacgcgccctgccagccttcagttattttaatgaagcgattttgtacaaatcagccagagggagggagagtgggagggaagaggaggggtcagccagtccttccagttaggagagtcccggctcactcactgcttctaactcactgctcactcaccgcttcttagcttaggaatcacctacaataacctcgtgtcactgtatcttgtgatttcaaacaaggaaccctaaaaacctgaaggcacactgggtgccgctcaacaataaggctcggctgccaagacgaaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggtgagtggaaggggcgtgctgcagctccgctggggcgtgggggcggctgcgggccctgcgcgcacgtggacaaggagcacactctctgaggcccccagcagggaggcagaggtggcggccgcacggacttcggttcggggctcaacacgcacaccaggtatggtgcgcttcacctggcgtcgggaagcacttggtgcgtctccctcggctcccgtttcgaaatcgtggcgatgtatt

SEQ ID NO: 67046 - DNA, 1328 bp, Homo sapiens
actttgaggtctatgtcctctgtgtgctgtagtgaatcccaaagtacctcctgaggagggggtaggccctgcccaagggtgctccctttgcctgcctttatgcccttctatgccaactttcaaatgaggttgtcaatcctctctccagcccagcttactgttaaaatttaggaccctgccagtcgcagtggctcccgcctgtaatcccaacactttgggaagccaaggagggtggatcacttgaggttgggagtttgagaccagcctggccaacatggagaaaccccatctctactaaaaagacaaaaattagctgggtgtggtggtgggcgcctgtaatcccagctacttgggaggctgaagcatgagaatcgcttgagcctaggaggtggaggttgtagtgagccaagattgtgccactgcactccagcctgggtgatgagagtgagactccttctcaaaaataaataaatagcttttcctccctgatgcaaacgaggtcgcacgcatgaggcttctccgccgccgccgccgcagacgccgcggcgatgcgctacgtcgcctcctacctgctggctgccctcgggggtaactcctcccccagcgccaaggacatcaagaagatcttggacagcgtgggcatcgaggaggattacgaccggctcaacaaggttatcagtgagctgaatggagaaaacaatgaagacgtcattgcctagagtattggcaagcttgccagtgtacctgccggtgtggctgtggccatctctgttgccccaggctctgcagcccctgctgctggttccgcccctgctgcagcagaggagaagaaagatgagaaggaggagtctgaggagtcggacgatgacatgggatttggcctctttgattaaattcctgctcccctgcaaataaagcctttttacacatcaaaaaaataaaaataaaaataaatacataaatacataaaaataaaaatttaggaccctacctttaaaaattaaaatttaggaccctacctttttgagtgctggggttatactccaggtgcctggcattgagaataacattgaactcacaatccttgtccaaagtaagacaaatagtatttatggaagtttgactgagtggtctatacccctagcatatgtcaagatctatccctaggaaagaccaaaccagaagagagctagctaggccccagcctcttatcatctcttcttgctgaattatgctcagacatgacgccattgatctacactgaagggcatttacatgaaactataaaactcactgacctctcagttccttgatgtcctcatcttcat

SEQ ID NO: 67047 - DNA, 1041 bp, Homo sapiens
cagcaaggagcgctccaacccaggttcctgcatgagctcactgggcatggttcacagagaggtggatgcggtaatggtttgggcacctcacagcactgaatgtggtcatcagaaatactgggtcatgacccgtgggaatgggtcttgtaggttaactagatgcaacatcagggacactggcacagctgagggtgtgtgtgtgtgtgtgtgtgtatgtgaagggttgagttgtctttagaagtttgtcatgtttggtgggaaaaagacatatattgagattcgccaggaactttaattttgcttatgatcagtacttaacgttccagggtgataatatttctaaagacagaaggagggatccaaatgaatagtctcctcctaaatatccgctggggacatgaagggtttcacaaaggcgacttgtgtaaataaaaagtaaatgaaattatatgcatttcctgaatatttgagatggaagcaggtttaaagcaaattttaaatgtctaggattcaaaggcacttcgttttagaggaagatggtgaaactgatgtattgtactgttctgtttcttaaagactgcattatccattggaactcatttaaggaagcattttgcgttagtcagcaagtactctgcttgtgaaatgcagtgttccatgaggggacttcccaaacatggcttcccctcgcccccagccagcatcactgcgaatgagatcagcctacatctgtgagaatggtccaacattcaaagttttggcttccgttcctagcaatgatgctgattcatagagataatgagtgaactgcttagcttgcttataccttagttttcgtgtgtgtgaagtggaaagatggtaaggccagcgcttcagagaggtgttaaaagattattgattggatttgtacaacacgtagaattccatgaaaaatgtttttccttttcaagaagcctccttttattaaaataatttttcaaatgtttgattcctcatctgtaaaatgaaagtcgtcgtgatctctaacattccttccagttt

SEQ ID NO: 67048 - DNA, 1028 bp, Homo sapiens
tgcaacaaaaccagcttgagaaccttattcaaaaaagagagttagtagaagaatggttgaggtgcagagacttgatgggaaagtggaggccaggcttggaatgaatcaaaagatcctgggagtctgggcagtaggaactgcaggaagccagtgtggtccccatgatactgttgccccctttctgcctgctcaccccctgccataagaagctccaaatggctagtcggcagcttcagctgctaattcagtagaagcatcacggggttttctagtgaaagcatttctcccttgaatactaaaacgtttatatcagcaaagttcagagtcacagggattagatgcaacaaaaaattttagtgactcattaagtggaattgtgagaggcaccatcaccctattttcaccctttgcttcccacaccacagcttctgtttatggggaaaaaataccacctactatcttgctcactaatttagaatgtagacatcctgaaggattatgctaaaatcttacaaggtgtcatctcctggaaatgggcacacctacctcttaataacccatttcacagttttatagggccagacgcctctagatgatagtggtgtgatatgatcaatgaatcccatggcatcattccatttccctatctccaccactgttaagtgaattacttgatctgtggcaatgtgtaggataccatgactatgtataaggcagtctgcatgttcatggatggtggtactagcatggcctaaatccagattaaatatattacaatgaggacatatctgtgtcccctcaatgatggtcccccagagtaaggtacaatattcaggatgtcggtagctactggaaaactggtagtaagcaataacagttcaggccaacctaggtaagattaagtctattgagcccaggtacagcttccatctccctaccatgagttcaaagtgggataaaaatactgtttgataattacaggacaggacattttgttccattgattattaaaattttttcatggcggg

SEQ ID NO: 67049 - DNA, 1013 bp, Homo sapiens
tcatgggcatactattatatttacaatgggtgagaattttgttttctcatgatttttcctttcgttcctatgcagagggagtagaaaaagatgtgtgtcttcatggacccgtaggaattcttgattgatgcatatcctctgcttattttttttggcgggggtggggggcgagggggccgaggtcttgttctgttgaccagggtggagcgcagtggcatgatcacagctcactgcatcctggacctcccagtctcaagcgagcctcccactttagccttctgctagctgggaccacaggtgcacgccaccacgcctggctaattttttattttctatagagaaggggtctccctatgttgcccagggtataggtctcatacgccagggcacaagtctcatatgccagggcacaagcaatccttctgcctcggagtcccaaagtcctggaattacaggcatgagcccctgcgcccgcttcctctgctttttttaccctgagctattgttcctgcaaagtggaaataatagagagggacgttcctgcagacttaacccaatcaaaagtcacgtttgtgctttttgtgcatctttgaagtaaatatttaattgtattttcaaatacttgtacattttctgggttcatgtatttttaattgtgcttatggagagattataaattataactatataaggtatgactatttatattgtcagcattttcttgatatcattaggttaatttcacatgagttcaaaccgtaattaaccaaatgagaaaatacttgtcccccaaaatgtgaagtagtccattttactgttacagttttcaatattatatgacaatttcccatcagtccaaaatggcataaaccccaacactgaaaatttagcagttgaaagtacagtcacctgtgcctacttctaaagttaaatagctaaaacataaaatatgatttaaatttcagtggacaccctttataatactaatgtcaggagagactaatatttgggct

SEQ ID NO: 67050 - DNA, 1030 bp, Homo sapiens
gttcaaacccctgacctcaggtggtctgcccacctcagcatcccaaagtgctgggattataggcaggagtcaccacagtcagccacaaatggatattttaaccaacccgatgggctgaccaacttgcaccctgtggatttgcttagggccggtttatcttccactgtattagctagtgttgttgatggatgtaactgggactagatgcaggtcttccaaattgtgatccaaggcttttcctgcctgaaggatggtttcagagaataaaatcaaagaaaacagcgaccaaaatgctcagggcatgcttctcttgtcctgtgaggtggacccttcacttctgaaccttcacttcacctttcctgtggctgcctccgaccctggttcctctgtgcccctgtctacaactgtggactcgctcccacaatgtaccctgactcttcacatggggcaggtggttaacctgagatggttctaggttttctgatgtttttactggatgtgttttcttatcctctagacctgtttgctccagtgactaagtcaagctcacccctctcctttcctctgtcagtaaatagattttccagccgctggaaactctccttggaaagaatgcaagtctgaggttttcaactccaggctccttaacctcccactttggtgccccctcagtggccacggttgggtttgcagcagctgggatgggtggtgttcaaaactctatttcaacagctacccccagtggaatatcagttaactacactggcaagagctacctgagatcaggttgacttggcttaaggagaatttcagacagaccctcaaagaaacacacgtacacaacacacatataccaacacttctgatacttgtttcattatccataactgttcactttttaaataccagaaaagacaaacaatttatcttgtctaagtggcactaagtagaagaaacaaaaatgagcagccgttggagaattatgacactttttattaatgctatcatttgggagacttcatctaactag

SEQ ID NO: 67051 - DNA, 1098 bp, Homo sapiens
ccacgaattctcgcgtcgtctcgcgagagtccaagttaaagaacatggcgacgtctaatctgttaaaggtaagaccctcactccagcttgggttttactgtgtggccgccgggttcggctctttgggaaaggcacggctcaggttcagctgcgaagtgtgggagtgttcaggggttgtccactggcagggaagccgcggtggcagccggcgagtaccggaacgcgggtctgtggccttggggtcgacaggctctggtggtcgctcccgccgactggccgctgggagaaaagcctggctgagcgctggcgaggagcgatgctttcaagggaccagctctggccgggagcgggagatgaatggtcgtgcggtgtcctgaccagctgggccgttagtactgttaggtctcagtttcttgtaaagcaatgtctaagacgcatcaaaggaaaaaccaagaaaatgctgcctaacaggtttcagtgactcgaccccccacttcttccatttctgttctcgttctgtctgcacgaaattccgagtcagaccagcagtgcctcccactccaccccccttcctcccttttctgcgtgttacaccttccctcctaattctcccattcttgagttcatctttttccttaggaaactgctttctaacccccacccagttacaggacacaaccagatgacaactgatgaagcgataccatcgttttagggcgcaggaaagttaccttgtcaaagacagtatttaaagttagttttatatagcaagggagatctaggcccacaggggcagattctccaccagttaaaaagtttggagaagaatgaggaagacttagaactagtctgttctgtgtatgtgtctgtagtagttaatcatttgccttaaaagtacggacagaaatgggggtagtgaatagctcagggaacataatattaatggcaaaaaccgcagtcacttttgcaccagcctaatacaaaggatgaaccacttcttcctgaggcctctcatgccttcaggcaatgtggatgaatactagaaaataatagaaaatatacaggaacctaaccatcatgtcttctttagaccactga

SEQ ID NO: 67052 - DNA, 1348 bp, Homo sapiens
ttcagtttcccttttttctcctatgcctataagaaagttcatatgtcgcgtcatataaacttttcttttttttggagatggagtttcgctcttgttgcccaggctggagtgcagtggtgtggatctccactcactgcaacctccgcctcccaggttcaagcaattctcctgcctcaacctcctgagtagctgggattacaggcacacgccaccacacccagcttatttttgtatttttagtagagacgggattttaccatattggccaggatggtctcaaactcctgacctcaagcgatccgcctacctcggccacccaaagtgttgggattacaggcgtgagccactgcactctgcctcctcatacaaacttgtactctgcctctgcctcaaacttctgtttctcactgtcacagttcttggaaaagcagcccccatttgctgcctttataattctttgccctttaacttaatgatatggcttactcttctctcccacccaattgtatagaacctgtcagtcataaaagtattagcaacctcctgattatcaaatgagattcttctctgataatatttatcctcttttctggtattattgctcatttcctctgcttctcttttggtttttatgacattccctccttggtcttctctctctcaaatcacgtttgtttttcactgacttccctcccctgtccccaatagaattatttctcaggattttatcttcagcccttttctatctttgtatatttttttctgggacagtcttaactcccatgatttcactatttttatctcttagctctgatctgagctctagatcaaaatgcagttctcaccatatcactttcctgttcagatacctttgatgattcaaattatttgagatctttccagctgggtcttctcctgataactagtattctctctctctgtctcttgtctctctctctcatacatgtgtgcgtacacactcctacttagctggttacttgttggctcactagcatgccagaggtcgtcatctccctaataactaactcttaactttcattctctctccttctgattggatctagtgagatggaggcacaagaaggcagtagtatataaccgaaccacaagataaatcaaactttaaactgaaatatgattcatactacttttctcagtggacttttttttatcctttaagaggaaagaaaatggaaatgtaaagcagtgattcagagtgtctatagaggccgggcatggtggctcatgcctgtaatcccagcactttgggaggatgaggtgagaggattacctgaggccgacctgggcaatgtagcaagaccctgtc

SEQ ID NO: 67053 - DNA, 1046 bp, Homo sapiens
caaaaccactctcaggtttgataattcattagaaaggctcatagcatttagtgaaagctgttgtacccatagttatgatttgttatagggaaaggattcagataaaatcagccaaaggaagagactcatagggctaagtttaggagagttccaaatgcgagcttatcttgccctctccccatgtggtcaggacacatttctctcccggcatcaatgtatgacagtatgcacgagtaccatcaaatagggaagctcacccaacctttactgttgagttttgatggagcttattcacataggtgtgattgattacttgctcacagggatttcagtctccgtgttgagtgaccccctgtgaccccaaacccgtatctcaagttgtattgttcgtcttcccagttggtgagcctctacataggattatataggtgtggacagtcccctccctgaattgcattattagccaatccagtatgacccaaggcctcccaaagacatactttttagacgtaactttctaagtgtccagagattatctactagaagccaagaagaaagaccagactgtctccttggacaaggccaaattcttcactaaacacatttgtacaatttttctcttttatgattgtcttcctgtgattcctcaataacggattaagcctgtagggattccattatggaaaactggttcatttaaatttgagcccttcatttctctagctgtctcataaaaattacaggatactttttatttaactgcatttaaattaaactcccttttatctttttttttttcaagaataaaggttctcttcagtttgaagacaaatgggattttatgcgcccgattgttttgaagcttttacgccaggaatctgttacaaaacagcagtggtttgatctgttttcgtaagtaccccactaattctgtttgctagcataaaggaaattttagtgatgtctttccatacccaaatggaatgtgtaactctaagtttatctgtttacctattaaaaagtattactagttacattgagggtct

SEQ ID NO: 67054 - DNA, 1032 bp, Homo sapiens
aaaatttaaaaaaaaattaggcgtggtggcatgctcctatagtaccagctcttagaaggctgaggagggaggatcgcctcaacccaggaggtcaaggctgcagtgagccgtgattgtgccagtgcacactagcctgggcaacatagtgagaccctgtctctaaaaaataaaaataaaaaaatttttaaaaataattaaaaaggacaaaatagtatacatctattgtgttaaagaattaaaaggatttgtagttgtttttgcacaggaaaatattaatagcagttaactttgggcagtgacattgggagatggagacatgctttcataactaaattttatgtggtaagtagcagagaattaaagaggaaaacaatggctaaagaaaataaaaatagaaacaaatgtgtatgtgaggcaattacaagcgtacttggtttatatgagtgaattcagacaccatttacttggttctaatatggcccatggaaactgtactgaaatagaatttaagatgttttgttcagttcttgtttcattattaatgtttgtttacctactttatattcacagggatgtgcatgcagtctgtctttgggatgataaaggcccagcaaaaattcatcaggctttaaaagaagatattcttgagtttattaagcaagcacaggcagtaagttctacatgcttattttagacttgttttaaaactactcagataatatcatattttattattttgaaagtagaacttcttgaagtaatttcaaaatattgcattgacttttgacacatttgttaaataaatttattaatgaaatgatcgtcattagttggattatttttttcccacagtgatacttctgtcaagagagtacatattatatttaattaaaagatgctatagcgaattcagttttttatattttttgggagtccccaccaccattattttttggctacacatcagtccacacagatctttttttttctctcatgactaatacctcttctcaagttgacagtaatttcttc

SEQ ID NO: 67055 - DNA, 1200 bp, Homo sapiens
aatttcttattttttagttggatcattccattaatgtcttgtacaacattagtaaaagttgtttgttaaatcgtgttattaaatactaaaaggtgcttagcagttgaaaattaaaactgagttttttctatgtatgacttaagatattgaaatcaagtatatgattggcatatattttaattttgctagtagccactaccatgatggagtaagactaatctattggatattacttaagaaattaagtgttttattgatagtttcttgacaaattttttaaattgtagttttataggaagttatcttttaatgaaaatctgttttcaagcacttagaaaattaaatgtttcagtatcaatttaaaactattttcttagaactaatttagagatacagtttctacttgcattgggaaatgtaccacgttttctttttatgacttgataaagataaattatgtttatttcagatagatagagctttattcttcagtttctggaaataaacttatgaagaattaccttggatgttcttaacagatgttaaaaaatatgctgaacactggcaaaaaaaagtaggggagggtttcacggtaacatgactgaataaagtctggaaatgtagacctcagcaagaacccaagaatgggatttagcaccactaattctgagcagttaataggagtagcaatgccagacatgggtcttaaaaagacccatcttaaaaagatttttaaacgcttaagaaatttttttttttttttcatgaatcattttacttaggcaatcttcagttgaacataccttgttaggaaggaccaaatctcccagatggttgaaaggcaatatgcattgaaatgtttataacattttttaaagaacaaaaaaaaaagtaaaaataataaacataggtggagtcttttttgtttaacctagattaacacaactgttttatttgttcacaattctgtggcttagcaatttgggctggtctcagatgaatttgcctaagcttattaatgcagcagcagtgggctgttggacatggtggtctaagagagcattaaaactcatatatggtttttgatgtggctttcttttcactgtgtggtttgtcattctcaaggagaccagcctttgagatgaaagtggaatctacaatacctattcatggatagactgagaaatctttcactgttac

SEQ ID NO: 67056 - DNA, 1054 bp, Homo sapiens
cccatatattgtttatccgtatttcagctaatggatatttgggttgtttctattttttatctattttgaataatgctgctgtgaacattcgtgtacaagtttttttgtgaacatgttttaatttcttttggatataagagcttgtacaataatttaaaaattatgtacaatttaaattttggcatgaatatgttcttaatttttcaaagcaactgcatttatttcaaattggtacacctctttttttcagcgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaaggtaagactatttttctccttgttttcctaatattcttcagaaagagggtaatttggaagcatttgaaagtaatttgaacttttaagtgggtttttctacttcacatgtcaattgcttttcagctcttaactagattttattgaataatattcttttttgtctttagcttcaatcttctttcatctttttatgtggtcttaagctatagatctgcatcttcaaccattatctcctttacttttcctttttactttctccttctcctggtattcagtattttatttctctattctttctttgtactctttttttttttttaaactggagtgtcactctgtcgcctaggctggagtgtgcagtggcgcagtctgctcactgcaacctccgcctcctgtgttcaagcaattctcctgcctcagcctcctgagtagctgggactacaggcacgtgctaccacacccggctattttattgtatttttagtggagaccaggtttcaccatgttggccaggctcgtctcgaactcctgacctcaggtgatctgcctgcctcagcctccgaaactgttggaattacaggcgtgagccactgcacccaacctatacccttactagaaattaaattac

SEQ ID NO: 67057 - DNA, 1023 bp, Homo sapiens
agtttactttaattatgttgtcaatttagctctccttttaatcctcgttgtaacccaccataagaaatacattttatattgtggcttagaatatactgtttatttgtacatatctgaaacaaaagtcttatgaaataatattcattgttacaatatgtgatacactctgatattttttgttctgtcctatgtacattttttttttttttaaacctggtcacagccattaaaactgatttcacaacatacagtctgaaacacactggtctggatttttagaatctgcaaaatttcaactaccactgaacaggataatgttcaagtgaaagttttcaatgaaatagaaaacacagagcttagagtttattaggattccactttgtctttgttctctattagttatatattgttagatttacctatgctcaatctggtttcactgcttaaggtggaagtgtttagttgggcctattccagtgatgttatagaataagattactcagcagttggggcagagatttccaccttgcaaggaaagagtttcttaaccattttatatgtgtagtcttttctttatttttcttttttttttccttttttgagacggagttttgctcttgttgcccaggctggagtgcaatggcacgatctcggctcactgcaatctctgcctcccaggtttaagcaattctcctgcctcagcctcccgagtagctgggattacaggcacccaccatgcccggctaatttttagtagagatggggtttctctgtgttggtcaggctggtcttgaactcctgacctcaggtgatccgcccgccttagcctcccaaagtgctgggattataggctatgagccaccacgcccagccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactac

SEQ ID NO: 67058 - DNA, 1053 bp, Homo sapiens
gccacttaactgagttatatttagttagcagtgtaggtttactgccctcctcactctcaattagacagtgatctcttcgagagcaggaattatatcttattcttgtctcttaaatacttccttagtgcctgcacgtagtaggcatccaataatggtttgttgaatgaatgtattcacacttctagaattttataacctaattttaaaacaggttctctccagacaggaagagttaatcaaagtttggttttgtatatttttctctcccctccttgaggacttttgttaaaatttctaaagagagtctagttctatagtttttttccttaggggaaaatacactttggtaaactagtatagcatatccatcttcaataatcctatagttaaggtaagtgaaatctactttcagtataattttttttttgttgaacaatattgttttattttgtgagttagaatagatttgtgctatacagcttatagtagccttgactaatttttgatatatttcagctcatggaatgctgtgtaaatgccctggtgacatcatttaaagagactatcttagctgagtgccaaggcatgatcaagagaaatgaaactgaaagtaggtaaaacatcacataaagttatcataatcttctaagagggtatctttgaaacaaatcacttactaagttgctcttagttaattcttttccacataggtatatgtggaactgttagagtgaactatacttaaggaaatagataaaatatttaacacagaggcactgctaagagtatataaacttaaattttaagcattttccctcttagctatcaacatctgtgtatgtgtatggtgaatttctacttttttctcaaaagcaagacactgcttttaaaggccagtttaaactggaaacatatgttatagattagaaccaggtatttgacttttgtgtggaaccttgtgatgaatctttttagaatgtaataaaacactccctgttaatagtcatctctgtcccccaaaatactttataagatttctaaaggattttttta

SEQ ID NO: 67059 - DNA, 1041 bp, Homo sapiens
gtggcgggcgcctatagtcccagctacttgggagggtgaggcaggagaatggcgtgaacccaggaagtggagcttgcagtgagccgagaaggtgccactgcactccagcctgggcgacagatcgagactccgtctcaaaaaaaaaaaaaggaagaaagaaaaaagaagtggcaaaacagtaatattggaacaccttttagttttatttttaagaaaaaatatccccagttttaaatgagttttattaaaattatgtttattttctcatttttttgtgttattctttttcttttaaaaacttaatgtaaaaccttttgtttctaggactctgagaaatacgttgagcagttacttacactatttaatagatttagtaaactcgtcaaagaagcttttcaagatgatccacgatttcttactgcaagagataaggtatatattcctatatatataaaaaacacttttaaaagttttattctcataatttacttctaataatcaatttgcattatttttctattaattataaacttaaaaacctagcaactgttatttttcatcagtggagaacaactatattcgttttgtcttggctgtaagcatttgttaaacattagatagccttgtgaattagaatttagttagaaagttgcttttttctcatttttccaagaatgtttttctgtttttgaatattactgatctattgaattcctattcatccttccattaagacccagctcaaagaatacttcccctggagcttccttgatgtcctgcctccctccacagctcatcaccagcagagttgattcctccatcctccgtcctttcatgggactccttcgggagttatgttatacttatccttgtttcccagggaagcatttgtattgcataccatctttttccatcctcactagtataggataatgataataaaacaccatactgtccttagcattgtatcttttttagtgtaataaacctataacaagaaattgctgttagttttttctcttctttgactacctttcgtta

SEQ ID NO: 67060 - DNA, 1031 bp, Homo sapiens
cctgcttcagcctcccaaagtgctaggattacacaccatgccaactaatagattttgaaagaagtattgtggttagtcattgttacttttgtcatgatttgtggatcaaagagctagaaataaagtttttacttcatgcagttaaatttattatatagtgtcaactgaaagttgagctttgttcttggggaattggtattatttaactgtactgtggtaactgaaattcatacatactaaaaatgcgcaaagcagggaccccttgtaataccgtattttgtttctaagtagcaaatttcataggtattagacaataaaattctaataaatgagaaaaattttgtattaaaacatttaagacttagtttttctattaaaatttttcccagtaatatatcagattatgtatttattacctcttccttctttggtttatatttataggaagttggtatgccagcggattatgtaaacaagcttgctagaatgtttcaggacataaaagtatctgaagatttgaaccaagcttttaaggaaatgcacaaaaataataaattggcattaccaggtattattttataattacatgtatatattttttaaacttagaagaatatctttgttttccagtaaattaaaaataaacctcagcagtaatagatcgaaagatgttatgaagtccatttccgtggagacagctatcaaagcagtgtgttagatttacagatctttatttcaaaacaaaaggacacttttaacaaaatctttatagtcttattgatttttcacccaaagttaccctgtatttattttgaattttatccattgttaatttactttatattcctgatattcttctctatagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtc

SEQ ID NO: 67061 - DNA, 1047 bp, Homo sapiens
ttctggttataccatcatacttaagatactgccgttgtctacagaattcaacatgatcccaactatctcagtattcctggcaacagaaagcaaaaggtgagggtagcttacacctttcattagggacaacttctagaagtttcctctgtcattttccatttgcatccgccagtactcagtcacttggccacattttgttacatggaaagctgggagatgagcgtgtattctgggcagtcattaacgtcttctaaaatgtttattactgtgaaagagtggatactggaagacagcaacctttttcatatataaattcatgtcatagatattaagagagaatcatcatgagattctttattaaaaatctgttttatctattatagataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatgggttggtttatgtttttttgtttttaagactgtatcctctcatgtagcaggaaatatatgattggcttgtaatatattagtaaattcataacagtttcagaatgtcttatcaagaaaaatagaggccgggcacagtggatcacgcctgtaatcccagcactttggaaggccgaggtgggcagatcacttgaggtcaggagttcgagaccagcctagccaacatagtgaaaccccatctctactaaaaatacaaaaattagctgggcgtggtggtgggcgcctgtaatcccagctacttgggaggctgaggcaggagaatcgcttgaattcaggaggtagaggttgcagtgagccaagattgcgccactacactccagcccaggcaacagagtgagaactccgtctgaaaaaaaaaaaaaattatgcacacacacacacacacgagatatttatggaaaaaataaattgcaaataggcaagttaccaaggcagagaaaagtgct

SEQ ID NO: 67062 - DNA, 2409 bp, Homo sapiens
tccttatttttcaaaatctctatagtcagattttttttaaatacatactttaagttctgggatacatatgcagaatgtgcaggtttgttacatgggtatacacgtgtcatggtcatttgctgcacccatcaacccgtcatctacatgaggtgtttctcctaatgcttatccctcccctatccccccaccccaataagcagattctcttttatggggcatgagaaaacaaaagatgtttttatttgttaagtaaaagatactagtctcaacattaatcccctagtgattattattcatttgggtagatgttggatagaggatgaatatgcataaaaagtcatttttcagtttgttgtacttaaaataatttcgtatattaatgcgcttttatttttattttttcttttaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctcaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattggaattttgtttaaaattttacactttaaggtagcaaatgtcaattattagaccgagcatattgtgaagaattaaactaaaattaatacgtacagttttctctaattaggtgactgttcataatgggtatatttggaatttagaagaaataattttgtagtaattgtg

SEQ ID NO: 67063 - DNA, 1046 bp, Homo sapiens
aagcataagaaaaaattgagccagtataccatatctagttcttagaattgcctaaggattttgaaaaattctagaaaacatctagatgttatttaacattttcagtatatcaggctcatgtaaaattgttttggtagtttataccttcaatatataaatcccagggaagatatgtataacatgactatagaattcagtttttcatatgtagcagtctatgatagggtcttcattggcattgaaaaaaacagatttattgatataatttatataccataataacattcttctatttaaagtggtttggtagtttttaacattcatttatatttatctccaggtgattctagataagaataaatatctgatttgaaaaatatgtagtgagtacctgctatatattgaataaggaaagttagaccctggagacaaaaatattaactggtccctatgtttcaagagttgtagacgagcatttatccagtgccatcatgcatgtttgtgatgtttgagaaaactgttttatgtacacaaaaaggcattcttacattgtcttgcagttagctgtgtacatgtttcctgagggcaggaattgtctccacccatatttgtaatttctttaaacatttagcagcccaggcaataggtatttgttgaattgaaccaaatacatttattgtgaaggaatgttttgacttcaacctcatttttgctttcaggcacagtaacagctgccaatgccagtacactgaatgatggagcagctgctctggttctcatgacggcagatgcagcgaagaggctcaatgttacaccactggcaagaatagtaggtaaggccaggcgaggtggctcacacctgtaatcccagcactttcggaggttgaggtgggaggattgcttgagccccggagttcgaaatcagcctgggcaatatagtgagacttcgtctctacaaaaagttaaaaaattagctgagcatggtggcatgtgcctgtactaccatctactcgggaagctgaggtgggaggatgccttgagcccag

SEQ ID NO: 67064 - DNA, 1074 bp, Homo sapiens
ttttctgtctctagttttactatttactctgaagacctgctgccagctgttccctttcagaatggagtcctctcctggggagtgactagttgctttccattctagatctggaaccatcagccagcattccctccgctttgtggttaccacaccaggtgtgtgagttctgtatgatacttacaagtaattcagatgtgtagttttacctgttctactgaagatgtagtttgtgagctgttctttatttttttttttttgtttgttatccttgttgctcttactcttttcaggagaagacatgggaagatttgaaaccaagctatctctctgctttggcagataacatttaaaatcttaaaaactgcaaccttggtataagcaaaccagaagctagcataatggagtatcgcccctcactttgttctcaccatagatgcagcatatacaggagcaattggaaaatcaataggttctacagcagcgtcagcaaatgctgtttaaaaaaaggggggggggggttgttaaaatctttttttttttactgtatagaatatgcacaagccaagtttagcccattaaatgcacatttcctagcccctttaatatatgtaaatatatgtcttccttttctaggattctacactttataaaattactccagtaatctaagacactgattttcattgggggggagtttgggggtatttgcctctaggaacattggcaccacctagagatgtttttggttgtcagaatagttcagatgccactgggtaaagactaaggattctgctaaacatctacaatgcatagaacagtccctacaacaaagaattacttagtgcaaaagtcaatagtgctgaggttaagaaaccatgatctaagctaagaaaaaaaatgaagttataaggctttttataaagtaacaaaatagcatctgttaagtccttaggaagaaggcaagacagatttctgcagctaaaaatcggcttaaggacattgagaacttgcccaaggccacagagttaataaatactaaaacaccacacatgtaaattttgtatttctggactc

SEQ ID NO: 67065 - DNA, 1081 bp, Homo sapiens
tagtctttacccagtggcatctgaactattctgacaaccaaaaacatctctaggtggtgccaatgttcctagaggcaaatacccccaaactcccccccaatgaaaatcagtgtcttagattactggagtaattttataaagtgtagaatcctagaaaaggaagacatatatttacatatattaaaggggctaggaaatgtgcatttaatgggctaaacttggcttgtgcatattctatacagtaaaaaaaaaaagattttaacaacccccccccccctttttttaaacagcatttgctgacgctgctgtagaacctattgattttccaattgctcctgtatatgctgcatctatggtgagaacaaagtgaggggcgatactccattatgctagcttctggtttgcttataccaaggttgcagtttttaagattttaaatgttatctgccaaagcagagagatagcttggtttcaaatcttcccatgtcttctcctgaaaagagtaagagcaacaaggataacaaacaaaaaaaaaaaaataaagaacagctcacaaactacatcttcagtagaacaggtaaaactacacatctgaattacttgtaagtatcatacagaactcacacacctggtgtggtaaccacaaagcggagggaatgctggctgatggttccagatctagaatggaaagcaactagtcactccccaggagaggactccattctgaaagggaacagctggcagcaggtcttcagagtaaatagtaaaactagagacagaaaacctacatattccaaattgtcagtaagggctatccaagtctcagtgggaaattgctaagcagtcacaggaaaagaaagttttaggggttcagggttcttagaaatcttaagtaaatatttccttttgagagggcctcaccctgacagtaaacttctgtaagcacccagataaaaaaaattgcagaattttagtaaaatcagattctccccactgcccccaacccccgcaatgaaaaaaaaaactgcagaatcagtaggaaacaagaatagagaagatcagaaacaaggggccagtggag

SEQ ID NO: 67066 - DNA, 1129 bp, Homo sapiens
acaggcatgtgagccacctcatccagctgctgcttttacttccaataatataaagctttttcctttttttagctattacaaacaaaaacagcagtgagcatttttataaacatttgtttatgttaactatttccttagaaattttagagagtagaattaccaaatcaagaagttagtgtacctttttttaaggatctcagtacattttgccatatgctgctattaaacttgcgtcaatttacatttctaccagcaaattgtcatttttttgcatagcatatgcttatccatttccagaggcatattcacctatatcatcacctgtttctaggtttgtgtttcctgatttggtaaaattaggagttagctcctaatccatttgttacttgttttggtacctgatatgaaaaaagggtcaatgtacattttttccctaaatatttaactgcttgacaatttgttcacttgacaatttaaccactgcacagtttgttcagataagctttcctttcccctgctcatttatttaagatgtctgtcttatcctacactgattaacaatctcttattcacaattctaaaacccaaaaggttccggcaaccaatttttttcccctagatttaacatcagaactcattctgtggcaaacctgacctgaaatgacacgaggctacttaacagtctttatctcatttatagtaatgttgattagtctgctgttccagactcaactggggggcatatggtgcatacatttgagttattttttagaaatccaaaatattctgatttatgaaccccagctaaccccaaaggtgtgtatgatcaaagattttggacttgtattaaatgtacacacatatatacacactatatggtatgtgtatcgtctattctgtgccactgattaaatcattataacttttgtgtccactgttactgtttttgttttttcaagtattcacccttttatgcttcctggtgaactttagaatcacttgaattatttcaggttaaatttctattggaatatttgaactacattaatgtcataagctaattcataaagaagcaaagggtaacgatcatatggtatgtatcaaagtgttatagttatccctatcagaa

SEQ ID NO: 67067 - DNA, 1050 bp, Homo sapiens
aaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttactttcttcaagattcatagttaactaaccaggaactgctaagtaaagttgaaagataacttgtacttggagcttttatgttcaagagcaaaatcatatccccattttaccttaaaagtccacaggtcctgaactt

SEQ ID NO: 67068 - DNA, 1025 bp, Homo sapiens
cacctaacatagaaagcatgttctatcttgtctcattcaacattcagacactctggatttgtatcatgtcttttgccataaactaacattcaggtgccattgaagtatatttaagtaactttgggtttataaaacttgtctctacttctctatagaagtaaaattctaatagactaaaaaagtttgacaattttagtagtatgtgaaagaacccaatatactgttttaggtgacttactaagaaagcattttggccttgttttgagtttattttttctttctctttttcaacagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagaga

SEQ ID NO: 67069 - DNA, 1039 bp, Homo sapiens
tgctagaaatagttttgttttgttttgttttagaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagttt

SEQ ID NO: 67070 - DNA, 1048 bp, Homo sapiens
atatttggattgactttttcttaatttgttagccttgctgtttttcctaaaactgtttcagtttcgttttttttgttttgttttgttttgtttttggagagtggatcgtaaggaagagggattgttcatagaatttatttcaaagcagtaattaatttgtgccaaacatttgtttgttttgtgccaaaacatttcagagaaaatctttttttaacaagaattgtttttttaggatctgccataataattgcctctccagtccagcctgtactccaaggaatggtagggatgatcccagtatctgtggttggacagaatggaaataacttttctactcctcctcggcaggtaagatttatgaactgaaaatggtgtggtgatgcttttcaagcttagtgtaattaatggctttttctcttccaggttcttcatatgcctttgacagcacctgtatgcaatagaagtatccctcaattccccgtccctccaaaatctcagaaggctcagggactaagaaacaagccttgtataggtaccatttttaatttcattaatgttaactttatgtttgtatgttcatttgtttgcagcaacacctaaatgttttctttctgaatacctaaaccattttaaaacaagtgatcaccctacatttgctagtaacagatgtcataatgcagccaactgttactgaacagctttggttctgagaaaattgtctcctttgttgaatctgttagcttttgcccagtagtccttggtttgttctttgcagcttccctaaattaagtatagtccctatttttcccaacagctttcaagtgtttaatgaatgcctcgtataattgtatgagactttagagcagttcttcttgtagtttagtgtgtatatgaactatttggggattttgttaaatgcaggtactgaattgataggtctggtacagcacctgaaattcctcatttctaacagcttctaagcaatgccagtgctgctggtactggaccacacttgaagcaaggctttaaagtttgcaaattaccttcc

SEQ ID NO: 67071 - DNA, 2000 bp, Homo sapiens
ccatatctgtctacctgcctgatactttgcagatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaagttcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggtaactttaataacataattgaaatttgtttctctgggttgggatctaatttcttttgtatgtgatgttattgactgcgaagtaataactaatgagtagatggtatgagaaaagattctgaaatttgtgattacgctgcttctttatgctagctaattcaaaccttttttatttttcttaatctgctagtaagctatgggctttagtggtttttcttttttcttttcacaaatacttctcaatctatgtgctagtaagttacaataaacagaaaagacagactaattcatcacatagttgtataaaacccaatgt

SEQ ID NO: 67072 - DNA, 1112 bp, Homo sapiens
tctctgtgggaaggcatctctataattgtgaaagataataaaaaatgtatactttgtatattcttactcaaaaatgttaatatgtagagtttctaaagttaaattatcttctgttcatttttttaagaggtagggtctcactctgttacccaagctggaatgcggtggtgtgatcatagctcttgtagccttgaacgcctgagctcaaaagtttctcccacctcagcctcccaagtacctaggactactggcacatgccacctggctaatttttatttcattttatagagacagagtcttgctatgttgctcaggctgttcatgaactctcggcctcaagtgatcctctcacctcagccccccagggtgctgggattgcaggcatgaaccaccatacccagcccagattgcattcttaacgtaatgtcaaggcactctaatgcattattacattggatagaaacttcttaatgaaaattatgtgtgttgtgagtgtgtctacatgccactatttttctcctaaagcaaatcacagttgcttgcccaaaaaatgtgtgtgtttgtcttttttgtctgagagagattttttgccttttacctcataactaacttgaggtctgactgtaactaaatcatagtggatgtcagcaacaaacattttttgatggataactactttgttttctttgttaggagcatgcaaagttccccaaggtttgctggcagtcagagaggttggtatccaactttaaacaatgttcacaattacttcaaacttaaactatcagatgaacattttaattcattgtacacatgtgctaagtatatattttccttaaactactgtttttctttctttttttttttttttttttttttttgagacagtgtctcgctctgtcgcccaggctgaagtgcagtggcacgatctcagctcactgcaacctccacctcccgggttcaagcgattctcctgcctcagactcccaagtagctgggactacaggcgtgtgccaccacacccagctaattttttttgtatttttagtagagatggggttttgccatgttagccagaatggtctcaatctcctgaccccatggtccgcctg

SEQ ID NO: 67073 - DNA, 1051 bp, Homo sapiens
tgaagagttgatactctgattggatgatgatttccttaactactgggagcaaattaatatcccattgtttgccaagggggtctgtgtgtgctttggggcatgctttagttcagccaagcagttgacccactctgccttagccttccttcactagttaaggttgatgttcttgttggaattgataatgctttgattcccaaagggcataaattaagaattaagggagttcctgtctcaactttcatgcagagtaggtcttctgttcattctttttataaatcatttggcaaataaatgaagtatacaaatacatagcagtgttgtgagaacatagttttctgataacgcagtaagtgaatttataccatcaactgacttggtctttatggaagttatgcagtagagggacatagttatttatcattaatttattggttctcctgtaagtactgtgaagtaattatactttgttaaacactttattttactagtttagctagaattgtttcttgtgaaagggccacctgttctatgaactgtactttgtattgcagcacaacctggtgtttctgttcaaggctgccaaacactagagcattccacctaaggtttcaattgtgacatcagtacatgctacagcattttcaatagcagttttaaccaaaagtacagaatttagtataagtacctaaacttttattttttatttaggttacttacagcaagaaaacctcatttctacctgccagacttttattttggaaagttcagatttaaaagaatatgcagaacattgtacagatgaagggtttattccagcctgcttactggtgagttatttgttccttaagggaaatatttcatcaacacaagagactaaaaacatagtcataaaatcagcttatcagaaaaaaaaaattgaaattggcagaaatttggtggtttatattcatgcatgactggtaagacccaaagaagaccagcttttctttttacaaatttatgccaaaactattaaatgaattacaactttgactccgagagttagttt

SEQ ID NO: 67074 - DNA, 1023 bp, Homo sapiens
cttctaatattaaacattgaaatacatgtaagctatatatacatttaagatggattaataaaaacaagataattacttacccagttagtccagttcaaggttgcaggtagctagagcctatcccagcagcttagggtgcaaggcaggaactaaccctgggcaggatgtcattctgttgaagggagcactcacacgcccacgtacactcactcatgctcacactgtaataatttagacacaccagttaacaacgtgcacatctttggagtttgggaagaaacgtgtacctggagaaaacccatgcaggcatggggaaaatgtgtaaactccacacatacagtgtcctcagccagaaattgatttttttctctcatcagcagtataacaaaaacattgaacaaaatgatggtattcgaggacttgctatataatgatcagtgaacatgagagtagtcaactatttactacattattttggaacttttgggacaaaagtaaaccagaatacatcaaatctaatctaaaatgagaactcaagattgccaaagttggggcatgttgttaagagcagaagataatgtatcctagatattactattttgagatacattataacttaaacacttattatagaggtaatctagcttttaacagccccatctcatgtgtgtgctatacagaggtataatgttttatgaaatgccatgaattatctgtaatgattccaggttatgctagcacaaatgacaatatttttctgaaaaaggtttactgtgtatcactgtattctgtctggggcattgtttctcaacctttatttcattacacaactttaaggaatcttcttaggctttttttttttccctgaccctcctctcctccccacacgaaagtttaatgttttagtgtcatgaatatattgtatatgtttatatatcatgtgtatctgtgatttatgcataaaaagagggagattttcttcattcctccctgccccagaaccaattttcagcctcttagggc

SEQ ID NO: 67075 - DNA, 1050 bp, Homo sapiens
gggagtccccaaaactatcatctgtgaaggttttcttgaatagatttgttaccttctgtatgagacagcatgcagtaaaaaaagtagaaaccattctgagtatttaacatggaaagatttaatgagagaattcgtttacactggtgagagaaaagctaagacgcccagcagcttacaactaaggcatctcagtggttagcaacagtaggaagccactatgctaatgagaaggataaggagagaggaagcaatcaagaggctggtttgactgcggaacgtggaagacttgtctgatgagggagtggtagtcttagaggagactctactgaggcagaaagggaatgggggaaaaatatggctgcttcctcctgccctccagcctcccaccagtgcttcctatttactgagcccagccagtagcaggccgacagaagagcttggggaacattgcctatatagagtcaagctttatgtcatacagtagagagcgacagaagggtcaagaacgtgtttgaggtcaaacaggaccaaaactgacacacccctaacaggtcaagagctgctggttctattcacctttatatcaccaaaacatagatatttaataaaacatttgcaaaagtatggctctgattatgacactcctttgtttatttaataatatatgtactcattgctgtctaaaacttttcatgatccttacccattttgtcttttctgttgtatctccaactgttacccttcataaaccttgtgctgcatccaaactggacatgttccccaaatatgattgcatatatactttctgtcagcttctttgggattcccaaccatccttcagtactcatctgcaccttcaaacatcacataatttccaagcttagtagtggtttctccagcccctcccttcccatgaagtgagtcagctctattttcttaccatttttgctttgcattacagttatttgtgtatatatcttctatctccaagtaaattgtaactttatagacagaaaccttgtccctgttatttgtggatctagtaatata

SEQ ID NO: 67076 - DNA, 1043 bp, Homo sapiens
ggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttacc

SEQ ID NO: 67077 - DNA, 1050 bp, Homo sapiens
ccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattt

SEQ ID NO: 67078 - DNA, 1086 bp, Homo sapiens
ttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactca

SEQ ID NO: 67079 - DNA, 1081 bp, Homo sapiens
ctcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagtta

SEQ ID NO: 67080 - DNA, 1075 bp, Homo sapiens
atgaaggtctgcaggctgacccagtaaataacttccagaattctctgtcaacctcaactaaactaccctgaattatggctccaagtaagccaaagttttcagcttgtatttgctcagaacttataccacgaaaggtaatacaccaaattttattccagagttttaataaatctgacttttgtgagctttctaggtttgacctcttgtcttgacacaatgcaacttccgtaaggcatcgtaacacatatggtgtacgttccccatgtcgctgttggggtagaagctgagatagtatcatcagtaatggagacagctcacagttaggtaaacttgcaggatactttgatattaattgggttgcaatctgtagcctaaaaaaaaaaaaaaaggataatttgaaaactattccatcacattaacaaactaaaaggaaatatatagacatggtactcttacaatatcctaattagagaatcaccatcatttccatagtactctaaaaataaactggctgttaatagttactatgtcctacttcctaaattggcaggaaaattgtcaacgtttggctagctgggtaagctgttaagtttcccttaaacaaatattttaaaggatattaaattagcaatatttgggccaggtggtttcccagcactttgggaggccaaggcaggcagatcacgaggttaggagtttgagaccagcctggccaacatggtgaaacccagtctctactaaaaatacaaaaattagccgggcatggtggcacatgcctggaatcccagctactcaggacgctgaggcaggataactgcttgaacctgggaggtggaggttgtagtgagccaagattgtgccactgcactccagcctgggtgacagagtgagcctccgtctcagaaaatatatatatatatatatatatatttagcaatattttatttctgagttatcttgtacatccttgctctttagtcaccaaacgattcctctaaaacaggaaaacaaagaaacccaaaaaactgtttttcctttacattaattcagttaatccaataaacatttgctgtgt

SEQ ID NO: 67081 - DNA, 1042 bp, Homo sapiens
gacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatg

SEQ ID NO: 67082 - DNA, 1050 bp, Homo sapiens
taattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacg

SEQ ID NO: 67083 - DNA, 1253 bp, Homo sapiens
ggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaac

SEQ ID NO: 67084 - DNA, 1020 bp, Homo sapiens
cactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacat

SEQ ID NO: 67085 - DNA, 1137 bp, Homo sapiens
aatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatac

SEQ ID NO: 67086 - DNA, 1168 bp, Homo sapiens
gtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttatta

SEQ ID NO: 67087 - DNA, 1043 bp, Homo sapiens
atctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaat

SEQ ID NO: 67088 - DNA, 1070 bp, Homo sapiens
ctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacagggg

SEQ ID NO: 67089 - DNA, 1033 bp, Homo sapiens
aaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtga

SEQ ID NO: 67090 - DNA, 1081 bp, Homo sapiens
ttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttg

SEQ ID NO: 67091 - DNA, 1031 bp, Homo sapiens
atgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtg

SEQ ID NO: 67092 - DNA, 1048 bp, Homo sapiens
ctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctat

SEQ ID NO: 67093 - DNA, 1047 bp, Homo sapiens
cctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataa

SEQ ID NO: 67094 - DNA, 1051 bp, Homo sapiens
actttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttc

SEQ ID NO: 67095 - DNA, 1084 bp, Homo sapiens
cttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaag

SEQ ID NO: 67096 - DNA, 1020 bp, Homo sapiens
aacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagac

SEQ ID NO: 67097 - DNA, 1074 bp, Homo sapiens
gtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagag

SEQ ID NO: 67098 - DNA, 1053 bp, Homo sapiens
ccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcc

SEQ ID NO: 67099 - DNA, 1192 bp, Homo sapiens
tttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatc

SEQ ID NO: 67100 - DNA, 1037 bp, Homo sapiens
gcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaaggtgaggccggcgctggggagggggctcgggccggccagcagcggggcagcgtctcactgcggcgaggagttgcagagtggaggcggcggatctgtcaccgggacccggccgggaatgagaggtcacgccgggtgccacagctcaaacctctgcaccgttctggccactcttctgcttgccacactgttcctaaaaaaataatagaaatgcggccgtacctaagggtagggagactaatgctgtaatagctacagtcatattcatattaataatactgatgacaatagtggtaataatgacacctacatttttaagcactcaccatgtgcttacagtaattgtttgacttgatctgaggtatggatattaataatcctatttaacagatgagataattgaggttctaagaggaatgaaacttgtccgaatctttcacgcttagtaggtggtgtggaattggaagctagatccatgtctttctaatcccaaagcctttgcttttaaccatgaagccagactgcatccctcaacatcatctatgctccttcctgtggccacctcattttctccacaggcttcatgtccccatccaagaattggcctagaaaagctggaccgctggtctgtttctgtcacctatcatccccacattgtagctggtgttcccagatgagtatacctgtaatgatcactttgacctcctgacttcttcccccaacctccagactccacaggtctgtcaattcctcttt

SEQ ID NO: 67101 - DNA, 1026 bp, Homo sapiens
taggttgatttcatatcttggcttctgtgaataatgctgcaatgaacatgtgagcacaaatacttttcaaagtagtggttttattaataaaccctttggattatacccaggagtggagtaggtggatcacagaataacttgtctctcttcacatggttttccctctgtgcatgtggacccttggtgtctctttgttcaagtttcttctcataaagacaccgtttgtgttggatcagagtccacccctatggggctctaacttaatcaacctctttaaaggccctgtctccaagtatagttatgttctgaggtacgaggcattagggcttcaacataggaattttgggggacacaactcacttagcctataataccatcctacagggatcttctaaagtataattcttccctccatgttgccaggtttgcaagaagctcagtaccgtttggtgactgagatacagaagcagaccattggattggctttgcaaggtaaagatgtacttggagcggccaaaactggatctggcaagactctggcttttcttgttccagtaagtacattgtcattgggtcagactgtctgttatacaattttataacattctgtgcccagatgcagattatataaagagatgttttcatgttagatttcatgatagattggctagaatgcgagcttcatcaaacaggagccacatgtgtgtcttgttctcaccattttccccaggttctagcacagtgccttgcatgtggcaggcactcaataacttactgaatgaatgaactattgtgccttgacaagtcattacattcttgatggaagtggagtgctccagtatggcaggttaaagtggttctgtgctgcagtaggactggtgggagacagtttctgctctcacccttgtgagcctgccagtggcatttatacttgccaccttgtttaggataaagctgaaatatgctcagtttaaggagctttaggcatttgttgagaattttctgggacattgctatcggtctttt

SEQ ID NO: 67102 - DNA, 1911 bp, Homo sapiens
agatttgccacatacctgctgtccccatgcagcctctgccattatcaacactcttgctagaatggtggtgcatttgctacaatggatggacctatgtttttgcatccttatcacccaaagtctgttactttagggttcactcttggtgtggtacagcccattgatttggacaaatttatgataacatatgtctactgttatagtatttcacagtatattcactgccctgaaagtcctctgtgctctgcctattcatttattcatctcccctggcagccgctgatctttttactgtctccatagtgtcatcttttcagaatgttgtatagttggaaccatacagtatggtagccttttcgtattggttgctttcacttaatattacgcatttaagattgctccatgtcttttcatggagtgatatgatagctcatttcattttagcactgaataatattccattgtctggatgtaccacagtttatttatccattcacttactgaaggacatcttgattgccttcaagttttggcaattatgaataaagctgcaataaacatccttttgcagatctttgtgtggacgtatgttttcaactctttttggtaaataccaaggaacgtgatagttgggtcaggtactaaaagtatgtttttttgagacagagtcttgctctgtcgcccaggctggagtgcagtggcataatctcccttcactgcaagctctgcccctcgggttcatgccattctcctgcctcagcctcccaagtagctgggactacaggtgcccgccaccacgcccggctactttttttgtacttttagtagagatggggtctcactgtgtttgccaggatggtctcgatctcctgacctcgtgatctgcctgcctcagcctcccaaagtgctgggattacaggcatgagtcactgcgcccggcctcaagtatgtttggttttaagagactgctatactgtcttccaaaatggcagtatcattttgcatttctgccagcagtgaaggatagttcctgtggctccacatccttgccagcgtttggtgtcgtcactgttctggattttggccatctaataagtgtgaagtgacatatcgttattttaattaacttttgcctgttgacatatgatatggatcatctttaaattgttttttatttttttgagacaaggtcttactctgtcacccaggctagagtgcagtgtagcatgatcatggctcactgcagcctcgaactccctagcctgaattgatgctcctgcttcagcctcccaggtagctgggactataggcacatgccaccatgcccagctaacttttgtatttttttgtagagatggggtttcaccatgttgcccaggctggtgtagcatcttttcatatggttattttttttatctacatatcctctttggagaggtgtctgttaagatttttggcctccttcccccttttaaaattgggtgtttctgttcttattgttgaattttaagagttgtttgtatattttggagaacagtcctttatcagatgttttttgcaaatatttttctccattccgtggcttatcttctaattcttttgatagtgtgtttcacagatcagaaacatttaattttaatgaagtccagcttatcaattcttccctttgtggatcataacttagtcatatctaaaaccagttgacttgtagtttttggtttgtctgtccctcctccttttttctttcactgtaaacacagacacacatgggtgggcatgtatatggatatataatgtatagccccctgataaatagtaccaaactatctgtactattctgccccttacctctttccttaacagtgtgtcctagacatcactcctcagcaatatatggatagaatcttcatt

SEQ ID NO: 67103 - DNA, 1046 bp, Homo sapiens
tttcttaggtattatgttaagtgctaacaatactggaaatgtagtcctcaataaatattagtagaatgaataattgttatccaagctaagcagaggtctttataatctgatacctcccttaccctccaagaatatgggaatgaatataccatttatttccatgccgtatatctttgtttatgctgatctgtctggaatgccctccctgcatctcttcatctaaatctggggaaatacttactttgaggctaagttcaaatgttatgcctgaaagtccctttctgacactccctttttaaagaatcagttgttccctcccctaaccttctgaagtgttttgtttatatcttagttaataaacacttcttgaacactagccctgtgctaggaataaagaataaggatttcagagatgtctaagagaactttgtctcctctcttaaggagaagggactacggtctttgtgcatgtgtgcgtgcgtgtgcctcttctcctgtactatatttcagattcccaatgacttaatagggaatgtagtagatcaattctagatttacagcttttgcaataactttccatgataaatatgtagatgggtttctctctagcttatgggaagttaagtggtgatctgatgctgttgtctactgaaccttattttaccatgtaaagaatgacttcagccttggtgcggtggctcacgcctgtaatcccagcactttaagaggctgaggtaggaggattgcttgagtctagaagtttaagaccagcttgggcaagatggcgacaccctgtctttaaaaaaaaaaaaaagacttcagtttttcaaggaccgattttagattttcaaagcttccagtctcctgggagcattcctcaaggcaacttggaagtgtatcctgagcagtagccaacaacaaaacaataaacttcacatctcctaaagaagagttagttggttttggcatctaggtgctaggaaatgattctgaaagttctatttaaagttctgtttaaagtttctactctttagagtaggagatgg

SEQ ID NO: 67104 - DNA, 1043 bp, Homo sapiens
agatggactatttattcagttttacatttttgctctgttttctttctcatcaaaactggatgattgggtatttatcatatggattccaggattggtctaactggaccaatggttgcttccaatttcatgccacaaactcttctcaaaactttcccagggatgtgaggatctttaggcccgagcacagactgtcctgtttggcaggcttgctttaccacctgccctgtgtccacttcagcaagtggccccaagtatgaaagtgtacgctatcccttgcttacctaggaagtccccttggcgtttagttcttttagatttctatacatttatattttttgggtagctttgaagaaaatttttttgtttttgtttttatgtggtcactttttgtttcagctgaagtgaaggtttttatgtctttttatagcctagcaagaaatagatcttcttaaaattctatttaattttcataagatgtttgaatgtatgagtgtttaagtgttttttttttttgttttttttgattgattcatgtttatcctgtgggccatctttaaacgtggtttataataaaaatgcactcaaattaaatgtgcttcttttgaccagcatgaaagaagggagagaacagtataataatgaaagactatttaaaaataggatttatgaattagtgggttcaaaaataagtcttttaattgcaattaatgatgtagttttaaacaagcaatgcagttaggattaggttttgtatatgatactgtacatttagacaaacttgtttttagaactttctttcttcttggaactaactaaaatgggacatgggtagaatagttgcctgttctccatttttatgagggggtagatggtgcctcattggtctttaatgtattgagtacatggtttttgttttgttctgttttgttttttttgagacagagtgtcgctctgtcacccaggctggagtgcagtggcacaatctcagctcactgcaacctccgcctcccgggttcaagtgattctcctgcctcagcctccca

SEQ ID NO: 67105 - DNA, 1033 bp, Homo sapiens
cctaattctgtattaattaattttacctttctaaattccttttgatctatagcagttgagaaatttccctgtattttccttaaccagcacaccccttttaacaaaatgatctcctttagagataagtgaggccaggtatatgaatatagttttataatgctctatcctgtgatacattctgtcactttaaaaagcaattctctttagggcttatagttcttttggtacaaaaccaagctcttccagtttttataaaaatgtccagttgaaagtagaaaatatttgggaatggaaaatagacatcagatattctcaactttaaaaaatgtttttatttggggagggtaggggagggttgtgggtagaagatgggcatttatatataactatttttttcccccagaatagtagaagataaaataatttcagcaatattctaatttagccttatgtgcctggctacattttgtggcgctcagaaattctgtaacataaggagcagaatgtgattccactaggggacagcagaggccaaaccttagcattgcacactcactggcagcagcttagatcttagaaaagaggaagatggccactagttaaaatctgtaataacttctgaagagttcatggctggttgtgggagaatactggtactttatggaatagctaatgagaattttttaatagtgtctttaattggtttgtgaattgaaataataaaagtaaaaagacagttttcatgagcattaactttccaaggcttaccatgtgtaccttagatataagataggagcaatctttgttagtgaaaatgatttctttaattcctttagcttacatttgtgaaggtctgcagtctgctcctcgtagatagtggctgatgcttctttacgtgacctgcttttgttggtatctatgatttaaaggttgcataaaaggtcacagcaaatttattttgcatcttgaagcaatgaggagctgggggagagtatagccagtatggctgtaggagtagataaggagggctgat

SEQ ID NO: 67106 - DNA, 1050 bp, Homo sapiens
ggtgagggaagagaagtaacatggattggaggcaagcattttacttgaacagttctatttctttcttttttttttgagacggaatcttgctctgttgcccaggctggagtgcagtggcatgatctcagctcactgcaacctccatctcctgggttgaagcaattctcctacctcagcctccctagtagctgagattacaggcacctgccaccatgcccagctaatttttgcatttttagtagagacagggtttcaccacgttggccacactgatctcaaactcctgacctcgggttattcacccgcctcggcctcccaaagtgctggaattacatgcatgagccaccgcacccggccgaacagatctatttcttataactaatgcttcagaacaattttacttccaaggtgtaaataaaatccccaggaagaggaattgatttttttttaaaaaaagtatatattgggtgctgtatttattcaaagattaactttattatgatcctctagtggcttgagtgagaaattgtctccttgttatatgggtagagagctatttaagaaaatctctttaattgatttctttcttagaatttagatcatcatctgtggaacagcctaaaagtcactgggaatgataactagtgatgaaaatgatatgaggtgttcagagccctagttttctgttatcagagattaaaagccagtctctgacatttatggttagacaaaaatggtttccatgtttacctatgcatcactctgttaaaatgtaaaatgcagattgcattgatgtgttaaagattttgtttctttttgtttaggtacaaagaggatggtgaagctttgctaattttgctaccctcagaaaaagctatggtgcagcagcttcttcagaagaaagtacctgtgaaggaaatcaagtaagagctacttgttgtctttatgtttttaggaaaatgagggcatgaaattgtttgcttaattatgtgcacctaatttgccccttcccctaatttattcaactgcctggtttgacttttataaaaa

SEQ ID NO: 67107 - DNA, 1012 bp, Homo sapiens
acttggttgagctcctggagtaaaactcatgagtgtggggctgccttatgaatgggtcctcctggagtttttatttctcagacttgtccacattgaggctccagcaggttttatcaattacagttgagggtctctcacccaggcactgcctcccccagttgtttctgctcatgactcagctcaagtaagctgtgatccctgtactcacctctctctttcctgtgttgggactgtggtttgtcctgtgttgtccatctttatcatggataaaagaagagttttaaatttttttttccaatctgttcagctttttacttattgttatgatggagtgatgacttacaagctccatccatagggaactggatatcagaagtctgactcttttttttttttttttaaagtcttaaacggccttttctgaagactattagtggagaacatgagatggagaacttgttaacttcaggaagcactgatgattgaaagaatgaaatctcttggatggaattacttttggggttgtctatccatttcagagagttgtgatctcctgtcactaaggatgtgtacattcagcatcagtgggatccatcagaatcttacttgtattggcgctgttgaaacaccctggcttgatttgcctaaaaataatttggagagtggttagatttggggaggagagttgaggatgtagaagagacaaaactggctgtgacttggtaattgttgaggctgagtgaaagtctctaacttttcttttgtatattttgaaattttttataataaaaataagtaaaaacaatctcacctaccaccacctatcaccattctggctttgcagaaacaacgtggttcagcctaaaatcagagaaacaatgaggtctcttttgtgaagcctagacctctttaaaattttttttttctttccctgtagcttatctgggcagagttagatatcatctctgttatagtatgcctaatttctaaataaggaaatcactacaatctt

SEQ ID NO: 67108 - DNA, 1034 bp, Homo sapiens
tactgtgttatatcaggagaaattaattccaaaatatgagagcatcaaatggtaagctataccaagttggacttctataagctcactttacctgagaaccttttcattaaaggatctttgaacaaatggttaatattcatttttcttaaaaatgaataggcatgcaaacatgtacattttttttctagcaaacatccttcaaacttgcagttgaaacctaggagctttggaagtagtacacacatttaaaaatattagattaattttggtatgtcatgacttactgcatgcctaagaggtcattcagttatctatcagaaaatatgaaacattggaaagatgttttttcactggtttgtgcatacaacggatgagccttccagaacactgattatagaaaagtgtgttgaaataaatgatgtgatttattggttgtcacgcatggtttagcagaatggccaactgtgttgccagcagcagcaagctatctagtttcatagaagtgattttctaggttttgattataatctggatagaacaaaagtgataagcaactgaggtgattgcttgtggatgattgtaggggaaaaaattatttttaaactggtgccattcattgttttttatgcctatggagacagaaaatggtttggagattagttgggtagaaaggattagtgtaaagctagataaaacatgaagtttaggaagtatgcaaacaggaactaaatatactttacaaaagtcaacttaaaaaattacctagatgagttttgttatctgtgtatttgacaaactgataaaggatcaggaccctgtttatattctggtttgtgtaactctagtatgaagatagttttttttttttttttttttaacagaaacaaaatattccaagttaatgatgaattacttgaaatcataaaaaagaaaagctttagcaataaagtttttcctgaaatggttttattaaatctcaatatgtaaaattttatttaattgaaaaccttatcttttgatacaataatacaaaa

SEQ ID NO: 67109 - DNA, 1576 bp, Homo sapiens
ctcagtttctttgaaccatgtcagataggaaaagagcagtgggtccatgttatgatgttactgtttattcagagcaatccttgataaaatctaagattttatttcccttcgatcattgagaacttaatgaagctattagctttgatccaagctgggaaagacatgataataaattgaatattgatcattgatggagaaaacaatattttttaatttctttttttggtgtttggtttataaaatccatttttatagcaatgattgtgccatattctcttttaggaagggagatggggaccacattccagttctttctctgtagagaactgttttgtcctttcatggtcatgtcttctctggtttatttagtacttaacattttatgaggtactctcatgtagttagttaattggatccttacagcaactgtgagttaggcctggcaggtactgttatccccatgttataaggaagctgaagctgagagggttgaattggaaattggcaggtctagtacttgaactgttatcttgtttctggtccagtgctctttatcttattccatgttaccctcttaaagaaaaaatagtgtctaaaatgttttctgacaggtgttgagtgtattttgccttactttttggatcaactaacctgttagtattgagttgtatctcacaggaacattttctttaaaaaagctctaggaatctctgctcttgagaaactcttctatgacacctataaacatatcatcagtgttgagatgactgttttcacgtttttccatatttaaggtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacaggtaagtttactcccagtggagggtcttctattacattgtcttactatgtgcttattgttgccttttggggactgagagaaagtgaaaactaagaaacttagactgggtttctttgcaatgaactcttcctcctttcccccatacttaaacacagaataagtgccaatgaattttcatatttttcataactttgggagctctaagaggttaacaactttaatcttatttactggttttctgatgctgtgttttaaaagttgccaaagtcctgattaagtctcaaaggaaggcaatgaagttttttggtttatggcat

SEQ ID NO: 67110 - DNA, 1134 bp, Homo sapiens
attaagtatttaatgatcatttaaagcgtgcagaattttaactagctgtttattttgatttaagtagaattatttgcaaacattattaaaatggccatttatcgtcttgttgcaaagcttttaagaaacttaggtaaaacaagtgtttatagctgtattttactgaaattttacatgtaattttttggcacttctagtatgatgagcaatactataagtactctgtaaaaatgatttttgtcttgggcttgtaatttccttttctaaggaagaaaatgattagaatcaagtatgatcaaagctaaaattaaattgcaaaatctgtataaagtacagctgttgctttgaatgttgtggttgtcctttgagctggtgctgcaaggaaaaaaatgaatgttacagttaatggaaatgagaagccattttaagattctgttataaaagatttcatttgagaaactggttgttggagagtgtcattgttttcttctttgggaaacaatcaggaaagctaacctcaaaggttttttattttagtatgtttagcagttagtgatgctatagtacccactaccagcttatttagtactaaataggcaggtgtgatttaaactgaaagacagttatatagttgacttaaactgaagattcacttgccaaatgtcataataggaagataatgggaaatatgaatcttaagttatcttctaactagttattaggttattgaactactcacacaattatgctgtaaatcaatttcccttttgtacagaagttcccccaactctctttcactctcaccctcttcctcttgtcacagacccccttcagcagtctgataatgtctatggggcccttcttagagtaatgtttctaatgtgtaatatatacattggattagttggtaccacatttatagacttctcccacctgactttaatatattaactgcagattaagaggttttgttatggtacgaattgaattagatagacttttcttatatatatgaatttcatatatattttatatctatattgtatatttaacttttttctttttttttgagacagggtctcactgttacctaggctagagtacagtggcacagttatagctcactgaagcctc

SEQ ID NO: 67111 - DNA, 1033 bp, Homo sapiens
tggcttctttcagaagtccccttcattgcagcctcactaaagcaaataaggtagtgttctcatgtttcagaatatctgtctgtgttccttgatggttcatgatgcccattaggcttttggctagtcctatggtgaataaaatacagttcttacgttttagtaaattacagtcaacatcgagtcatgtcttgttatcacatacttttggtcttaattgaaggctaatacattatgaagttatttgggtagaattatctcttttataattcctcagacatcctgacacacaatctttcctgacctgggaaagatctgaaaaacaaatgcagtaaacccagaacagatgattgtagtctgagtctgtgttaaacttttcactttaataggttctccctgtggagaggacaggggaaggcgctgctgaggaaggcgctgtaaagtctcccttctctccccacaaataattcctcaaaccaaatcatcaacctgtctgcagtctccttcacctctgtcttcttccttatttcctctctctctgcaagaaatgtttgttctcttttccaagattcacgttgcatttcaaagtttccgacttacaaaaactgttaccaacttttgtgtatctgtctgtgtaacataagctacacctgttaattataattttatgtaattatccagctaaaaatatttactgttaaccatatttttctagttttggagactatttatgggatttggaaacagttgtgtgcacatgtcacacttctatttattatgataatttccatacttatcaaggttcctaggttgcaatagctagaagcactgtggccaggagtgctcccaagggatttcctgtaaaagcacagttaacttccttggtgtcaaccttaaaaattaagccaccttaataatcaagcttttttccatagtcttgtgattacgcttagatgtgactagacccttcgactacatttttccagaaccacttgttggttgtcctcttgaaaacttttttccctctgaccctaat

SEQ ID NO: 67112 - DNA, 1154 bp, Homo sapiens
aatgaaaataattttcgagttctcatcacttctgcttttattatggagtgtgttataatctccaaggacctggttagttttctgccttttcttttcctaatggcaacagtacaagcatccatcaaaaatgagaaccagggcatgagcggatctttttcaactcagttgattactcaaagcagggaagttgtaaaggaagcctgcctctgttttaaatgttagaaaaatgttaatattacttgtgtttttccttttggagaacagtagtagtctagaggcagcgcctctaaattttttttgtgtggcctatgagttcgttttgtgtggcagtaactatttgtggtcctctttgattcaggactctctaaatggcttttaaagactttaaacttcaaatcttttctattacaacattcccttggtttcgtatgcagttacttctggcttggtgagacagttttcctatcattgtgttgtcctcagtgattattgattagaactcctttgttagctgggcagctcagaaaaacatgtggggatcactgtattacagagacaaggattgtagaaaaagggtcaattataaatttgaatttgttttccttgtaagacatttagtatccctaatgatggtgtttctactccaacttacatatcttttggcctctgccatttgggtcaccagagaaagtatcttgtaagaagtaaaactaactggtagcatggagagctgtactgtatactcaatttcctgtagtgtacattatgtggaagaccatacgttactgccatgggagatgtattaagaatggaaaataaggtgtagttgtaataaatcattaagtaaatttatataatattttctacactaatataaatatgaaaaatcaaagtttgagttactgccctcattaaaaatgagtacagttgacatttattgtttagaccttgatcaaattgctatttaagcttctaaacttttaatttctattgtgatctaatagctgacaggaggaggttgaactagatctcttaactcccttccttgctctaaaattctgatgccttggggtatttttattctttatggtttgatatgattcccttgttattgaatgcagtgctcaaatacagcattgacaaaacaggcatct

SEQ ID NO: 67113 - DNA, 1007 bp, Homo sapiens
ttggatagaatatttatttttctatttactgagtggtagatatgatagtctgctgaaagggttaggtcttggcttttgtgatctcaaccatccaaagaagttctttaggagaactctgatcacttcacatctacaaagtgttctcctttttcctaaatgtgaattccgaagtccttagcatgctttatgatctgattcaaaactaaatttcttattctccctttcaccagattctggttcactcgtcactcactttcacccctccctgcatccccatcaaatgactgagaattttccagatgtggcatttatattttggccttgtcctaacataacaaacaatctctcttcctgtgataccatattcttgtttctttgtatcgagtggaatttcactagttgattgcagcctttgtctgccagggttcttcatctgaacctcactcagacaatgattatttgagtgactgttttcttagttttcccaaggttggtacatgaatgttaacattctagatgtggaagaagttaattcatgaccttcaatggttgctttagggcattaagtgttcattttcttgcagacttcccattgagaaaggtctagtctgagtttgtttccttcttttgaccttgcgcagatttcatcctcctctggaatgtttgttttattgttattacttgtttgtattatcagcttttccaccagactgggcatctggagaactttgtcttatttattcttacatcccaggattcagcaccatgcctgaaacagagttgatgttcagtaaatcttagtggaatagattatgttgacttcctaaaactagttcagcatgacatagttctagttgttcatttccctttttttgttgttgttaagagatggagtctgtctctctctgttacccaggctgaagcgcagtggcaccatcatagctcactgcagcctccaaagctcactatagcctccaattcctgggcttaagtgattctcccacttc

SEQ ID NO: 67114 - DNA, 1034 bp, Homo sapiens
acatgcctgtaatcccagctactccggaggctcaggcaggagaattgcttgaacccaggaggcagaggttgcggtgagctgagatcacaccattgccctctagcctgggcaacaagagcgaaaaaaaaaaaaaaaaaaaagaaaaaaatctttgtttttcctgatctttgctgtttttcttcattatatctctgagacatacatatgtaaatctaattaatctattgaattcatgtgaaatatacttaaagtgtaattttatgtcctttttttagataagtaaatttcagatactacttttagcagaacacattttttaatgtgttggttataaagtgatctgtaggtaaaggaatctgaaaaagcaaatgctcatgtgttagaaatgagtacctttagttgcctctggactgttttctttttgctatcctatgagggttacatgaaacaatcccattcctttgacatttcctcacttttgggttctctcatcccttttagagtaaggcactgctgattaggcctgtttccagggcaatttcttgctgctctcttatttttagttttgcttgttttgttatcataggtttgaaatgtaagtaagcggctcagaatgacctggttcttgtagctaattcagtaagcatttattgagggcattgtacatcagtccaacaaagaaagaacacatcaaactagagagcagttccaagtcaacttactggtaacctgttgtataaaaagttactacaaggccaggcatgttggctggtgcctgtaatactagcactttgagaggccgaggagggaggattgcttgagcgtaggggcttgcagtcagcctggtcaacatattgaaaccccatctgtacaaaacaataaaaaaaatttgccaggtatgatggtgtgtgtgtgtggtcccacttagtttgggaggctgaggtgagatgatctcttgagcttgggaggttgaggctgcattgagccgattgcacaactgcattccagcctgggtgacagagtgagaccctgtc

SEQ ID NO: 67115 - DNA, 1089 bp, Homo sapiens
cagtgctgagaaactgatgtaagtgaaaggttgaccttctgtatacacaggttttatatcctgcagattccgtatgatttggtttgaaacaatctgtgtataagtggaccctcaaaagtcaaaaccatattgttcaagggtcaactgtgtacttgtataatgtcataattaagagcttaaatttaatgctatcatgtgtcccatttgtataaatggatatataacattctattcagagaacccttattaaaatgctttggatttcttttgattttttttctaataaacacagtgataagaattctttataatccttaaatttctggaaaatgtaaaaattgatgactagatattcattctagtattttaaagtaacccattatatagctaaattttagactcaataacactagattgaaatctggaccttcatcatgaaagtcagaggatgaggaagagaattccttgaatgagtaacttaaacagttttcactgcctcaccttaagttttcttttgaatctattcaggtcaggtttttgtccctgccaatctgttgaaacttttcttgctatggtctggaacagttcccattttgctaaactcaaggatgaacatcttaacactcctagcaactttttttttttttggaattgccctcttcccttagcttttggcatgccatactattcctggatttgttccagctttcactggttgttctttcttggttgtctttgctggttcctcctccttttcccatctttaaatgatgggggaatacccccaaggctttgccttatattctaatctccatctacgtatgctccctaggcaaatttagtaagaccttttctttaaaactcatatgctaatgaatccaaatatatgtcctgagcctgttctactattgtaaacttcttttaactagttgtttaatatctcttggatatttaataccatttattcagtcacttcggactcagaccaagaacccgtgagttttctctaaatcttttatctcccagatctacccctttaaggagtcttgtgtacttcaaaatatatccagactctaccacattgttcac

SEQ ID NO: 67116 - DNA, 1035 bp, Homo sapiens
cactgcaacctctgcctgccaggttcaagcgattctcctgcctcagcctccccagtagctgggattgcaggtgctcaccaccacgcatggctaatttttgtgtctttagtagagatggggtttcactatgttggccaggctcatctcgaactcgtgacctcaagcgatccacctaccttggcctcgcaaagtggcatgagccaccgcacctgtcctgggacttttaacttagctcattatcaccttgttgcctcccctatgtgatcagtttcccttaaccctgttagccaaatgaccatgtgacacaagttatctttacttttaatgttactgctttttattttttatttttatttttttgctatgtagcatataaaatttctgagttctagaagaattccaaaagctgtagagatgagaaattgatatagccaatttggacacaagttaaaaatgaaatcaatactgtcatttttttggaaatctaaaaagagagggaaaaatgtatcaggcaccgtttctctaaattgcttccagctgcttgcttcctaatatagaaatatttattaaaagtagcaggttaaaaattggattcctacagcaaaatatgagtggtttcataattttgttaaacagcaggaaataactgagatttttgtcactatagtggctttgtttttttcgagggtcatggtgtagagcaaatacatatttcccagccaggcgaacagaacagtaaatggcctgaacaatttaaacaaaccaaggaaaatgtcctaaggtagtaaatagggaattatgggattttcccttaactattgtaacactataaatgttcaaagaggtagaaggaaccatttaagacaataaataaatgaacatgatcataaaacttagttgggaatgaggcttaagtaaggaaaatggcatgaaaagaaagtcagataggggttgggtgaagaacagaaatttacatgttatctagactaattgcaggcacagtgaaagatttaaataattattaggccaaaatgc

SEQ ID NO: 67117 - DNA, 1031 bp, Homo sapiens
cactgggtaccatggaagcccaaaggaggtacagcctgtgtcctactcagcccgactcctactgtgtgcagataattttgagctgagttgtgtggagaataggatactaagaatgctgtttggaaagatgctggagcatctctattttgtgactgccttctcttccaaattatttggtgaaattttcttttaatcctgttctcattgggtatggcagtgttactttactctgactagggcagtctcttctatggcttgaagttgattagaagattaaataatacagattagattgtaaggcagaaaatgggtatctgcaccttttcagaatcatcagacaaaatgaagtgtctttctggggtattccctacttcctgttgacactgaccttttttttacctgtagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggtaagctttccatcttgaattcatactgagtaaaatttagtgtcccgaagtatatctaaatattcattagctattcattaataagtgtattattttcttcattgttttctctgacacttctttttctgtggctactcttttttctgtttatttgttcctttgctgggggagtctgtatattgactcgtttctgagaatgccacttaaatctgtctttggtctgaggtgatctaaataatattagtggatttgttgttattattacagtttttattttgagataattgtggtttcacttgtagttgatagagatatcccaagctctccatttcaataattttgtcattactggaatgttttatataaaactatgcagtatgtagctttttggaattggcttttttcactcagcattattctatggagacagagccaagttgtgtgcatcagtgctttgttccttt

SEQ ID NO: 67118 - DNA, 1583 bp, Homo sapiens
tgcatagccagagtaagtgatatagaactgggatttgattccagatctgtctgacacattcttaatgattcatgaatacttgtgccaatcccatagtagtagtcagtaaatatttgttgaaaaatgaatgtcatatattagttagctttaggaaataaaactgtaatgaatgtgtagtctgttttatacctaattatatgctgctaatttttctcctcttccttgtctccaggagaaaagactgaaagaaagggaagccagaagagaagccaacaagagacaagcaaaggtaagggtttatatacatttatttttccaagctctattaaggtagaatggacaaaagcattttatattttggcaagaacaatgcttataatgttaaaatggaatttaaatcctcttcttttcaacatggattttatatattatttgtatatcatgatattccaattggattcaagcccatgtggccttctattcactttcttgtattcctctggtgcaggacgaaaaatccctaagataatttgttactgggcttggccccatttactccaccacttttttccatatattttgcatctattaaatacaaaaggcagttgactctgtgggccaggcctgataggattttcatctgtatcatcttcaggtagacagcctgtgtgaacccaacctcataacaggtaactctgaaagcatcagttcagctcttagaatctaggagaaaagcattctgtatctcccacttttactatattctgtaacagatacttttcagcaaatacatatgtacagttttcctcaagtatgtatgtacaattataaacactgtccatgtgcagccatgatttttatctaatgtgtttgtcactgagaagtgttcagcttctgcattctgagaacatttagtagaaatgatttcctagaactagggcccaataacatatgtcatttctcatgctgtatctcattgtgctgtttctgactagccatgatttcttcttggcagttagcaaagctccaactcccttgaggaagcctataatattcttcgtcattttttttccatgctggccatagcacttaagagagcaagtcagagatgataactcatgctatagttctgaagtgggaagcaattatttaatactgaatataagcagaaaagactgcttatattaaatataagcagtattaaatatcactctgtcttcaaaggtgcccaaaaacgagagctccagtgtgtgcagcctgactgctaaataaggtggaggcttctgcatatgctttaacgtgcaggcgtgaaacaccatggcagaaccaccactagatctcagaggctgtagtgggaaagatttaaatttaacaagaaaatcttaaatctaataaaagcatttgatatttatgaatattgcatgttcagcataaaataagcccattttatttcactaagaagctctcatttctgcatatataaatgtaaaatgaaagatataatctagagccaaagaaagccctgttactgtatttcctttgtgtttattcatgcatatttgtatatatattactaaatatgg

SEQ ID NO: 67119 - DNA, 1944 bp, Homo sapiens
ttagtcagattccaggtagagcttccctttgatccctgaacctacaagctatccagaagatattttaatggtcaaagaaggtggtacttgcagacttaatttaccaggaaatgtagtcatagctgtttatagctattttaagcaatcactgcatagaaactgaaagtgtaagaaagggaggactcacgtagctgtctttctaccttgttttgtgtttcatgcagcaaacatcattttattatacaaggaaggatataaaggacacagtattttttttttaattttggggaaagtgcttgaatgaagtttcatggaattatctttatttcccagaaaagagaaaacttaatgataatgtgaattttcaattttagaaatgaatcttctctggcatattgaaagtacttctaagaaaaattgctttaaagtgtgagtaggataaactaaagttggaatggacctctcaggaatctgatatgactttttgttaaaagatagatctaagttctgcctagttatattatgtgcagaattgggaatggaagataaatacgaagctgaaactgttacgaaggtttgctgggtacctaatagtggtttgggaaatataggtcttttgggtatcaaaactttctttagcagagaagtacttgaattgcacaatagaattgtttttactttagctaacaagatgtcgtatattcttatgacctacagattttaaactaagatctagaaaaatacttgtagcaatgatcaatagaccacattgctttttgagttcaggtaggttacataatcctggaatacagctttacctcattatctagctaaatttccttttgctttgagggtcacaagtgctagtaggaatccctggtcgctggaatgattttgtataaatgtaaggaaaaggaacaacagtgctgaaacttgaggaaatagatcctcagcaatatctcactactgtgctgcttttgaaaagaaagtgtgatttttatttatttatttattttttaagatggagtctcgctctgtcaccgaggctggagtgcagtgacgcgatcttggcccactgcaacctccgcctcccaggttcaagcgattctcctgcctcagcctcccgagtagctgggactacacgcatgtgccaccacgcccagctaattttttgtatttttagtagagacagagtttcactgcattagccaggatggtcttgatctcctgaccccgtgatccaccctcctcggcctcccaaagtgctgggattatggatgtgagccactgcaactggccaaaagtatgatttattaaacaaaagtctgaggctgatgaaattgaacactgactatgaaggaacaaagagtaggaaagagctcaaacacttaaaatagttaaaagttgctttgactatattaaaaatgatgattatagttcgtatttttaaggtgtggggaaaatatgtcatacattttgaggttgaagttttatagatgtacattttcacttgtttttattttttggtttgtactgtgtttttatttatacttaacaaatagtggttttaggtaatagtttcttgaatacctaaggtaatctctgtacaacagaaaagtagtgttgaagttagagctctcagaataggaggtctgaagaagtagtagttaattaattttaaaactctaggccgggcatggtggctcatgcgtgtaatcccagcactttgggaggccgagatgggtggatcacctgcggtgaggggttcaagaccagcctggccaacatggcaaaaccctgtctctactaaaaatacagaaattagccaggcatggtggtacccgtctataatcccagcatactcgggagggtgaggcagaagaatcactttaacctgggaggtggaggctgcagtgagccgagattacgccactgcagtccagc

SEQ ID NO: 67120 - DNA, 1069 bp, Homo sapiens
acactcctgctatccctatcatccaagtcaccataatctgtaacatgaattactaattgtaacagtcttctaactagtctgctagtcttctttctcttatcctcccactcttctatccccagtttattctgaattatagtggccagaatgagcctttaaaagtaagtcgcatattataattctgttcagacccccatcctttaagagtttccctgtctactttgtcacaaaagctacaaagttcacatgtgatctagcttccagctccttctctggtcttatttcccactgttctgtcactaactctcttaactttagactgtctaattactcctcaaatgcactaagcagattctggccttcgctcttggtatcaccacatagctatgtgatttgtttccttactgtctccagatttctgctaaaacataactttactagagaagcattcactgatttcctgatgcaaaatagcaacctcctcttatcctgtattctcttaccttgatatatttttctccatagtacttctctctaccaggcaatatataaatacatactagtttgttgttgcttgtttttactgtcactagaatgggaaactcagaacagggactttgttctgttcactgctgaatcaccagtgcctagaccgatacgaacaaacagtaggtactgagtatttatcgagtgaaagaagcagtaactctttaatacagtttcttgttttcactgtgacacttccaaaatagtgtcaaaattgaagaattatagcatattgtttattgaaaggcataataactctagggatgtttcagaatcctttcagaggcagaacagtaaaacaaaataaagagggggagggctagaaagcaatgttactggacccagatagatattagcacacatggacaatctctaattatacactttgtgtccaagttcatatgtaaactggagcattttttttttctccatagaaaagatgttctatactgtggttgatttccattatcacttaggctgcccatgtaccatacaagcatgacacttaggtgagtgaaagggg

SEQ ID NO: 67121 - DNA, 1044 bp, Homo sapiens
attcacttccatttggcctaagcagtcctcagcacagtctctgtcaatcaattggaactggtacggaaggtaaaacctatttgccattcctggactagcaggcaggatttggagtaaattataagtagtagcctacatctgtaatttctatttatactttaatttccatttttctcccttttctgtggtttatttgcctcaatggcaatgaatcaagatgtatgtaaactaaaaccaaaattgttttagataaagaaaatgtatttggaagattgtatatactagaattttgacagtggtaattgctgttgctgctagcatttgcatagtagcgccagtaaagtttttctgtattcttccagtttggctacacactggaagcatacagcttccatctgcttatgcttctcataagctgtatgattacgtgctaagatcttatgatgtcagctttagtgagtcctcttgacatgttcacaggttttacttgctgtgctgtctctagccctctactcagtaattgaggcaatggctagtactccagcctcttggacatcatcacatctctcagtaggttattctctggctatacacttagcattttcagagacgaattcactcttatgggactagatagaccaattggaaagtagctattagtcctggccgggcgtggtggctcacacctgtaatcctagcacttcaggaggccgagatgagtggatcacgaggtcacgagatcgagaccatctggctaacacagtgaaaccccgtctgtactaaaaatacaaaaaattagctgggcatagtggtgggcgcctgtagtcccagctgctggggaggctgaggcaggagaatggtgtgaacctgggaggcggagcttgcagtgagccgagatcgtgccactgcactccagcctgtgcgacagagcaagactcccagagagagagagccgagcacagtggctcacgcctgtaatcccagcactttgggaggccgaggtgggcggatcacaaggtcaagagattgagaccatactggcca

SEQ ID NO: 67122 - DNA, 1096 bp, Homo sapiens
acaacttaatgcaacagatattagaagcagtacctggtgtccagatagctgttagcttgcacactgctacctaaagataacctgactttcagtagaggtagtttggtgtggcaggacaagcacacactggagcgagacatacctgtggtgcatctcagtgtcctcaaattgtggatgatacagctgtaacttcctagaatgattgtgaagattggatgacccagtgtgaacaaagtaccttgcatgtgcctggtgcgtggtaggacctagctactgatgggaaggtacttactaattatacagatatcttgatgttgccatggtttccttcattcttgaataatatcactttaccaactctctgttaattttgtcctattttaaatgtttgatttcatactgagtctaaagtaaatctttggatttcttctcaccagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataat

SEQ ID NO: 67123 - DNA, 1048 bp, Homo sapiens
tgccctttgttgggtggctatggtcaacagagccctctccccttctgatctgtagcccactgacctctggctgtgactggatttaaagatccttgttaaaccattatcaaatgcaacatattaaactacagtaagctctctgagaaagacgttttgctgaagacttttgggccactctcttgtaacttatggctccttagagacagaaataaaaggtgtgaacaggcacctcttgaaggctgaaggctgggagatcacataggtggttgagattcacattaagtccctcttcaccttcactccccaacacagggcagcccaaagagaaatctcttggatcctcttgatagaggttgtatcctaaacactgaagatttccttcccccaagctcattagaatatatggaagattagaaaatccaattaaaacaagatcccaaatggcattgtcttaatgtgtctgagcttgatatcaggtaggcctgaggagatgggatctaaattctattctgtttgcattcttatgtgaacattgctactttatttcacagaccaaaatatcttttatagatttccagcatggaaaacagtgtactgtgaaaatggatgcagtttctagtttatcttctcttcactgtggccatagaggagaaaatgtacacacacagatatacacagacacacacacacacacacacacacacacagagcgagagagagagagagagagagagagaattaattgatatccatgtaaatatctattttaaaccacacagatttccaaacccacccctcatccttggttctgattctggagcagaattgttagtttgggggtgtttatgccatgtgattagctcatgctgaagggtgacacatcctggcggcaatcagataagtatccaaagcctccaatgtgctgtgcagaggaagataccaaagaggccggaggtaaggttggtccctgcccttatagttgagtttgctgacaggattcactgactggaaataatgagagagctgcaggatgctacctgtgtgatcc

SEQ ID NO: 67124 - DNA, 1104 bp, Homo sapiens
gagatgggaattagaaggggagaagggatgtagaggggagagatgggagatggtggggagagtgggagatagagggagagatacgagatagagggggaggtgggagatagagggataggtgggaaatagatggggaggtgggagataggggtagagacaggagatagagggggaggtggaagataggggtagagataggagatagaggggagagatgggagatgggggaaggtgggagatagagggagaggtgggagataggggtagaaataggagatagagggggaggtgggaaatagaggaggacgtgggagataggggtaaagataggagatagaggggagagatgggagatgggaggaggtgggagatagagggagaggttggagataggggtagaaatatgagatagacggggaggtgggagatagaggggagaggagatgggactgggcataaaaatgagatgctggaggagataagagtgaatgggatcaagagcagttagaagtattagtcttggcagaaaagcaggacacttctcagatatgacagtgaaagaagttctggagatattttaatgagagctaggaaagctgagggaatttgcattaaattgtgtaagcttcatagtgaaagtaaaattacctatagaaagtgaggtggcacattggaattaagtgataaggaaacaggagtggctgctatgggcagtgccattcacagacactgccaagagagctgaatgaaagagttctagcgagagggagggccctgctaggattagtatttgatcttaatagtttgtgtttgatcttacattgaaaggagctcagggttattttatcattctatttccatattttaggatacttagattttctggagaaagtcttgggaaagagatagcattgcttagctgtggaagggtcacatttgggtggcaaatgaggttctaggatggcaatgagtgcattattaaagtgagatgtgggcaaatggtccctgagagggggtgatggactgggaagttaactcagatgaggaaatggagatcacaagaggctagagaggtggagtaaaagtccgggaatggagacactg

SEQ ID NO: 67125 - DNA, 1051 bp, Homo sapiens
tcacccacgacatcaggcatcctgggaagaagcagagctgtttctacagtgctcatttttcagagagcgcagtgccacctgccatcttcctgtatttccaatttcgcattgtccttgtctgtttgaagatggggtatgtgaattccagatgagcttgtgctggcttttaaaattcacatggtttgaggagaaggagcagtgacagctgattgatgtagaaatggcttaggaagccaggctgaatcagaaatcctgattccaatgaaatccccctcttggctgagtgctggcttgtcaccactgagacagtatttcaaagtgatttcacaggtgttagttcattgactcctcccaccatctcatgaaagaggcaggggaggaaagagtaagtccacaggacagaagaggaagctgagagtttgaatgtttttgtgacttagacttggcccaaggcaagttagcagtgaaactggcataagaacctaattctttttccactgtacctggagggtctaaggcctagggaaacattttttaaagtctctaaaaagctccttaggtggcatagtatcaaggaacttggaagggatcagaaaattaacctcaaattatctggattttaaagcatcaatcaatgtacctttttattaagttcctagcattgtatttggcctacagtaggtacttagagatgagagcttattcattatttcttttttattttattttattttattattattatactttaagttttagggtacatgtgcacaatgtgcaggttaattacatatgtatacatgtgccatgctggtgtgctgcacccagtaacttgtcatttaacattaggtatatctcctaatgctatccctccctcctcccccaaccccacaacaggccccagagtgtgatattccccttcctgtgtccatgtgttctcatcgttcaatacccacctatgagcgagaacatgtggtgtttggttttttgtccttgcgatagtttactgagaatgatgatttccagtttcatccatgtccctacaaaggac

SEQ ID NO: 67126 - DNA, 1099 bp, Homo sapiens
ttttaggctcatctgccttcatctggctattcaaaatttctcaagactcaaatctgggtttttaaaatcattcactagacttatgctcacagctttaatttccatgtatatgctgatatctctcaaatggacatcatctgccccagagtttctcaaccttgacacttggagctagatgattctttgttttggggggctatcccatgcattgtaggatgtttagcaacatccctggcctctacctactagacacaagtaacaactgctccctcctccagttgagattaccaaaatgtctccaaacattgtcagttgtcctctggggggcaaaatcattccaattgagaatcacagtgcttccctgacctctttatttttcaactacctaatcaacatttccacttggatgtttcaaatacacctccaatttacccatcaatccttgtccttttctgagaatcccttcatctaatgtcttaagacagaaaactaaaagttaagcttcacagcttcctctccttctccctcaccaccccagtatctattatcgagttcagtctatttagtctgctaaatatctctcttgaatttgttcaccttcttcctctcatcttttaactctttccaaatgatcttgtttttattaatgtcatcactattctttccttccaagctcgaaattcttggaaatcattagaaattaaaaaactcttggctctttcctttctatgttcccctctaactgctctgtgcaagttttattatttttctccttaaaaaaaaatcttccaaattttcactttcttggtactgacccttgccacttcaaacttgaatatcaatagccttctcactactttccctggctccagtctctcccctccccttctaatacagctataaaccccaagatatcttgctgaaattctctccattattttaaagttccatgttcttattcattcctctactcaataaccaaagcatggatcctgaatttttctttgtttagattcttcagcttgattttttatagttgttcctaatttgatacctccctatcagaacctattactaacccccacccaaatatgtcctc

SEQ ID NO: 67127 - DNA, 1047 bp, Homo sapiens
agagacaagtttcagaataccagtaagccagatctctggaaatagtagtccctttataggaacaagtggtccagtctagcctagcttcctttggcactggccagttggtttgccattgagagcaagttctgaatggaataccataccacttttaaatcaacaaaatagtggtggctaattggtggcaaagcaaataggtttaaagaaagtgacaagccattcttatgattattgatgtaaaaattcttagtgaaatatcagcatatgtaatcctcctcaaagtaatcatatttctctattggctaatctattagtataattcacaatataagttaaaaatttgtgattgtctaatagatcattttaatgtaatccacatttctaaattttttctctaaatcttttatgtaggagaaaaatgtatttctgtaaatgatttttcaaaggctgtatgtagtgtggtatgtatatgtatagatgtatataaagttataattacatatagctaacatatgaatgcttgctatatgccttgcactgttctgagagttttatatttattagctcattaaatttcaaacaaccatattttatccttttttcaacaattgaggaaactaaggcatggggaggttaatttgtcccacatgagatatatatatatatacacacacacacacatatatatatattatatatatacacacacacatatatattatatatatacacacacacatatatatatacacacacatatatatattatatatacacacacacatatatatacacacacacatatatatattatatatacacacatatatatacacacacacatataatatatatatacacacacacatatatataatatatatacacacacatatatatattatatatatacacacacacatatatattatatatatacacacacacatatatatattatatatacacacacatatatacacacacatatatattatatatatacacacatatatattatatatatacacacacacatatatatta

SEQ ID NO: 67128 - DNA, 1055 bp, Homo sapiens
aatgagaactttcagaaaatttggtcactcgatggaggaatttcagtgtgtgcaataaatttctagtgaatagccattatgttgtaaacctgcattcagctagtacaaagtttctttttgataattaaaagaattagctacacttcatcatcatctacaaaattagcatgaacatttagttctttttcaacaaataatattatttaattttcaacttgccttctagcaagaaaaattgagtttccaatacagtatctggaaggaatttatagatttataattatagaaatcttcacaaatcactatatatttgcccagttccttttgtgttcaagaatatagtgtctttaggtcaattacagtggagccctgataatacagtttaaaaattagctgcatttcttggagttttttgataactatgggagtaaaaactgacctactttgtgaaacttggactatgctgcttcatgaaatgagcaaaattacccttatcagttaatatttcattgattaatttaagatggtttatatgagtttacgttttagtaaatgcaaacttaaaagtctaataattttttaagaaatgaaaagtattttctactttacatgtaataatacattttgtgttgttaatggtcttttccgttcttttaaaagttatattaatcatttttaaagaactgaacgaaaataaagattatataccattctttcttcttaagtttctcatagtaatttcttgtaagttttacatatttcattatattaacaaatactgcagcctatttaaataccttgtttttaaatctttatcatgtagcttttcattgaatgatttcaagatattgccaaattctgggttgtttttaggtgccctattaagtaagggcaatcgtttgctaattacaagtgggtgaggaagcattctagagatcaaagttttaaaaaccaaatctttaccatttggatcaatacaaatcaggttatttcaaatttgtagtatgtttataggcatagaaattgaactcatttgtccctatttgtactgtttc

SEQ ID NO: 67129 - DNA, 1050 bp, Homo sapiens
ttcgccaaattttacatttatttaaatgagatcttaggtgagatgtgtgtgacactttgaatttgaccttcttgtgttattagctgactatttgtcattgcctcatggattttaaattatgggaaaatagtgtagccagctgccacctctactgaagtgagtagctctgaactacccacactaaatccttcagtgtaattaattatgagtttaaaaatagcagttttcttatgtgaagaggacagtttgtcccctttttttgaagcaccgatgttgcgttcagagctgtagaatgagataattggcagactttaggtacagcaaattcttacttatctaaagcaataagtcaaaggagtccatcattaaattaaatccatagctgatcacaagccttcattttagccaaaactttctctctaaccaaatcttttaccagacttgctaataaataaccagagagatgtgttaataagtgaagttgccagaaatggtcaactgatcggaaaaaaaaggattcagactggagtattttgcccctgaataattgacagttgactgtgctttacacagtaactagccagtctgttgtctctgtgtcttagtccagagggaatagtacccaattggccaaatactggcccttagtatctcctcctttcttgcatgggatacagacgttttcagtcttgtttttatgatctctctctatatcctgataagagtttgtcattgacttacacatttggaagaaatgcacaccagtgtaatatatttgatactggtggaaacttgaactttgtgtttttatgaaaattcatttatgagaatatgtaatataactgaagagtattttatgtatatctatatacacaaatatgtatttgttatgaggtattaaaaacaggggttggggggagtgcttctgatggctaacttttctctaattaaactatgtttctttgagttgtgaacgaccgagtctggggtctggacggccaatgataagatttagaaccacttggatggaaagcagttcttcactggttt

SEQ ID NO: 67130 - DNA, 1588 bp, Homo sapiens
gaagagagaatacgtatatggttagtctctagactgtagaaatgaaagtaaatagatagaaaatgtgagccagtgtgcattgactgtaggatgataaagctggagtggtttgggcccaggaatttatggagccttgaatcctatgtttagatgttttaatttgatttgaggacaactggtagctttgggaaggcacagctacagaagggaacaataactaaaccttgcttgaaaaagaaaactcatgttgtgatgtaaagtatactagaaagtgcagaggagatatcataatagaagagctatgtctactgtagttagcctaagaaaggccgtggccatggaatgaatttaaaggaaattctgataaaggaaatgtctaagtgtaatttgctctcatgtttgctatattgttcatgtttgtggtaatgtattttcttctgaacttattttccagccgacctcttttgagacacttaaaagctcagtttcttttcttttatccatgactttttgggaatgggttctttagtggcacaatagaagtagaaattaaagacatgcaagaacaaatggatttggttctgggttctaattccaagtcttatgctctcgtactctagcttttataactgattttatagttctgaatcagattgtcctttttcagagcatttctctggattcagattatggacacttccattctagatccattatcttcacaaaaatgtatgcctaaccgaggcttaatatctgtgtatgtttgaattattaatactggtttatagttgaaaactattaacctcagaataatgcttataacaatagtttatcagacttctttttgctctcagatgaccgtcataatgtactggcttttagaagaaattcgaagggttttgtttttttgttttttttttttaatatatatatataaacagtttggggttagaaaaataactctttcagctcattatgacaggattatgttcaccaaaacataactcagagattatctcagaatatacaggcacaattatttcctggctgtgacaactctaaacaactcactttggaaatttctttagatttctttcttttctttttttttgttttttgagatggagtttcactcttgttgcccaggctggagtgcaatggcgctatctcggctcaccacaacctcggcctcctgggttcaagcaattctcatgcctggctgatttttctattagtagagatggggtttctccattctccatgttggtcaggctggtctcaaattcctgacctcaggtgatctgcccacctcggcctccgaaagtgctgggattacaggcgtgagccactgctcccagcctagattttttaaaagtcaaaaactgtagttgattatgctcatcaatttagattttgctagaggtacccaaatgacatcttagatttttttttctttcttacttttgattgtttctctcagacaattcctaatacaatctagttctcaatttttaggccataaaggttttcaaatacaggtagataaaatcttttgatagaatctaagttacaggtagatggtttcttc

SEQ ID NO: 67131 - DNA, 3770 bp, Homo sapiens
gtttttgatcagtaatatgtacattgagggccaggcgcagtggctcacacctgtaatcccagcactctgggaggccgaggcaggtggactgcctgaggccaggagttcaagaccagcctggccaacatggtgaaactctgcctctaccaaaaatacaaaaattagccgggtatggtggtatgagcctgtaatcccagttacttgggaggctgaggtattgcttgaacctgggaggtggaggttgcagtgagccgagatcatgccactgcacttcagcctggacaatagtaagtgactctgtctcaaaaaaataaaataaaataaaatgtacattggaaagaatgatagttaatatactatgtttaagacattacataatcttaattatttgttgagattttatattggcaaaaggtcagtatattacatggacataactaggtcaaagtagaggattttaatattatgagctttcttttttcccaataagttatctaatattttaattgttaaaatctttaaatattaaaagaaaatgaggtgatagttacaataaatgtattaagacttttggagaaggcttcccttgaggtatagattttaaatctcatagtaatattagtctgtaatggctacattgaactttttagccatttcaagtattagattagaaagttaaggaaatttagaataatgtacaaaataccatggttgataaatgtggaaaggccatgtgtattcctcccttaccactgccaccactattactaaaacaaacttatacctaaagaaaaaggtttcacagtggaaatgatttggtatatgtatttttgcatcttaaagccattttcataaatttttttaaatctaagaaaaaaataatagttgtactttttattttttaaataggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgccttcaaggtccactgttgttatttaacatggattttttgtatgtttcttgaaaattacaatctttatcacagccatgaatcaccacaacttaaaagtaagaagtagataggaaataattttaaatcctcatagatctactctttccccgatacctctttggtatggaagtaatagtgattaattctgtggaaaagttaaattattaaattaaattgactttgttgacaacaaaacgtaatttagggtttccagtcattgcctttattgtatagt

SEQ ID NO: 67132 - DNA, 1156 bp, Homo sapiens
caagtctgtgaattatagaaaattagaaaatgcacacaaaagacaattgtattcccataaactaggggaaatactgcaaaaccttagtacatattcttccaggatacttcctgtttatatattcaacatgaaatcttactgtatgtactatttcattttagtcaattttcatctcagaatattagactatattaagaatttcccaaaaagtctcatagctaatttgccagacaagtgttcagaggactttgcattgtctgtatttgctgtaagtctcttttaatggagggcagtttctctttttattattttgatttattgaagggacctacagaatgtctcacctcctatatttgtttagttacttccttgtgtcattgaccttatcctttaactccagtatttcctttgaaccagaagttagatctagaacctggggaattcaaattaaatgttttgactacagtgcatcaaaggtgagacttccatataattgaacatctaaactggagtacttttgagaaaaagggggtattgttcataattacaccaggacaacagtgtaacaggacttttccaggtaaaccaagataatatgatcacccaaataattggtgatgttagatatttcaggttgtatcatatcagaagacacttaatatctagttaactcaccattagtattttttagtgatcattggatttgagtaacgacagtctcattcctccgttattcggttacattttccccttgtggctcaaataaaatctattgggtgtgagattcttaggcattatatgaatatctatttctcatcaactatttgcacaacagttttagcaaacaattgataatccttgccagaattaatagttctttttttgcatgtatgcttgtttttcttttaatctgtcactttgaagctcacagagtaattctaatagggtttgcataataatgtttttgattttctcttttacctgttgacattcttttatgaaaatagaggtttcataaatagggcctattttcattaccttgaaatacagtttctattaaaaagggagtataacttgattgttttgattattaatttttgaagtaagttgctcataaacgtatttttaatgttcaggcttttgcagcccaggaaga

SEQ ID NO: 67133 - DNA, 1083 bp, Homo sapiens
ggatttacttattagtttagataagtaaaaccttaatggaagttttgaaatgtattatagatttctgaaacatggcaatttgtttactgaggtcaaaacttcagatggagagattattttttaaaaataaaatagttacgtgcttgtagcctttttacataacttgaattgcagaagattttcatttctctttaaaaattattaggcttttgccaagttggaaacgaggtatagcgcctgtagtcctagctacttgggaggctgaggcgggaggattgctcgagcccatgagttcgaggctgcagtgagcttctgcacttcagcctgggcaacagagcgagaccctgtctcaagaaaacaaagaggtatatatgtatttacatgtgtgctaacttttagaaattgaacagatttgatttcttgctactattttagcttcttttgataatgagaatgattggaattaatcactgttggggggaatacacatatttcatagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagtaaggaactgtcttcttagagaaaaaagtttaaataaaagcatagagtgaaccctctaaaaaagaaaaaaagaaaagcaaccattttgtgctttctggagagcaagccaaagataacatgtaacttaataacaaaatgtagacaaaaacctagaaaatttatttctgcctaaacaaaaacctaaaaatacaaaagaataaggcatttttctatagattatttgtaaatggagtctactgtcagcaaaaggttctgattcactttgacattggacaggttcggtaataagtcagttggcgtcttttgctttagataaattaatatgttatagttatataatatagatatatgttatagttatataatatattatagatatataatatgttatagttcctatgaggccataattggttgggttt

SEQ ID NO: 67134 - DNA, 1698 bp, Homo sapiens
aaccctgttaaaatatttatgttgtcatttcttcttagttgattcagttcttaggtttcacatgaatactatttccaattattattattttatttcagtagtttttggaatataggtggtttttgtttacatgaatgggttctatcattgtgtattctgagattttagtgcacctgtcactcgagcaatgtacactatacccaatatgtggtcttttgtccctcaccccattcccaaccattgcttctcaagtcaccaaagtcgattatattactctgtctttgcatcctcatagcttagctcccacttataagtgagaacatatggcatttgtatgttctgagttacttcacttagaatcatggcctccagcttcatccaagttgctgcaaaagacattattttgttactttttatggcagagtagtattccatcacatgaataatatttttgtgtattaatttgtaacagcaattgcaattccttttaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaaggtaaaagtttcttttttgaaaatggattaaaaattattattgctctgttgtcagatagtggtattttttttagtactcttaaaccttatttgttatataggacaattgtatatttaattggcaaattaatacttagtggaatcacatcataaacatgtttcactaaggcacattcatttatacagtgctgatgtttctcttaaacatgcagatatttttctttttttagttttttgttttaaacatgcaaatatttttcatatgtattcttaaataattgtaaatgtatatatgggctttataaacaaaaaacacatatgcaatacattatggcatttaaagaaaagtatgcaatgctttatggctgtataagtaaggcatttaagtaattaaagtaatttaagctattctgactatatgaacttttttggaactcaattcctaaaaatattttactttattctactagaaaatacacaacacatagacgtgttataacgttttttgtttgtttttggtaatgtgtttggaagaacttacttcttaggcaatatataaccaaagtgctactgtatatagaaaggatatactagatttataatatgtggtttatattaagtaactttaggatataccactttcactcagcgaatagtggagaaagcaagaaaaaaaaagtattgcatcaataaaatgtttttctcctctctaagcagcaggctctcaggggtaacatgaagtctacactctttataaaagctctatttaataatctgctttcttacaattggtaaaacaagctattcagttctgttggaaatagccaacacaggttgaatatcccttgttgaaaatgcttgggaacagaaatattccgattttgggatgtttgcattgtcctattgagcatttcaaatctgaaaatccaaaatcggagctttttttttttttttgagacacagtcttactttgtcatctgtgctggagtacagtggcatgatctcagctcaagctattctcctgcctgagcctcccaagtagctgggattacaggcgtactccaccaggcccagct

SEQ ID NO: 67135 - DNA, 1057 bp, Homo sapiens
gccaccatgcccagcctctctagattattaaatggtggaaggattcattaaaccagcagcaaggtgtggtgacccgttatgttttagcttagtgcatgcactaggaggtcaccatcagtgtttgacctcttgctgacttgtgacacctctacctgtttgccccaaaggtaagctctctttctgttttaggggcaaatgggtatctaggagctgcaggaattttaaaatgtaggtttataaataagggcgaaatttttgatagcaaaacttttctgataagtttatcagagactgcaagttgagaaactacagggttttgtgcttgaaattcagaattgacagtaggtggcagtgctctttttgtggaacattaaagcatactcagataaatttcagagatgaaatcataactgatttttaagttattaaagtagtgatttgaatattgattcaacttaagtaaacaatattgtctgataataagagtttccccatgtgacttttattcctctttatatttttgcccctaacatagattctgacccatggtaggctcttggtagatgtttggtgaatgaatttggcagtatttaaaagaaacactctcatcaggcccatggcaggtgcagctaaatgatcaaggcattttttcccactgagctctgatgatattttttaagatcattagccacctactgtcattctaatggaattgtgaagggaggtgaaattgatttgttgtcttgtatctaggcataaatgggtactacccaagaaattaaacttggattaattcatttttaatgattgaaaattgttgccctcccttttatttaagatacatgcctttgtttgctcccttcagtcctttattatttccccagtggaggtctccggttaatctaaagaagatattttcttggggcatggcaactgtgtggttaactcttttggtgctgacatttaatttgttgtcagagttcatcccgtatgcaaatggtaaatctgatttttcccccattaaagtgtgccttataagcatgttctatatgcagga

SEQ ID NO: 67136 - DNA, 1040 bp, Homo sapiens
acaaggaataatagtttattaatgtgatttatgtccttgaaatagaacaactgcattgaaatgagtgttttcaaacccaaactccaaataaaaatatctgcatctattgttacagtaatcacaaaagacttcatgaggaaagtgggactgaagcttgaaggttagagagagcaagagatacgttcagaagaagaagccaacatagatgaatatgtagagataaaaatatgtgtggtgtgcctatgggccagtgaggtcctctaaaatgaacagcatttaggggagcagcaagatctggtttcataaaggagacaagacaggcctacaaaaactagatatcactgagtaatgtaaagggctgaaggcatttgtattatttgaatgaagtgttggctggagatggctattgtcagggtaggattcttataaaatgtgagatacgagcctcacagagtacagtaaactacaacatgttttaaatattataatcagtttaaatatctgctgtatacttattccatttttcagtaggaagaccattccccaccccctcccaacttgcatatggccagattatcttgattctttttttctgcttccatatctccttcacctccatccctgaagaacaaatgaaacatcaatagggaaaagctaaataaaaccagcacatccatctgcagaaagggccatatatgccagagctgggtctgaaaggctcttagttggtggaatatgatggtagacttctggttgagatctggtttgcagtgtaagtcctcgagaattgtcttgggaccttgggaaaggagggagggaggtagttggcttgggaactgtggcagaactggatgtgattgcatagaggctggggagtgattgggtagtctaatcaacatcctagggtggcagacaacctggcatggacaagaatagcttttggccttactagcaattacttgaaaagtactgtgcttttgcttcttttgctttcacacaaagcgtgatgtttcagctatctaaagaacacagaaaggtca

SEQ ID NO: 67137 - DNA, 1050 bp, Homo sapiens
gtatttttagtatattcgtgaatatccagacattttcaaattaaacacaggaaggaagtactgtttttttatttgcagtaacttgcccgtaattcacatgagaagttataaaggcctttttttttcttcccacttcttacacatatttaaactgtagttgtagcttgaatccaaacaataaaaactgaacagctagttcaaaccccaggaggctcagttctacacttgggtcaccaggtagtttttttagataattttaggaaaatacactgcttttaaggttcatgacacatttatgaaatctttggacagttgtttgttttatatgatttatcagttttccccttaaaagataaggtcaactgtagttatgaataagttaatacattttgaaaatctggaactcttaagattggtcattcagtcagtttaggtcctaaacaggaattttattcattgtttcctgcctttaattaaggagatgctttcattttttaaggttaacacctaaaattggttttccctggagtgaaatcagaaatatttcatttaatgacaaaaaatttgttataaagccaatcgacaaaaaggcacctgtaagtaatttctttaatattttgtgtattaactgtttaatatctgctagtttcccatgatatcacttgaagaataacagtgttcatttattaaattgcttctgaggaccattctctttccataggtcagctttcccagtgatgaaataatatgttaataaaaatccaaagatttaattttttaaagtaagatgtaaatattagaattttattttatttgagattcagttataaatagataatatttattaggaggctaatgaaaacaccattcctaagaagcaattttaaagtgtttcttcattggtggctagaatgtagtagaggtagccctattctaaattaacttcgtttatacagttttgctttatgaactttgtatttttgtaacttgaagccttgaacttaagaaatctttttatttaaatagatttttaaagttcctctaatgtca

SEQ ID NO: 67138 - DNA, 1073 bp, Homo sapiens
gtaatttagttctatgcaatttcatcatgtgtattaattgtctgacaactaccacagtcaagttactgaaaggattctttacttttaaagtgtatgcttttgaatcttaaagtcattataatttttttttttttttggtcctcttagtgtattggaacaacacaaactaacaaaagaacagtgggaagaaagaatacagaactggcatgaagaacatagaggaatgttaaggtatttgggtagctattttctatgttttcttttttccttcaaagtattttcatgtcgtaacatttattattacattatttccaaaagattgtttgacttatgtaaagtactaatttttaattccaggtattttgcaactttagtttgatatgctcctacttaaatatattacatttagttttatttcaacagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagtaagtaaattagttgcatagtgaactagtcattgttcagtggtctaaatgacgttaatcttatgtcctgtttttcaaagtagtttcttgtcttgattacccttactattttcaaactaaaagatgaattaatgacacatagacttgtagatattttacctccattttcttatcaccttgcagtttcagagttctacttttcagtgtatttatcaaatgagatgattgacttttatttgaattgtgctgcttttagctcttgtgagttatgtctagtaacttaattaaaatttgctccctcgataggtgagaaataattctttaaaatgctattatgcttgacaaatagattgaaattgaacatacataagaaatcaggagcaatgagagaatggatttaataaatatgtctatcacatcttagaggatttttttgaacatttatatataggaattgttttaaatatgtttggacattaatacaatagaatatccctgtatta

SEQ ID NO: 67139 - DNA, 1070 bp, Homo sapiens
atcctagctacttgggagcccaaggcaggaggatcacttgaacctgggaggtttaggctgcagtgagctgtggtgttaccactgtactccagcctgaatgtcagaatgagacccatctttaaaaaaataaaaaaaaaaaattagtttcttccatttttttgtagattacattaatcagaatttccttttgtttttggcagtacagaaaaaaaacattgaataagtattcttaagctcttcagagtctgaatccatctgtcttcacttttattgttcctttctctaacatcctggatacagagatgaacctgactcagagagcaagcttttgggctctaagcagtgatgtttccttgttctttgttgtctgtaattaaaacttctggttagatcagtgtgtttataacatgttatttgagatgtgtggtatttttaatcttcagatttcagtcttcttagggaatgtgcaatgctagtagaagatattgaaaatgagaatgaaatcactccttgttactttaaatccaccttttcaaatattttaatttatatcttacacaaattatagttaaaatagaaaccttatataaaaagataatagattatgcttttttttttttaacagaaagtgataacagaattcattgaagtggagaatttttaaagaaggtaacaaaaagagaaagaaaatgccgaaaccagtaagtgtattttattacatttgacagtgtctcaataataagatatcattaaattcgttttggaacaagacaaagaatgttggtagagttgttggaagaaaaaggcactgatactactgttatttctctttagattaatgtggccaaattaattagaaacacagtgttgctctgttgcccaggctggagcgcagtgggaccatgtcggctcactgcaacctctcctttctgggttcaagtgattctcctgcctcagcctcctgagtagctgggattacaggcacctgccatcatgcccggctaatttttgtatttctggtatagatggggtttcaccatgttggccagaccataatactatggtattat

SEQ ID NO: 67140 - DNA, 1035 bp, Homo sapiens
aaatgtgagatgaagcaatttttctgaaccaataggttataggtcattttttgtttgtttgttttttgagatggggtcttgctctgtcacccaggctggagtgcattggtgatctcagctcacttcaacctgcacttcccaggctcaagcattccttccatcaccatgcctggctcgttttttttttgtttgtttggttttttttttttttttttttgatagagatggggttttgccatgttgcctaggctggtctcaaactcctgggctcaagtgatcctcccacttctcaaattgctggaattacacacgtgagctatcgcgcctggcctggaggctgttttaatcaagacctgagatgataagacctgaactaaggcagtaatagtagttgggatgaaaagagggtatagaatttaaaaattggactgaaatacatttaggttcatgaaggtaggtgagtgtagatgggaataagctaggaaatgataagaattaagaaatgaggggtttatacctccagcagaatttcattgcctaatggttcatgcctgtaatcccagcacttcgggaggccaaggccggcggatcacttgagctcaggagtttgagaccagcctggccaacatgatgaaaccctttctctactaaaaatacaaatattagctgggtgtggtggtggacgcttgtaattccagctatggaggctgaagcaggagaatcgcttgaacccaggaggcagaggttgcagtgagctaagattgcaccactgcgagcactgcactccagcctgggcgacagagtgagactccatctcaaaaaaaaaaaaaaaatctcaggaggaaatttcctctgaagaggtttattggtaatcagttacttgtgattgactagaatttagggaaatggccttacctaaatttcatttttattacaacttagagaatttctcttttattagttatggcatcttttctttttttgttttttagaaacacagtgttgctctgttgcccaggctggagcacagtggga

SEQ ID NO: 67141 - DNA, 1060 bp, Homo sapiens
gtgcctggccaacaactaattttttaaaaagcctttttgtagatacggggtatccctatgttgcccaggctggtctcaaatgatcatcctgcctcagacttcctgccttggactttctgcctcggcctcctgaagtgctgggaggattacaggtgtgagccaccatgcctggccaaaatttaatgtcttgcatactaaaagtccagaggctcaagaatggttcaataatgacatcaaggactccttctctttccaactctcttccctgtgattttccctattaacttcatactaagacagcccttacccatctcaatttggctgctgcaaaggagccaggagcggtggtgtggacctgtagtcccagctactcagaatgctgaggttggggtatcacttgagcctgggaggtcaagcctgcagttagccccttgtcccagtttggctgctgcatcccatccagacagggcagtatccaaaggaataagaggaactgtttccagaaacccccaagcagatgtctttcgagcctcattggccaggattggggcacattctatacctaaccagtcaactggcaagggtaatggaattgccctttcttccaactctgttcccaatagatacttcttttttctttttccttcctccctccgtccctccctttttccctgtctccctccttctctctgtcactgtcacctctctgctgctggagtacagtggcatgatcatagctccatgccacgaactccagggctttgaactccggggctcaggcagtcctcccacctcagcctctggagtagctaagactacatgtgcacaccaccatgcttggctgattttaattttttttagagatacagtttcactatgttgcccaggctagtctcaaacttctggcctcaagtgatcctcctgcctcagcctcctaaagtgcaggcaactgcacccagccctgttattttcattattcatctatattacatgtcttcggtcctttttttacccccacccaaagtcatatccaaaattgatccattacagatagtcatat

SEQ ID NO: 67142 - DNA, 1007 bp, Homo sapiens
tgggttgctatggactctacccttaaaagattattttaagtctcatggcattactgatccagctgaagactgttctggtaacttccttgattgctgcagccagggtgtgcgtactgctttgatgatagaggtgtccaatctggccccagagagttcctcaatttctagcctattttagagaaatcctgcctttcctactttaagttcctggtgtatatctttatattgaatgtatagcttaagccatttaaaaaaaactataaaagtgatatattttatggcaaagtttaaaaactcagaaaaatgtcaaggaaaaggtcaaagtcctccttactccctggaacaccccagcccctttcccagtcctgttttccataggtagctgctgtcggcaattccttgtttatagaaaatgccagtaggtatgcagggataaacatatactttatatcccttatttgtgattttaaagtcttgttaaaatagggttatattgtaacagacattgaaaggatgcttattaacttgtgttaaacattgagtaaatcatatttctcatgttttcatcatttgaataaaagcacacaatagaattccctacgctaattctcaagtgtgtgtatgtgcaaatttgtttgtgtacagattttcttgattaatgattgaagatgaagtttactttttgttttctagcatatggcatatagttgacaatgagaaatggtgtcttttaaaaaaggaggtttataatttggtgtgggaaatagccacatcttgctctttacaaaaaaagtttgccaactccttagaaaaaacatcctgttgaaaggatattttagatacagtattgaagaaacaggtacttcattgtttattttctctaagattatagaatttataaagctattagtaattgagataatggactgttttcttctgagttgtagataatctctatggctttcaggaccttaaatgttttttttttttaatttatttgtgaaaag

SEQ ID NO: 67143 - DNA, 1076 bp, Homo sapiens
ccgcggttcccggccgcagctctacctgctgctgttgcagctctcggagccctgtaactttctcgggcccttgaggccgctcagttttagtgtctcagaccccaccagacaagttcagtacatgatatccctcttttcctttaaaggattctaaactcaattcccggactaactttgaaagggggcagtgcatttttgtttttttttttttttcagtttaaacagactacatcacttcctagacagatgtcatgtttcttcagacattcccaatatttggtggtttttttttttccttaaagagtagttactaggttggaaatgtgttaaaagtcaacttcataaaaatatattttaaaatacatttgagattttggtggaagacacgttgctgaggaactcgatggcattcttgtggcactaagactggcaggatgtaaatataaaagtctaagataataagggtttatttgataaacgagtactttgacatagacattgtaatctattgtttaaggagcatacttctttttttttttttttttttagaacactaaatactcttttatatgactgatggagctaagaaggaacaattaccccgttcatgttgctggataaataatggcttgatccatttgccaaaacagcatcactggatttgagaaaggagactaatattcaggattgcagttttttattttcagaatttctttgctttccccagtgtgctttatcttccagagattaataatactttccttcaaatacagcaacatgtaaaacactccttttgaagttaatcgtatgctgtaaagacgattgcagtgactttctttgcttaatcgcttttttatatatgatggaatttaataaacagttggtatattattagcaaggaatgaatagacattggcattctttacagttttatttaaatgagacagaatttgattgtggcattgaaaaaacgttgagttcttgaccttaggaatcacatacaatgttttgttcactcctgtatccccacacatggaagagtatgtaggagagtctcagaagtagctgtagaatag

SEQ ID NO: 67144 - DNA, 1371 bp, Homo sapiens
aaacaaaacaaaaaacaaaaaaaccccacaaaaattagccaagcatggtggcatgtgcctgtagttccagccacatgggaggctgaggtgggaggttcacctgagctcaggagtttgaggctgcagtgagccaaattcacaccatcacactcccgcctggacagcatcacactccaggcttgtctctaaaataaaaacataaataaataaataaagagtaaaaagcgtagcagttgccgtgggaccagagagaccagaaacattccaaagcaatttcagaaatataattaataggaatgatgcctgcatagccaaaagtcatgaattctagttagttgaggcaaagaaggtacagataaaaaaattcaaatgttaagatccagtctttaaatattgtgaaaatttgggatagtacaataattactttcatggattattttaaacattgtttaaaatgcattgtagttattgtccatgacaactttgtaagatatcctttagaattacctccattttaaccaggtgcggtggctcacacctgtaatcccagcactttgggaggccgaggcatgaagattgcttgagctcaggagttcgagattggcctgggaaactttgcaagacctgtctctactgaaaacgaaaaaacaaaaaaaacagccaggcatgctagcacatgcctgtagtcccagctacttgggaggctgaggtgggaggatcgcttgagcctgggagattgaggccacattgaactgtcatcaccaccactgcactccaacctgggtgacagagtgggatcctgtctcaaacaagcaaacaaaaaataagaattacctccattttaacaaccctgagagtgatttacccagggtcacatagcagcttggaggcatggctgtgtaaaagaagttggggcttttaatctctgtattagttaggattctcgagaggaacaaaactaataagatagatagataaacagatgatagatgattgattgatagatagatagatagatagatagatagatagatagatagatgataggagatgtattatgggaataggcttacagaattatggaggctgagaagcctcacaatatgtcatctgcaagctggagaaccagggaagctagtgatttaattcagtgagtctgaaggcctgagaaccaggagctcctatgtcttacagcatcaggagatggttggctcaactcaagcagacagtgaattcacctttcctctgcctttttgttctatctgtgccctcaacagactggatgaaaatagatcttctttactcagtctactaattcaaatgctgatttcctccagaaatgccctcacagacacacccagaaataatgtt

SEQ ID NO: 67145 - DNA, 1173 bp, Homo sapiens
ctagcacgtaatgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgatttatataatgcagatctctcgacagctctttgaccgcatgatgtagggtagcaggaatcgagaactagagggagagtgtgttggatttgtacgctgctttgtctagtttctttttgaggtctctgagagcagggtctaagactttcagtcatcttttccccactaatcccgttatctagtgggtgctccatacatttttgttgtgtgaactttgggggaaatcagggagaaggcaagccagatttatttgttcctgtttcctctgcacttccccccctgtctttgaccagtgtgggtaccttgctttctgttatacaatggatgagttttggacaactgaatcaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctgtaactaccgtaactactaatcacatgtggctattgaagtttaacataattaaaggtaaataaaattaaagattcaatctcgtagttacactagccacatttcgagttctcagtagccacatgtggctagtggctactgtattggacattgcaagtatgtgtagaacatctttgttatggcacaaagttcttatagacagacagagcagttctagaaactgtagttctgtctttgaagtttaacaactcgataagctatcagtaattgagagtcagaaaaactccttttactctaaaataccgtgacacaagggggttt

SEQ ID NO: 67146 - DNA, 1048 bp, Homo sapiens
tttgagaaaaaatatgctcttataattgatgacttaagtctatgtatttattccagatttcttcttttaaaggctttaaaaagtgtagctttcttttatagtctgtgtggttttaattatctaggaattgattaatcattttcttggccttgctaataacctcagttctccaccattgtgccttctgattgtttccttgcttgtcagctctttgaccaaaaagtagtggtctggtgaaacagttaatagataataggaaccaaaggctaaaatgaagctttggtacaccaagtttattgtattcatatttaccttttgttattctctagttgatagggttggttatatctgttttgacataaaggaaatttaaaaggttaataagttccctgactgctttgggtaagaaaatataaagactatcttaaacaactgcattgccttgtgaatatatatacgtaatactaaaccataccttcccccttttccatacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcct

SEQ ID NO: 67147 - DNA, 1032 bp, Homo sapiens
caagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatctataattggtttgtataaaggtgatttttcagtttgaaaaaatccttctgtatttgatatatgtgtgttgtaggtaaatgtgttggtttatctattgctgcaaaacaaattaccccaaaacttagtagcttaaaacaagaatcttgtattatttcagacagttcctgtgagtcaagaatttagagtacggagcagggatagcttgtctctgctccacaatgtattaggtcttaagctagatgactcaaaggccaggttctggaatcatcttcaggcatattcttcatatgactggtgtctgctgttggcatcagctggggggtctaggagaagatactggctggaacacccacacgtggcttctctgtgtggcctggacttcctcacaacctggcgcctgggttccaagggcaggcatcctcagaagagcatgcatgccaggcagaactggatcctctttatgagctagttgtggaagtgacacagtatcactcccaactattcttttcattagaagtgaagcactaagtctggcccatcatcagaagggaggggtttccaagtatttggagatatcagagtaactgttaacttattggccccttatctcctgtgaatattggccttttaactaacagtgttctaaacttaagaggagctagctttttctcttacatttgaaagattcttgtgtctgctttattatgatggctcacttgttttattctataactcccaacattttgcttcttg

SEQ ID NO: 67148 - DNA, 2278 bp, Homo sapiens
aatcataagcaggatgtctgttttggtatacgtgtgttttttgattttttaaacttacaatttttattttttacatggagtggcagaagtaaagatgagattagtgtaggataaaaatttaaaaagcatatctgatatgtcatatcatcagtggtagcttttaaagtccaatgttgactttgtgaaatgtttttataacactttttagtgttaaaaattatgttaataaatctattatgggtctttgcaaatagaaataatgttcataatgaaaaagtaaaacaccctctttctctagagctacaccatggggtggataaagggatgactcttcttacctttaagacagatgctatcacaaaaatagattcacagtctaggtgtacttcgactccagaattcaatttctcttttagttctctgcaggatttcacattggctgattgcctgaagatacctttggtgagaggtcctttttgattaagaaagaaaagcatatcctatggggaagcaaaggaaaataaacaaaatgacacttccacacacacaagggaatgtacacttgccctctttggatgccagaggctagggtgcgctagggtaaaagcactgaaggattggagctaaataaatggccggaaaaattaaagtcacctttttggagagtggaagggtggttaccaggggctgggggtggtggtgagcaggttggggagatgttggtcaaaggatacaaaatttcagttaggaggaataaggtcacatgatctattatataacattatgattatagttaataatgcattatattcctaaaaattgctcagagagtgaattttaagtgttctctaattttcctttctatcactacgtcctgcttacagtgtaagaagagaatgggttttgaagacaagcaatccatgggatccaaaacctagttatgccacttggttactgtgtaacattgagtgcagtactgaggctttaaaacaatttgtaaacggatgagatgatgacatgataacaactatcccctaaatttgttgtgaagaataaataaagtggctagacaagtgtcttgcatttatagatgcataatatagtataaaatgccatatatgtagtatagtgcttgaaggatactagagactcaatactgcttagcagtgattatttaaaatatcaactggagataatataaacccagtggctttcatctgacccactctatatacaaaagataaataaatgccagggaatgtatctttatgcgtgagcacttgaaatataaataaaacggatttaaaaacctaagtgtaggatcgagtagtttctgttgctacaatgatcaaagaagactttgagaacaatgtgacgttcaagaaaggatttgtgaggaataatgtgaattctgtctgcagggcaaattctgctttatctgagaaagcttacgtggctctttcctaggttatttcttcccattatgtcttccttctgatttcacagtagctaaatcagattttgttatttggaggaataatagtgaagattcttagccaaagacagtggtgtctataatttttccatttggggacagatttacctcgcagagctctcctttcccaaacaccctttcccatcagtttacagaccaaaatgagccttaccaagacaggtttgggcagattgtcattctcacaaatatttggcagagaaattccaaagagctgtcctggcataggtgatgttggcgatgagggcaagttgtccaggtgagtgctagaacctcgccagaaggcccagtttatgatagatcttctccttttaaatgtcttatgacctgaatctaaggaagaagtgagcttattagaaaaatgagtttcattcacttaatcttatttctataacttccattttatggtatgtttgttgctatggctcaaagagaaaaagatgctaatagatggcttttgtcattgacaattcaacctataaaatttcatttcgtctttcatcttataaatgaaagatgaatcaatgaaggaagaatcaaatgtttgggttcttctcccatccagtttttggacatcactggtctgtttacttgaattttggcactacattttcaaaggtgaaagactcccttattgaactgtaacacctaaaagcaaaaagcgtttcatacaaacccatttattttcccattttaaagatgagactaagcatacaaaaagtttaaataagactatagttaaatactgagaaaaaagaaagtgtg

SEQ ID NO: 67149 - DNA, 1087 bp, Homo sapiens
caaatcccaacaagtgacatgtacaaaaacactcacgtcactttcttccgagcacatagcaagttctcagactcagtagtttttctcacctacccccagaagacatacactttagtcattgggttgatcaagaaatgtaaactccttttaatagatgcctaatcaaaatttaattaggaagccgttctgccaaataaaaatacggtaatatatttcagtgtcatacgtaaatgacttttgcattgtttgcatcagtgtatcctttagtgtgaataaaagagaatggttgtatcttcacagtttaacactggttatctagaaacctcaagggacagtatttttttttaggggaggtggatagaggaaacagaattaatcagtatagatgtctttaattctctactatagatgtaaaaataaatttattgtttattttttaactaagtttttaacaaatacacagttttgggtaaaattttttactggaagcttgtgagtatgaagtgtactaaggtttttcacttaaaagtagtccttatagaagctttagccttagatcaggaaccagcagtcatcttcccccaatctactccagggtgagaatctgcaataagtatacatgcaggtactgaaagttcatgcagaccagtggttcacattgggggcggggggaggagggggtgttactaacctctagggaacactttggaattttggggaacatttatgtttggtcagtgatttagtggcagcagccagggatactaggcatcatggaaagcacagaatatcctgcgtagagaagaatggtgggttcctgcatagcttttgaaagtcccctatataacatatgcacgaagggggaaaatatctttatataattatctatgcctgtaacctattttatatataagcacaaagtatttttatacatttcaatgaatactaaatttttcagaaatgtagctaccttgtacgtcaagagataattgtactttgtattgtttggaaccatttctaaaaattactgggcttcatttttctgtgcttgttacatgaaatttcttatctgacttctcttaaattt

SEQ ID NO: 67150 - DNA, 1049 bp, Homo sapiens
taatgcaattaattaattgagtatttttgcctaaatgtatagtttatcgtttctttaaaacattaccttttaaaaatattctatttcagagtggtatccactatttatgaagtcatctagttataaacatcaagtacaacagaaaatatatactatatactgtttgaagtttaccttgttttctgtgaagcaaataattatagttatccctgtcacagaacaactgtgaaatttgtttgtgctaagataagcataacgtaagcctgtcctgataagtttgtactattatacacctgtaaaagaatcaatagtttcattctattttgatgtatttcacatagttgtaaacaagaaaatctaagttttcattgcctgagaacagattctttaagagatcagtgaatttgttttgaagttattagtggccctttgtttggttacacttttaagcaaaagaaagagataagtgtattttgaatgaattaatatctaaatctattaagcccctggttatattggctgcttgtaagaccttttgttacttatttagaatgaatcctgtgaatcctaaatgtatggttcatgtaatgtttattttcttgcatatccacggtgaatctttggtggacacttaatgtgggactatcagaaataaagggacctaagtgactatgtagtccaaactgtctcattttgtgagtaaggaaatggaggcccagagaagtggctgaattgccttgggttgcacatctcattaatgatagagtaagtctgagtacgaacaatggaacctgaaataaaaacaaactacctgctggtagtttgattgcattctcttcaatataaatcaagctggatgaagtggctacactcagcatttgacccattatacatctgacaattttaaaactcagaaaatacattctattcactattatacaaatgatcttctacagtagatttccatgaaaaacacccatttcaaaagcaccttttcagaacaaaatttgtcacccttctttgattatccattctcatgtttaacagct

SEQ ID NO: 67151 - DNA, 1037 bp, Homo sapiens
gtgattaagagagtgatcttacttgctttactgtctgtacgtggaagattttaaaacaacttgaagggtgaaattgcattattcacctcccgtgcactcacacgtcacccagcaaaaatgctctcatgaatgtatgccctcactctgaaaatgtttgtggactgagtgaaggaatgaatagtgagccatatgaaaaatgactgctgcaaagtattctggtaaacatctgaaactaaaccacttaattcaaactgaaagagccaaattccttttaactgacttttcttttaattcagtacacaagtatagagtgctataaaatagctacactaggtggcatcaacaatttctgtatatggtcaggatcgtgtgccactattttattttattttattttatttttagtactgaaagctcttctcagttacctttttattctccatcatcatggtatatggagaagatgtctagtattcccatttacaacaggaaaactaaggcccaatttaagatttgactccctttaaagaccaatttgagatgaattagtaagattccaatgtaaaatctatttcagttaattgtaacttccttgtaggattattataaggattaaggcagttaatacttgcagaataagtatatactaagcacttgaatgttacctattattgggattattttattagttatttcctttgaatcttaaagtagaatttagttcaaaaaattacaggcatattttccagctgcctactctgcctactcagttggttcttgatttcctttcctgactctctgttttgtactttaacaggatttgggaattgtgactctaaagctggggtgtctgtctatcccaagggtttttaatcttttttgtgccctgcagcagtctggtgaggcctatggactccttccagaacaatattttattttatttattattttatttaaaaaaatatatatatatatatatatttgagacagagtctttctctgtcgcccaggctggagtgcaatggcgcaatctcggc

SEQ ID NO: 67152 - DNA, 1001 bp, Homo sapiens
aagtagctgggattacaggcgctcaccaccatgcccggctaatttgtgtgtttttagtagagacggggtttcacagtgttggccaggctggtttcgaactcctgacctcaagtgatccacacgccttggccccacaaagtgctgggattacaggcgtgagccaccgcgcctggcccaattgtttcttaaagtattccatgggagtaacaattccattgttaatgatgttttttacagcagttatttatccttattcgttcattcactggataaatgtttgtgtgtttttgataaatacaactaccttaaaaactataagatgtttaattaaaacttttgttttaaattcagttttcatggcagaacatactacagtagttatagtggaacaatgaatatggtataaaaataatatcagcaaaatatcacaattatacttattgacgataaaagtttctttatatactatgctttaacatcgatacaagtttgtgtgttttaaaacttagaggtcttttttcccaagtttgactctgaggcaaattttagggcttaatcatctatgtaatgagcaattaggacccttttatttttaactggttcttctctgtctcttgttctatatcactcacaaatgatgtatttctacagaacttgggagattcaagtctgtttcccttttaggaaaaaaatagtggacaaaagagatcttcgttttggtcgaatctatcaaacagtttaacattgtttatgaaatataattacatcatcatctgaagtggtattgtgttagatctcgatgtgaattttgcatccaaaggggaagacaggtggtggtagaatccagcttcctaatacgctttgcaaaggctttgtagtattagtttgtggtttatgaattagagatgctaattttataaaattagcataatgggaaaagaataatagcatgtcagctgttaaactttgaggcaatagtggttgcttgtttgctattcagt

SEQ ID NO: 67153 - DNA, 1034 bp, Homo sapiens
tagggaaccattttcggctggatttcagcacagaagtgactgcatctaatgtatcattttaaaagcatcactctggctgctgtgttgagaatgggaaagggtggagacagggaaaccaggtaggaagctgttggagtagttccagtgaggggtgttgacagcccagaccggggagtagcagtacaggtagtcctaagtggtcaaactcagaatatattttgaagtacaatcagtaggacttctcgacaggtggagactacctaagtaataggtataattatggaagaggccaagatctgatccctgaggcatttaaacattaaaagatttagaaaagaggagaaactagcagaagagacagaggaggaagaaaaccaagagaatgtggtatcctagaaaccaagtgaccaaagtattctcagaaggatcaagtgaacatctgtgacaaatgatgccgatagatcaaaaatgatgaggaatgacagttgaccattgtatactgcagtttggtaagagcagttttggtggagtgactgggccaaaagctagattgaaggggcttacagagcaaatgagagaagaaaaatggagagagcaaaatagacaaccctttcaaggagttctgctgcaaaaagggaaaaaagaaatgaggtagtaggtagaggcaatgagtcaagagaaggatttttaagcctttgcccattggaacatttttaaagctttggactgtagttttacaagtaaagtagaaatagctgttacatgttaggcatcatttctatgaaaataggatagtctaaattgttctttcttgctaagatctttgaaacaaatttggattacattgttttatacacattgagacataatttggggatttttaaatgtataaggtttatatttaaagtaaaatctctagggtaaatggtcaattggagttctggaaagaagaatctgatgtccacagaaaagttggacagtgaatgctattatcttattttccactcttgggtacagttaatttcttgaccatt

SEQ ID NO: 67154 - DNA, 1034 bp, Homo sapiens
gcagggaaccaagaagctaattggaaactgagccagtagaagggattttttcactgctagggtgatctgactgtgttcttatattggggatttccaatgtttgtatctttacacttgagttgatggattaccaagagaagattctttgtcttctacccataaggtaaagcctggttgccatagttttggccttatggatgaggaatgctaacgcatgtcagtatccggtatgcatgtttacttaagctttctgttttcaactgcacctagggttcttaggtctggagacccttcattttagtctctccttgagaggataagcctctagatttctactggggtagaaatcagggcactcacccagtccataaaatgaagggaggagatttggggattgaattattttttaaaccatcttcacctgatcatccttattttagcttcattttacaccaacttccagtttcttgtgccatcagttcctgagtctttggggcattctactatgtaaattatattgattcaaggcattttccattgctgaggcttcaagtttctcaagtcagttgagctggtatttcaacagtgagattttttttgtttccaagttctttagtttgttctttttcctgtttcctgttctattctgtaaaatatatgtgatatagtctcttatctctgggaagatagtaaacatatatatttatctctagatgttccttttttcttatgtttttctttaaatacttgaacatagttgtaataactattttaacatcatcttataattccataatctataaattctaggtctatttctgttgtccttctcctgcttataggtaatattttcctgcttcttggtatgtttaattttttgttgttgttgtttttttgttttgttttgttttggatgctagtcattgtgagctttacattgccaagtttctggattttgttatcttcctgaaacagtgttgagctttagtgggcagcagttaagttacttatagtttggcttgatcttttcaagt

SEQ ID NO: 67155 - DNA, 1126 bp, Homo sapiens
ggctgaggcaggtagatcacgaggtcaggagatcgagaccatcctggctaacacggtgaaaccccatctctactaaaaatacaaaacattattagccgggcgtggtggcaggcacctgtagtcccagctacttgggaggctgaggcaggagaatggcatgaacctgggaggcggagcttgcagtgagctgagattgtgccactgcactccagcctgggtgacagtgcgagactctgtctcaaaaaaaaagaaaaagaaaaacctccttttttgtcatgaagatggtttttttactttttttctatttatagatgaaaataagtctgcagtctcaaaaatggagtattccatttttatcatatagtaaatgaaatttctctttctaaatcaaatgcagctggaaaaagaattacccttggaattagggaatctgtaatgttaaaaaataagttgtttaaggatgagcttgcagtcaaaaaaagaaaaaataaagaaaaaataaaaataagtaattaagagattttaaaacatagttgtagaatactatgcatggtatgatttcatttgggtttttaaatatattattactatttactatttaaagcagtttattttaatgccttagttctcttgagctgctataacaaaataccttaaactgggtaacataagcaacagaaatttatttctcgcagttctggaggcttggaaatcctagatcaaggtgccaatggtgtctggtaaggacccactttctcagatggcaccttctcactgcatcctcacacggtgaggggacaagttagctctcttgggtctcttttaatgggcactaatcctgaacagtgccctcatgacctaatcatctcccaaaggccacacctcctaatatatcacatcagggattagatttcaacgtattaattttggggaaacacaaacaagaccatagcatataatatgggctcctattgatatatactgtaaatatatttatacatgaaatatatatatttcatgtatatatatatattttcacagactggtgaaaaagtttagaaaatatgaatcaagctgtacagtggttgtatctatggagttgggattatggggaactttcatttgt

SEQ ID NO: 67156 - DNA, 1324 bp, Homo sapiens
tgttctcggaaccatagattgagaaaaacaacgttgtatcctttctcctaagctcagaaatgctcagtaacttgaccttcagctttggcaccaacttccctttccttgcaccagaagaattcttccaacagaaggcaagaaaagagaagatccaagaagatggacagtgagaaagggaattggcattttcgtaggaaagaggactacttcagagagaggttcctaaaattgaggtgtaatgaaggcttgtcttcctcacagggtggagatcagattggatacagatatgaacgtgcatattgccttgcaaagaagctttctaaggacattaaacagtgagaaatggtcagttgtggcaccaggacggagatttatgccaaagaatcttatcggaagtagattccatccattttcagtgccagcaccaaaatgttccacccataattttaggattgccctggggcaagctgggaggtgtctgtggtgtaaattagctttttcccttctcagatctgtcttcctttcccttccatgttatctacatttcataagttatctatacagtttaaacacctcttttgttttactttgctttgttctattttattgaccattctttgacacttgccatgtgtgttttgaattccaaagtcaatttcaagatggtttccattgttaagaatttgaagcaaaagactgtgaggaaagcaaatatagaaatttcttagggaaaacatgattgtaataaagtatatgttagtaaatatttttctgctctatagcagtggtcttactattccttcctaagggaatttctttattgttttttcaatttttaatacaaaataagtgcatctgaaggggaggaagaactcttaaaagctccaatgattgggtgaatccttatggaaaaatcataaaaagaaaaaacccggctgtcagagttagagtatctaatttccttttctctgccagatattttatttgcctgttgaaatctctgattgttatattatctcctatgctgtagatttttaatctttggaatgtagactacttcaagatctgagttattattattcagtaatgacaagagtatttggccattgtcagatcatttggccaaaagagatcctgtttgcctaattctttttcttatttcttgactcagttgtgtaatattgtcacttgtaccctgtttatagttctatctgtgtaaaaaccaaattatgagttacttaaaggtaagttctttaatattatgctttgtttaatcagtataaaacaacttttcaaagtgttgttctacagttctgagataagc

SEQ ID NO: 67157 - DNA, 1067 bp, Homo sapiens
ttaatggccagtttgtgtgatactgattacatgatcattttttcatttttatttactttcataatcttctttattaagttttactatcattggagctattctttagtctcttatctgttattgtcggtgccttttaattttgcaattttactgttattggagacattttttgtctctcatctgttattgttggccccttttaatttgcaatattagtctgatttgacttttgccttttcatctacctcccatgttctagacatggcttgttaagtaggagaacacacacgcaacccaactcttgtgaagggaaatacagtgtaaggttacaaagatgtctcatggtaattcaaggataggaagtgcagcttaggcaggcatcgtgggaaccagaaagctaaaagataccttttttcttaaaagagtagtgttgttctttttattggcctctctgcttcttgagacacatctgtctatgcctcctcactgtcccagctggcttcctccgtcgcttattccttttacaatggctcaaacgcattctccattttttaaagctctttcagctcagttccacacagctcactggcagcttccgtctttgtctctcattttcccaagaaagggaatctgattcacccacctcacttttcaatccaagtcacagaatccttcctgagccattagcctttcagctaaaagtaataaaaacctgattcaaattggctaagaaatgaggaaatgtattatctcctgtaacaggaaatccaaaggaggggcaacttttagagttgattggagacgcaaccgtgtcaaggagacacaggttctttgcatctcctcactctgccagcctcagctttatctttagtaaaatggctacagcaatttcaggtgtcacatccagatattcagaaaaccgaatggccatttcttcctgtggctttttcttaggcgtgagaaaacattttcctaaaatctgccctgaaaatgaacctcatgtttcattggctggatttgcagttagagacctgtttggattaataagctctgttggtgagaaagag

SEQ ID NO: 67158 - DNA, 1057 bp, Homo sapiens
ttgagtacacaccttaggtctgagctatgaccagtcacacttcattatattttataatttttgagtcctcatctattttgatcaaattaaagatgtcttcagtttccgatcatatgggagcttattgtgccatggtaacaactttggcttgtagtccgagtgacgtgggaagccattggaggattattggcagaggactgatagaactgtttctaaagattgctctggctactctgtcaagaatggaagacagagatgcaaagataaaaggaaaaccagttaagaaactattctaatagttcaggcaagggataatcgtgacttgcactagaggaggattgatgcagttcaagaaaaatggtgggattctggacatgtcatagttaagagttgaaaggatttgttgatggattggatgtggagagagggcagggtgtggagattagctctaagattagagtggcatcatagatatccatgtggagttggtgaatagacaactgatagttgaggctacacatcagggtgcccaatactttattaatgaatgaatagctgatagataattcaagaaggaaatgtataaaatgaaagttttaaagagaacaagaattacagttaactcctttactatgactcacatggtccttttctctatgcttccaagcagatctcattttgactagaatacaactaaactggttaagagtttggacagggtgagagagagagtgtgtgtgagcatgctagaggaaatacatttgtatgtgtatatttatttctctcagaatctaagtgtctgtctctcagaatctaagacttgacgtcagaaaaattgttgctactaatctatgtagagatattacaactttatggaattgtgtttaattaaaattattatttttaaaacttcttcattttaacttccatataaaattagaaatgttttcccaaaatcaggcatggtggtgcatgcctgtagtcccagctactctggaggctaaggcaggagaatcgcttgagcccaggagttctaatccagcctgggcaacataat

SEQ ID NO: 67159 - DNA, 1055 bp, Homo sapiens
attttttgttttaatttctgcttaatgggactgtacagattattaacctgagtttacagtttcacattatttttcagtgctttttacaaatgtaaattagatcaagtctctcatctacttaaagtccttaagtggctatcaatattttaagatacagacccccttgttaggcctagaaatcctcgcttagtttgactttgacttcttcagtttcatcgtacgccttcctccttccctgttctttatgtgttagcctcattggtctcctttcagttttgtgaacgtgctgcacctttttttagaatgcttttctcccagttgaaatagtatcttcaaaaagaagcctttcatgatcaccctgtctacagtggcctcacccagatactttccagttgatcatccctgtacctctaacatttattgccccctgaaattgtaatgtttgtctccttattcattgtctttttctccactcaaatagaagtttcatgaggccaaagtgccaagcatcgtgagagacacaaataagtcactcaaatatttgtcaaatggagtttattcttcaaactcaagtagtgtaactttctttcttaatttgattccatgagggagaaagcactgtgctttgagattgacctgaaaaaaagtcaggacagttgagggccgtgagttctgtgctactgtgctcatcactcttatgtaactgattttattctcattgactgagatatttagggtgctttttaagatctttacatatgtatgaaaactggcaaaaaaaattatgattttctgtacatgtttatcagccttgatttgccctattaaatatttcacagttagaattataaatttcttgctaatgtacattttatgttgtaagtactaggctcttatttgatgctgcagacagcatgatattcttacgtgacaggaaaaaaaaattgctatgtgtgggcagaagccagtaggatagatgtggaataaaaccccctttaagggttctttgccatgaagtgccagttcatgtgcagagcaatttaaggtatgactct

SEQ ID NO: 67160 - DNA, 1055 bp, Homo sapiens
ttgttttcttccctagagtatgggagttgttctttatgtccttgtctgtggagctctgccctttgatggaccgactcttccaattttgaggcagagggttctggaaggaagattccggattccgtatttcatgtcagaaggtaatcaacttttcatcttattaatggtgttttacagtgttagtgctccaagtgaaatgcctaggtaaaagcttctttttttctaagagtttgggtgccaaataaagtgactgagctgtaggttaaaagctatagaaagaagcaacctcctttatgtaggcgagacaggttccagccttctacttgtaactaaacacacagcatttcccagattaagagcagcatgtcttctcattcattctgggtctataaatgtcccaggtttattttagatttaacgaagccctttgtagatacagattcacaaccattttactccaatatgaaatgaactttataaaattaaaatttttttaattaaataaaaagccaaactggcaaaactctgctaaattcagatgatatgccataatccctgcctgtcgtgtattgagctgttacctagatagcagttaagtttaccccttagtttcattttggttatcattcttaactctgttctttctactaagagtagaaataataactcttcatagttaagagcatggactgtgaaggcagactaccagactgcctggttttaatcctgagtccactggttactggccatatgactttcacaagttttgtctcctctctatctgcttcaatttccccatctataaaatggaaataacaatagcacctaccgcacgggtgttgtaaggtttaattaaattaatctgtcagtcaggtgcagtggtttatacctgtaagtccagtggtctgggaggctgaggcgggaggatctcttaaggccaggagttggagaccagcctgcacaatattgcaagaccctgtctctacaaaaaagttttttttcaattagccgggtgtggtggcatgcacctgtagtcctagctactcaggaagctg

SEQ ID NO: 67161 - DNA, 1062 bp, Homo sapiens
caaatcaaggagcataaatggatgctcatagaagttcctgtccagagacctgttctctatccacaagagcaagaaaatgagccatccatcggggagtttaatgagcaggttctgcgactgatgcacagccttggaatagatcagcagaaaaccattgaggtaaagtgatcagagatttcggggttctactgcacttagctacttgaaatttcatgctcacacctgtcatcctggtcttttagcacatgtatctccagcgcctaggcgtactgttcagtgttccctatagatgacatcagactctatttatatttgcttttattcagcatcttaaattcctttctttgcccccatctgccaaaacattcaagaggaggcatttataaaagactcagaaaaggcaaagatggaagcttaacaaatacaaggtagaaagtttcttccaagatgaagcatgaagttttacataggtatttaactagtttgtatggaatgtaaatgtgcagataggcaaagggccaagcaggaaacaagaagggtaggtatcaggtttaagaaagccaggggatttagattgtgaactggagaaactaagaaggcaaaaacaggtgggctcctgatttggaagtattaggggtcatagaactgtgaagggtcatgaacctggaaaattcctcttggcttttatttctgtcctcgaatagttagcatacttataggatatacgtatttctaatacctttacgatagtaaaaaagcaaacagtgctcttcaggaagaaacataacaagaaagaatatcaaatgccgccttgtttgctgtgaaagaccaaggctccgggctgtgctgcctttcccccgccacgtagccataagtgaaaccaaactgattctcctgctttgctcactttgcgcccagtgatgtttttctgtacttgtccatgaagtgcatcctgagcagtagctgggcgtgtgattccactgacctgtgatttttgctgagagtgctctgcatcctggtgccctgcacagcacccatgccgactgtcaggtggaattagaa

SEQ ID NO: 67162 - DNA, 1032 bp, Homo sapiens
atcattgcgtattgacactcttaaagaatatcttgataatatctgcttccttgggatattgaccatctatttatttaatatttgctaatcaactgtgtaatgctgagcatgctgtctgtatatttataccctctcttgttccaaaaagactcctttggtcccctcagtgatcacaagactcctaaaacccaccatatttcctaggaagtgattgtcacaacaaaaagcgttattccttgatcctgtctgttattcctctaaccgagttcacagtcagttgtagtagtccaggtcggatgtgaacactgtcaaggactatgtgctacgcttggtctggcacagcaccgtctggccatttaaagcgtccgagctagtgagagtcagggacggagcagtgtgtcgtagttagggcatgggcatctcatttccatatagcacccccagtcatgcgttgccctaataattcagactaccttcatagagaaggagcagtctaataaagttgggaagtagaaatcaattcttcagttttatcctttgattgaaaagctattgatgggggtaagaagaatgtagcaaatatactttagtgggaagtgtaaattttacatattgactagataaaaattttacatagtagctagataatttaaaagcctgatatttgaaaagaaaaagttgtttaacatcagaagtggcacagaatataagcttgaggaatgacaacacaaggaaagctatttctttatcacactctgaatggtatgcagttgtttacttgtttgtttatttgttttggggcatccataccattctgacactttgctaatgctactttatcttatacagtatagccagtgatattaatattggaatataccaaatataaagtatgttgaaaatatattcagagtatattcaaatataaaatatatttctaacatatccccccatccttgaaaatcatcaatccaagattctaactaggaaccgttagtatttgagaacgagactgcattcattttgcaaact

SEQ ID NO: 67163 - DNA, 1067 bp, Homo sapiens
attaatgctgaaaacaaaaaaattaactttcatgccaaattgggctttatttgattactattgctgctcttctgcataggtacctcaggtacaaaatgatgggccgtcttttgtgatcagttatacatgtgtttttgtccaatttggaaatgtttaaaagttaatgtgctgggccaggcacagtggctcaagcctgtaatcccagcactttgggaggccgaggcgggcagattgcctgagctcaggagttccagaccaccttgggcaacatggtgaaactccatctctactaaaatacaaaaaattagccaggcgtggtggtacacacctgtaatctgagctactcaggaggctgaggcacgagaatgtcttgagcccagggggccgaggtggcagtgagccgagatcacagcaccacactccagcctgggtgacagagtgagactccatctcaaaaaattaataaattaataaaaataaaagttagtatgtggaatgaagttggcatttaggatacagaagatgacagcttctctcattcatagatgtctctttaacttccaatgtgtattatatatacttagcataagcgatgtatagaagatcataataatgggtagtagagtgtcatagaaaacacaggtcttggagcgtgttcaaaatagacctcctcttagtgtgaacttgggccacgtaacaaaactctttgaacctcagttttctcttatataaaaggagaacaccaactttatgagactattatgaggattaattgagataatgtgtgtgaggtttgggacagattatagataataaataatggtttcctgtctttttagcctctttagataataaaaagatgagtgagacatgaactctgcctctccagagtccactatagcctagcagaagaaacattatacatactgaaagacagcgccaggtgctgaataaattgataaaagataaaatatgggccgggcatggtggcttacgcctgtaatcgcagcactttgggaggccaaggcggacagatcatgacgtcaggagttcaagaccagcgtggc

SEQ ID NO: 67164 - DNA, 1022 bp, Homo sapiens
ttccctcaaaagaattaaaatgcagttgactaaaggcttgtctgtgagggcatcaggcctaaaacacagattgggcactgactgctgtattatatagggcaagctatttttaaagcttgtgattgttactgtaaccagaaaacaggcaggaaatgaatgattttgcaaaagatatagacaggagctagatggtatatttgcatttgtaggaagagcagtgccacgctggagctggtcacccacactggcaatgccatgctggcactcagtcaggccatagacatcctccgggcttctttgtggaccgttttatttatgtcagcaaaaacgcttgtccctcttccctccctaagacctctttcttggggcccataaataagtgcacacacacacacagaaaaacttatcagagacacagttccctttttattgagactgcctcatgtgcatttactgtaacacccatttgttgttttctgattgatgcttcattgctgcatgtattgatacttgcatttctcctctcaactggggacaggtattgtgcatctcaaagagacttcagctctccttccctcccagaaatcttcagtgcttaaaattgtcagtaaaatcccttggggagtctgaatggaaactttggtttgcagtttcaaaaaaatattgcctttctgagatagttgcccaactctagataagaatggttggatcaggtgttccaaacaggaactgagatccacagatgacatgggggccatatgggagggcagatgcataaaccttgtagaataaatctacttcaagtatctctttttaataaggaattttatatacatacatatacacgcacacttgagtcatttttagctttttttttttttttttttttttttgagatggagtatcactcttgtcacccaggctggagtgcagtgacacgatctcagctcattgcaacctccgccccccgggttcaagcgattctcctgcctcagactcctgagtagctgggagtacaggcg

SEQ ID NO: 67165 - DNA, 1058 bp, Homo sapiens
ttaagtttagtcaaaaaggaaagtttatctggggaaggaccaaggagagagcaagagttgctggccaggtttcagagttttgctttctgctgccatggggaagattggccagtgtggaaaggaagcatttaccactcttcctcttaaatgaccgctcatcgctttaaaaccctgtaatgcattagccaccttacccgagtgagggctatagcccagaatggattttatggaataaccttcccctccctgcagcaaacaaagatctgagtcaccctagtctccttctccaaataaagggcctcgcagcgccttcagattggctgccataagaggaaagtttcctgtgtgtctggtaaagggaaaccccacaccacctctcacatacatgagcttctcctgcttccaaaggaaacagtagctctacccagtgttttccaggtgaaagtactgcttagaactcagcgtcttatgactggctgttcctgagcagctattcataggagaaaatggattgatttccacgggggaatagttaaggtaatgaggtaaataattacctcctcacaggggcctttaccagccagaacttgcaaccacaacccccatgccagtatgctgttctgcctgccattaggcagtgtgcgtggcaactgcatgggaagggccaatgcttgcggggagctgtgctgcgctcacccctgtgggataggaaccatcgataacgtatatgttgctggaggagacaaaattcagtgcactggggcttattagcctctgctggaattttgggccagtgagccctttgttattctacaatgggaggctttggctgtctgccatttgaatttttttcaatcctttttgtggtatcagtctgtctatatagaattcttactttccattccccaggcatatagaaccaattaaagactaaatcaaatgggcaggtacttaaattttgaacataaaagtctttctaaaaccttccattatgtttatggttgaaaaaatagaagaatcttggtgactacccctttttttttttttttttttagcaa

SEQ ID NO: 67166 - DNA, 1017 bp, Homo sapiens
gactaaattggccagtaaaagggctctgaaaagatgttttgattggaaattaaggacatggtagctgtcaaaactcaagctggttatgctttgtaccctatgttccaaggagatgctattgctgttggttttatctgttctgttttctcttaaagggaaaattttctccatgaatgacagcccctcccttgacagtgtggactctgagtatgatatggggtctgttcagagggacctgaactttctggaagacaacccttcccttaaggacatcatgttagccaatcagccttcaccccgcatgacatctcccttcataagcctgagacctaccaacccagccatgcaggctctgagctcccagaaacgagaggtccacaacaggtctccagtgagcttcagagagggccgcagagcatcagatacctccctcacccagggtgagcacttcctcctctgctttttgaaactcgcgtcgtaggagagcagtttcttgccatgttggtgtggtcacctgtggtcactgaaaggccttgtattttagttaaactgtttggtcttggtgctttctttcaggaattgtagcatttagacaacatcttcagaatctggctagaaccaaaggaattctagagttgaacaaagtgcagttgttgtatgaacaaataggaccggaggcagaccctaacctggcgccggcggctcctcagctccaggaccttgctagcagctgccctcaggtgggtaccttgggcccttccctcaatggctctgtgaggatgaggtgtgagtttgtcctgaagatggtcattttcacttagaggatttcctccagtcctggagcaaacaggctgtttgggaaaacccacagcttctttgccttgttgctgccacctgccactgacgggttcaacccatccacgctgcttccaagtgatcaataccagatggaggcctggacactctcaagctgtttttggctcacagggcagagtacagatgagtgacctcttacag

SEQ ID NO: 67167 - DNA, 1108 bp, Homo sapiens
actgtcatttttgtgatttaataacacacagtgaaaatccaggaagaatgaattaagcttcttctgggagttgtttattcctgctcgtgcttaagattgatgatttcgtgaaataaagaacatcatttcatttaagagatcatttcattaagatctctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatcgacataaactcctgccccccaacaatgccatgagctgcttagcccaggagacctgggagctatggcaggacggttaggccagccgatgagggactgcagagaggctactggaaggttaaggacccagagagaaatcgagaggtgccctacagcagccaggcctatcaggatccgtcacacacggcagcggcgtggacaccggcctgatgcagagcgtgacccctcctgctgggacctgtgttgtaagctcctatttgcttatcttgtttatttcaagcagaaatcaataaattccataaccctctgtattgactgcaatgtaagctgctgaggagactggttctgttggtcagtcaggtgtttgctcagccctgtctgatcacctgtgctgctctgtccctaactagtgacccatggaagcttccaagcagttttctcttcatcactactaacaaacaaaacactaagaaggcttagtatcgctctttttctgcggggctactctgaagtactgacttgctttccagtctgattcacgttagcagtgtgtacactactgtatcatcatcagcttcatcaccctgtaaaccaggctcctctgaagagactttggtgagatgaacgtgaggtaaaaatttcgttcggcaaaaagtgcaatatgtgtggtactttattttttatgttctttttttaaatctggggtattagtctgtgctttgggagaaatgcactagctctgcaattcccagctgggcaagtgtgtct

SEQ ID NO: 67168 - DNA, 1475 bp, Homo sapiens
agctgtcactcttgtagcttgaggcccatctcctatcacctcccagtccaacagcgaggcccatacagaggacaccagtggggtttggtgaagaattgcttgtaaaaaggggctgttcccactttcctcacataatatagaagtgacttgccataattcctctcagttatttccattcaagataaaaatagttgcaagtttctctgtaacagctcagatgttctacaagccccattggatgccactctgtgtggaaatggtgtgaaaagccccagttcagcagtcagtgggtgccagccactgccccagggccattcattaggagggcgatttgtggcttacagatacattcagaaaaggagagcagcagggcttggctgcctcgtgcggatgccagactgcgtttagttcatggggaaaaatctgacattctcacacccattctagtaggttcgcttagtgaaaattcaatgaagtaacatcaaaaaggctgccttttaagtcacatggcttttcattttatgtgaaccgaaaccatgaaaacgttttttgccttttgttgaggtccagaatcgcagtcactcatcttagaacattcttgccttcctgaggggctgcacacttgtccgtgggcagctccagccgttcctgcagtggccgcacagtgagaggaagggctgggtgaccactgtccagttggattccaggggtggccagcccttggagtccatgtcgtcttcacagaactgggcctcagggaggagagcttggctgaaggagtgggagtgacagttacacattttttaggcctaaaccacagacttctttgggaagaaaggggttacgtcttcctacaaattcagagccagctgctcatgccatgaatgcgtggtatgacccgatctgagtgtggatcattgaggcggccctcccatggctgacctgctcagctctgacagggcccgggctgcctctgctagccgaggagttactgagaataagttgccgttactcgagccttggtcactgcagcaccttgtcaggcacttcaaatctcatgtcatcctcacccaccctaggtggtaggtgctatcattgttttttggtccctcatgaatctcctccaacccctggcatgtctatttgggaatcttttttccaggaaaggaggcccagtggtgctaggcctctgaggcttcagttcatttaactcagaaaaatcccccgccccatgactcagggagccttccatgcatttgtttcacttaaggaaaatgacccgagggtgagatggaaagggaattggctgttgccaggcagagccctgtgtgtcaggggccagcagccaagtgagtgatccaggaagtcatccaattgcaaccagaaattgttcttaacccctcactgtctagggtgcgtagtggacttgccaatctgtccgaatggggtgagcgtgagcgcgctgctgttgagag

SEQ ID NO: 67169 - DNA, 1127 bp, Homo sapiens
gctctgtaaggctggtatttttgtctgttttatcttctactgtatcgccagtgcctggaacagtgtctggtgcacataataggtgctcaataaaaatgtgttcaatggatgaatttctaaaatatcctccaatgtgtgcatggaacaaataatcaaaagaaccagactgtgtcttattctcccactgacagaaagattttcctgctttcaggaaacaagctttatgtggcccttttctggtcccctggcttagactacagttctgtgtggatttgtctgattgcttcagacatgtaatgttgtttttcatccttggcagcttacatcagttgtttgtttgattagaaaaatgaagcagacacacacacacacacacacacacacacacacacacacacacaaacatataacctatgccaataaaaatgtctcagcaacagtggaattcaccttggtgtttctctctgtaatttgtgtggggtttacccctcacaggtttaagagaccaggtcttgtttctctctctgtgctaccaagaagatgtgaacctgaggatgcatcttgtttcataagaaggaaggcaggtgaatatgtggtttctaacgaggtcttgttgaaataacgggctgccctcagctcacagaaataccacagctcagccactgtgatgcagagccccaggggtctttgccagacaacttgtcctgactcaacagagacggcagcctgacctttgagctggcttgtccaggcattcaggttgcttgcgtagacttccagggaagcaagcctgtccttcctgacccggcggttaacctggtgcacttttgttcctttgttaactgttgtgttgtcactaaactgaaaggctggggcttgcccttagacgtcacattggctctgtccctgtggcgatggcagggcagggtggccaaacaggtcaggtgcttgttctgtcctcttgccttttacttaaattcctctgacttttaaaaatggtgacactcttatcgtaaagcttcttatttttctccactgcttggatatgaaactgtagagggagaggccctgttgcccagtgttctcctggtttagcagctgaggtgactgcagtctgatgtgatgta

SEQ ID NO: 67170 - DNA, 1603 bp, Homo sapiens
agactgtctttcacagataatacttttgaatgtcagtgctttacagggagaagtgaagccagtactacagaagttaggtcaagatgaagacatggatgtcaaatactttgcacaggaagctataagtggtatgtatttccttcttttgccttgcagcttatgccttggttaactgggatttatctctattatgtgagaggtgttaagtgggtaggatgataagtattatgggaaacagggagggtagtaagttcctggaatgctggtgtctctctgattagaaccctcttggcccaccattttctcataagtgagcaggctatttttcttagttacatgtaggactgggtaggaaatacgattctcactggtaagaatagtttttcgtttggaatttaaccagtttttaaagtttcacttctgattagcctggctgagtaaagacagtaaccacagtgagaagttgttagtttgatacgtttggatcattgttattgtgcttaatattcacatagatcgttcgtgaactttctgtaccactaacctgattttgtttggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattc

SEQ ID NO: 67171 - DNA, 2055 bp, Homo sapiens
taattttttgtatttttagtagagacggggtttcactgtggtctcgatctcctgacctcgtgatctgcccgtctcggcctcccaaagtgctgggattacaggtgtgagccaccgcacccggccaattatcccattttacagatgagaaagctgaggcatagagggttaaagtaacttgagcaaggtctttcaacaatgacagatctgaaatttgagtgcatctgatttagttccagagattatgctctttaccatcttacggacttttcttgtagtctttagtattacggacttttaattgaaatttctgattaagatcatttatgttccttgagttatttatgtattcactattatttcttcaagattatccatttttttttcacctgagtcttacctcaccttttatcttaccctgacaggagactgttgggcagagtacttgatttttaaatgtggtcttttggggcttgtgtacttgcagtgtcctgacgttcgtttgaatatcatctccaatttggattgtgtaaatgaagtgattggaatccgtcagctctctcagtctctccttcctgccatagtggagctggcagaagatgccaaatggagggtccgcctggccatcattgagtatatgccgctgctggcaggccagctggtgagtatgtgttgctccatgaactgcagggtagtgtcagatagtgacaatttaccatggcaagtaggaggcctagtagcctgtatgcttatgtttgtttagatgcatgaaagtatggccttgttcttgttacctataggatggtttttatgtttgttagtgcatacgtttcttttcttttaagatggagtttcactgttgttgcccaggctggagtgcaatgatgcaatcttggctcactgcaacctccacctcctgggtttaagcgattctcctgtctcagcctcccaagtagctgggattacaggaatatgccaccacacccagctaattttgtatttttaatagagatggggttttaccatgttggtcaggctggtcttgaattcctgacctcaggtgattcacccgcctcagcctcccaaagtgctgggattccaggcgtgagccactgcatctggcctattagtgcatacatttctaacaaaaaggtataggttgagtatccctcatctaaatacgcttgggaccagcatgtttgggaccagaagtggattttggaatatttgcattataaatatttactggttgagcagcccaaattcaaaaatgcaaagtccagaatgctccaatgagcatttcctttgagcatcatatcagtgctcaaaaagttttggattttggagcatttcacattttggatttttggatttgggatgcttaatctgtattacagaaacatatttcacctcatcaccaccgaaaaacaaagccatagaataatcagtttcttggtatatataatgtaaattttataatatttaatgcctttgtgacttaagaaatgtttaactgagaagaaaagggattatggttttagggtaagtctgctgtgatttttgctcaaggaaacttccctgtttgccttgtattctaagcaaaatgtccctaggtaccacttgccctacattctgattaaagggagttgaggaatcaccatatagaaaagaagtattgaaaggccgggcacagtggctgacacctgtaaacccagcactttgggagccagaggcaggcgaatcacttgaggctaggagttccagaccagcctggccaacatggtgaaaccccatctctactaaaaatacaaaaattagctgggcacggaggtgcacacctgtaataccagctactcgggaggctgaggcaggagaatcgcttgaacccaggaggcgaaggctgcagtgagccaagattgcactactgcactgcagcctgggcaacagagtaaaactttgtgtcaaaaaaaaaaaaacaaaacaaaaacaaaaactgaagcttgtaatgttagtattttggtcaaagtccacattatcacattatctgttactgtttga

SEQ ID NO: 67172 - DNA, 1038 bp, Homo sapiens
ttttttgagttggagttttgctctgtcacccaggctggagtgcagtggcgcgatctcggctcactgcagcctctgcctcctgggttcaagcaattctgctgcctcagccacctgagtagctgggattacaggcacgtgccaccatgcctggctaatttttgtattgttagtagagatggggtttcaccatgttggccaggctggtgttgaactcttgacctcaggtgatccgcctgcctcggcctcccaaagtgctgggattacaggcatgagccactgtgcctggcccctcactgatttgtcttgtatattttccacttgttcaaaggacgtaggtgtcacgttgacattggctgtttacatttggaaagttgagttcattaatcccatacttttctaatttctgtgtttttctagccacagcttcctcaaagttattctgtccttgatcttcgacatttaaatccaactgatttttgtttttgatttctaacttttaattgttctgtgtatttctttccaagtcattatcttatgctgcctacactcctgttactgcgaccctgatctgagttttttgaaaactaagctttctaagtgatttcctttactcttactcttacctttgtcctaatctgttataaataacttgtacaaatattgttttcatttttatccctcaactttctgttatagtaaggctttgaaggcatcattaaaatgttttttttttcttttttacttaattttaaaattttcatttcctttatagaaactctgcattctagccaaggtaattacttggctgtttactcatagtacaaagtcatttctatctttatgactttgacatgccattccaggcaaagggagcagctctttctttttttttttttcctttttgttttttgagacagagtgtcactctgtcgcccagactggagtgcagtggtgcagtctcggctcactgcaagctccgcctgctgggttcacgccattcgcctgcctcagcctcccgagtagctgggactacaggca

SEQ ID NO: 67173 - DNA, 1510 bp, Homo sapiens
ctaccatctctgtactttaccttttttttttgagacaagagcctcactctgtcacccaggctcaagtacagtggcacaatctcggctcactgcaacctctgcctcccgggttcaagtgattctcatgcctcagcctcctgagtaagctgggtttacaggcgtgtgccaccatgtctggctaatttttgtattttttgtagagacagggttccaccatgttggccaggctggtctcgagctcctgacctcaagtgatctgcccacctcggcctcccgacggctgggattacaggtgtgagccaccgtgcctggccagtctctgtagttttcacttgattgttctgtcagaaactcctttctgccctatggctaatggaaagttgctgaatgtgttctgaaaaaagcaattttgcattcagcattttataggttggataaaaggatgggatggagatggtggataagggttgcttgcacctctgggaatggtggaaagatactgaaaaggctgtggactcagtgacctgacaagctgttatcctgtatttgtggtgcctaacattggtcatagttttgtacttactcttgaggaaatatacatgatcctgtctgaatttggctatgtatcttttaaacctagtgattcaactcacagtaatattaatattgtgtcaagtcttttacactgtgtcatttgtagacaccatctgggaattgccatctgggacacgagatcttggcttttctacagaagtcgtgtctttgggttggccgcaccatatgttatcactgtgtgagctgaaagtaaccatttggtatgatgcagctaacattctggttacgtgtaccacctcccttcagtcactttaaaaggtgattatctgtttctaacctgattcaataagttttcttctctggttttcctttttaatccattcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagtaagccatggtatttttttgccttgttaaagcagaaatcaggtagtaagctatgagttatttgggattactggggacttgtagctgacaatttacatagtaccttgttaccaatgagtggctgatactaggatagtaggatttatgacatctttcttttttttttttaagagataaggtcttgctctgttgtctaggctggagtgcggtggcacaatcatagctcactgcaaccttgaactcttgtgcttaagtgatcctccagcctcagcctccaagtagctaggactaccgacatacactactgcgcctggctaatttttaaaaaaaatttctg

SEQ ID NO: 67174 - DNA, 2413 bp, Homo sapiens
ggaactggctcggcttgttgggtagaaagcgggggtgggatggccgattaatctggacgagtagtgtatccgctctgtgggaacttttctttgaaaccacaggtgttgtattcaaccgtttcacctgcttcaccactgccaaagtgctctctttttaaaattatcttacttcctaggtgttgtattgtctttccttcatttctcttccggtcccttctgagtgtttctcctgggaaatcctccgccggctagtgaggccgagttacacttctttttggaagtccttatgagcttccttaacagtaaaatctaaatgaaaggttatcttcattcttacccctgtgtcataatttcacctgttagcaccttttgtcttttgatctaaattcagccgtttctttacattgttcttctttctactttcttttctgaagctccgactcaacagtattaagaagttatcaacaattgccctagcacttggagtagaaaggacccgaagtgaattgttgccatttcttacaggtatgtgaatctttgtttaaagaaaggtagggacattccattttccagtagctttcaacactgacttttttagagtttattacccacattaaaatgagccaggtgttttttgtgcaaaagaaacagaacagagtatattgttagttgtggctagatatattcaaacatcaaccatttagctattgaaagtaattgatacgggagtatgaatttctaattcgttgtgcaaagcagatacaggaagacggttgagaagaaagaaaatgctgttaggattttgactgggtcaccttcctggtcgcatagtgaatctgttcctagttttgtgtcagtgtccagctgtgggagagctatccatgttgatgagtcctgttgttgtcacttccagatacaatttatgatgaagatgaggtactattagctcttgctgagcagctgggaaatttcactggcctagtgggaggtcctgactttgcccactgtctgctggtgagtatttataagctgcctaccctccttctacaacttttgcagtataaatgatacattgtttggtgatagacacactgcagcattttttatgcagatctttttatgggcagatagtcataatgttagtcattgagagaataagtactgtaggcactttgcactcaactccttttttttttttctgtaaataagagaacttcgtcctccttttctgcgtctgtagacttattagtttagatgtagggagaaaaagggtttgattgtttttatggttcccccgcgcgatggtggaagttttaattctcacctagcagcattttgtctttgtcagtttaacttttgcttctgactttgtgagtttgatgaatttagttcaatttaattgacatttattgagagtctactttatcagacacatcatagtttacaatgttaatgttgaagaagaccaatgtgagggggcttggtggcacaagcctgtagtaccagctactcaggaggctgagactggaggatcacttgagcccaggagtttgaatccagcctgggcaacatagtgagacccccatctcttaaaaaaaaaaaaagaccaccaaaatgaatctaatgaggtcactgcctttatgtgtcagcaaataattaccgtgcagtcgtaaatggaaagatataagtacccacaaaatacccacgtaatagaagggagaaagggattcactccgggtgatcagggaagaccttgggagatgatgtctgaactaggttttaaaggatgaccaggaattcaacagttggacaaggtaggggtgtatgtgtcagagctttgaatactgggtatgtaatactgattcttgtgatttctgtctctagttctgacttttccatggaactcctgaggtagattgattaatagataagtatgaatatatatatatagagagagagagagagagagagttttttttctgtctatgtatataggcctatgcttttttctacttgtatgtcaaacaggtatttcaaacttaacatacccaaaacaaaacttagctttatcccccaaatacacctctcatttagttgttccacttcagtaaatggtatcactatcttcccacttgcacaagccaaaacctagaatgtattcttgaatcctctgtgccttgttccacacatctaatccattagtaattcctatagagtctacgtatatttcaaataagtccactttcttccatccctcctattaccagcctagtccagactgtcatctttcctctagattgctgtagtagcttcctagcaatgctttccactcttgcctctcacccgactcttacagttcacatcacccagcagatggctcactctctgctatagctcttagaaaatccaaatt

SEQ ID NO: 67175 - DNA, 1043 bp, Homo sapiens
atggggaaactgatgcttggagatattattaagtgtcttgcccaagatcacctaggtagaaaatggtagacctgcaattcaaacccaagcagtctgacgcctgagccgctcttttaaccgtgacttatagtccctatttcataacctctttgaagtctacagtcttttttggatgatatgttgggggaacctagacggagtcagtaggcagagatgagaacaggatgtagtcaaagttgtttcactttatgaaaaataagttatttatttatttagagatggggtctcactatgttgcccaggctggcctcaaactcccgggcttaagtgatcctcccgcctcagcctcctgagtagctgggactacaggcacttgtttcagttttttatcaccttcttagtccacttccagtaaccacagcctggagagtgtcctagtagaacagtatgcagctggtacatgaagtgtttgtaggggcttttctagaacactgggggcctccagctaattttaaccacatagctaaatcagagagggagttgatttcctgaaatcctagaagttagtggaaattccagtttctgattacagtcccagctggatttctgccgaaatgtgactttcgtgtccaggggatcttggcactggtcccttcttactcctgtgacttttctcctaccagttctgctgagtagatcagaaaaggaagtggggaagaataccatcttcaggggagaccaagggcaaaagctttcaggggaacaggaatattttaagttggccctgctgttgctaaatcaaacctctgtctagttggatcctgggggcagtgtgcctagctgctgaaatctactatttatgttggccaggtctagtacaagacatgatgataagtggccgggcgtggtggctcatgcctgtaatcccagcactttgagaggctgagtggagaggactgcctgagcccaggagttcaagaccaacctgggcaacatggtgagaccctgtctctttattttttttcttttaaaaaacgacatgg

SEQ ID NO: 67176 - DNA, 1041 bp, Homo sapiens
gaaaattgcagcccatactctttattaccgaattcaagtttggaaatagaccctttgttttaaatcatgatgggtctttatcccaatcatttatctgggtcatttttccaactttggagttctaggaaagaaccttgaaaacctgatatgattctgcagcatgaggtctacggtgaccatttgggcaaagctccagtggcaatcatttattgtgttttgcatttcctgggatttattgaaataagaattcactgtgattatgtagtcttctggctagtatcaggcagctctgcttttaatttggttaattttattttctctgaagagggagaagaggtacaatttaatcttggcctccacaagcatattaaagctcacgtgttaatcagtgcattcttatgctcctacattaaatgccttgggtaaatggataaatggacatgtgcccagctttaattttttttgcaacagaaagatcagacttccgtatggcatcgttggatttcagaggctttctggtgtatctgtaaatctgaatgttgccttctgccagtctgtataaccaggtgattcatgctgcaaatgaaatcaggaagcagtaaagtgttaaagcaagagtattgtccaattcacttgtcttcctgatccttgtactttatttcacgtgtcggtgtttacattacatacttatatttcctgtgaaagaaagagttaaataaattgtagcagtttgattttctttttcttaatgtgacattttctcttttgcttttaaatctttcttggaaattggaaactgaaggagctcaagtcctttctccctgactccagccctattcctcagtgtggagacctgccttctacaggccaaatatcccagaatgtttattctgaaaactttagaagaagactttgggaaacccagtgaggattagttttattttaactatgttaaaaccacgcacagtaggaattaatatatgggccaggcgtagtggctcacgcctgttatcacagcactgtgggatgccgagacgggtg

SEQ ID NO: 67177 - DNA, 1685 bp, Homo sapiens
tattgagatagggtctcgctctgtcacccatgctggagtgcagaggcatgatcttggttcactgcaacttccacctcccgggttcaagcaattctcctgtctcagcctcccaagtagctgggattacaggcatgcaccaccatgcctggctaatttttttgtatttttaatagagacagagtttcaccatgttggtctggctggtctcgaactcctgacctcaaatgatctgcctgcctcggcctccaaaagtgctggaattacaggcgtgagccagtgcacccggccgataatatatttaaaagtataagcacttttcacattcttcagaaattcatgagaaatttaggttttcagttcttatatttcagtaataagtagatatattataatttactagggacatgttgtcacaacatgaacttgtgtgtagactctttccttgacttagacaatactggaacactatgcacaggtacccaggatgtagttttcttgccctttccaggaaaacttagagctggagtccaggtcatttgagtacttggcatctctacagtttcttagatgcagaaaccattttggtgttaagaattcatttcagcaatagaagtcctttgattgacctggaatttttctatggcacattctaatgcaaaatgaagacctagagctattctgaaggatatactgtggcttattagggacaataataaattttcgtttaggtgacaaggtactcggccttgattaagtcttttatcgtgatctagtaccgaaataataggcttttctgtgccacttgaataaaatataatccttactacagattagtttatttattttaatcacatttagtaccattagtaaattctcccaagtgataaaattcttttttttatcccttgtttttcagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagtcaaagtctatttcaaagtctaatcaaagtcacatttgctccctgtgtgtgtctctgttctgcatgtaaactttttgcagctaggcagagaaaggccctaaagcacagatagatatattgctccacatctcattgtttttcctctgttcaattatttactagaccggagaagagcagaaccaacttacaggaagaattgaaaatcctggtactggatggctgtgataagctgttctccacactctggcctggcatctgagaactagcaagcctctcttaggccatatgggcttctccaccaaagctgtttggcagctcctagcagaccttcttattgaaatcctcatgctgaaaatgaacacagcctagttgccaacccacatgtccttttcacctccagcaagactaagcttctttaaagcacttcacaggactaggaccctgtcctggagctatctcaggaaaaaggtgaccatttgaggaactgtgacctaattttattata

SEQ ID NO: 67178 - DNA, 1029 bp, Homo sapiens
accatagaggcaccaaatcatgtgctagaactttaaagaaaggagggacctgtggagattagagtacacttagaaggcttccagaaggagggggtgcttgagctgaagaaaagtaggattaaataagtactggtggtaaggagggaagaaccacttatttaattcaagaagcaatcatgagtaaaagtggaaagatataaaatgcctgttggatgaggggcccattagtcagcatcaaaaagttctatttacctctttggctggtttgaatttgcttttatgtaaggtaatctataatgtatcatccacatcagaagtcttttgaaagtaaaaggggtcctgtcctggataaattgaaatatatggtcatcttgctttaatgtgacccgagcaaagagacttgttccaaaaagcaggatgggagaaagaagatacatagatatattttctttgttccatagtccatttactatgtggatttgcccatggtttacttatttgatttaacttgctgacaattcttattattgtggcctagattgggcctcagctgtctgaaagagaagcaatcagggtagtttgaaggcagtaccagcatgtttgtttgtttgtttaaaaaaaaaaaaaaaaaggaatcagccgggcacggtggctcatgcctgtaatcccaggactttgggaggccaaggcgagcggatcataggtgaagagattgagaccatcctggccatagtgaaaccccatctctactaaaaatacaaaaattagctgggcgtggtggtgcatgcctgtagtcccagctactcgggaggctgaagcaggagaatcacttgaacccgggaggtggaggttgcagtgagccgagatcgcaccactgcattccagcctggtgacagagcgagactgtctcaatacaaaaaaaaattatactgtgagttatatgtaattggagtttccacttcagggagttgcaacctaaagatgattgggacaattttgtgattggggcaaatttaggaattccacatg

SEQ ID NO: 67179 - DNA, 1040 bp, Homo sapiens
cttgatgcttctaggtatgtggctttaatcctatgggatattccaggactagtatgggtaaaaattggattctaggattatataacttccagtcctgggttgactctagtagccatcgtgtgtgtgtgtgtgtgtgtgtaatggagtctcactctgttgcccaggctggtgtgatctcaactccccacaacctctgactcctgggttcaagtgattcttctgcctcagcctcccaagtagctgggattacaggcgcacaccaccatgcccggctaatttttgtatttttggtagagacagggttttaccatgttggccaggctggtctcccaactcctgacctcaggtgatccacctgccatggtctcccaaagtgctgggattacaggcatgagtcaccatgcccggcccatcattttctttttatttgggcccagtttcctgagaaatcttaaagatttcttttttgaggcaccagaatgcaaagtatattctggtttcgcccaagtgaaagcatccaagtaaagcagataggtctgctgaagaaagcacaagtgtttgacactgattatttttggcaaccaacttcagctatcttaactgagagcattttgacactgttaggaagattgactatgccctttgaggaactagaagttcatgttcattattttcaggctcaaggctcagccagggctgagataggccttattcagtcttaaatagagagaccaaatggaccagggcttgactcgctcttcagaaaggtctcagaattaatgataagaggggatcaggcattcagataagggagtaatggggaagaggagttggaggggtcaaggtgtctgagggcagaggtccaggtaaacagacagttggagttaaggagatccagggaggcctggtgagcagagcccaggagccaggaggtctggaaggaagcaaaagacagaggacctggtcctgagagtcaggtctggggctcagaaacggactgggcccaggcccaggacaggactccagaaagacgaagtaag

SEQ ID NO: 67180 - DNA, 1039 bp, Homo sapiens
ttctattagccattaacttgacatttatatgtgtcctaaccaaatctagtattgtgcttgttgttagagtttagatctcttgggagagctaaggagtatattcttctctccttttgatgcctttatggcattggagaaagtgtgaatacaagagtagaaacattctatggagtgtcctagggcatactcctaaatttgagatcaagataacactaaaactaaatatgttgttttgttctaatataatgaaagatgggtatttttctgtgtcttgcagttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcaggtgagtttcagggagaagtgtatctgcctcattcttttttacttattaaataattgctcacaaacttaagtgcaaattacagaatgcttccacctaagatattttatccataacattaaacctgatatagatcatattattaaaccttcttatattgattgcttagctgtttaccatacttgtatttgctgattacatgtttgcagtgttaatttgtgtgttactttgcctctgttaccaacaggaatccaattgcagaattccattctgtggcagaagtaatggaatgtctgctctttgaactgctagatcataacaaaacttgctcaagagtttgggatcacagcaggcagttcacagtatggggcactttgtaatcctggttgaaaacctgcccaggtcaattctctggcagagctcatcttaactctgtttgaatatctctgtacttacggcttcagtagcctcagaaccctgtattgccctctgctaccatttgcagttggcagaaaaaaaataattaggatgataggtttttttcttaacaggttttttgagatataattcacaaaccatacagtttacctatttaaagggtatgattcag

SEQ ID NO: 67181 - DNA, 1045 bp, Homo sapiens
ggattacaggcatgagccaccacacccagccaccaactaagtttttttatcactctttcctttggtctgcgcgatcttgagagaatagttaaattgaaatggcagttttattattttagccctatgtggctctaaagcgatttaaattatttggtgcttctcaaaagtattagttccattggggcatagcaatttgggctagatatagtggtcagtatagaaaatacagctaactatttgaaacttgatttctccctaaatcctcatgaccaatcccattctcttccatctcgctcttgtgcttcttttgtgtagcttagcatgggaagagtgggctgtgcactctcattcccatgaggcataggatcatcagtgttattccaacaaagaacattatatgtcaagcaccgtaataggtgttaaaggcatccactaatgatttcttacctttatgtctccctcaggtacagaaccctggtatttctatttaattaatggatttctgaatttcaatgtagcctttgctttggctctcctagtcctaccactgacttctcttatggaatacctgctgcagagatttcatggtgagtggcataagagatggtaggtgttttgggaggaaagagcaagtaatggtgtataccaagaactgaaggaaaatcctacttactttattttccacattcttcctatggaaatggttggcttactgaattttcagtctgtgtttgttgatccattgaacccttgtgaagatttggtgaattgtggcaaattaaattgacaggaggaagagctttattattgctttaagtgaggaagtcaatataatttacacaatcacccagggaagtaaaaatatttataaaatctcagaaggaggccgggcgcggtggctgacatctgtaatcccagcactttgggaggccgaggcgggtggatcacctgaggtcaggaattaaaaccagcctggccaacgtggtgaaaccccatctctactaaaaatacaaaaattagccagacatggtggtggatgcctgta

SEQ ID NO: 67182 - DNA, 1093 bp, Homo sapiens
atataaatgtttaccctttctattgttcctggttttcttttttttttttttttttgagatggagttttgctcttgttgcccaggctggagtgcagtggggtgacctcgactccccgcaacctctgcctcctggattcaagcaattctcttgcctcagcctcctgagtagctgggattacaggcatgcaccaccacacccagctaatttttagtagagatggggtttctccatgttggtcaagctggtcacgaactgttcctggttttcaaagggacctttctacactttcctggctaggtagcatgtattagtgagacattctagacttgagctgacacctttcatttgaagctggggaaaataaagggagtacattttgaaagatattaattacaatatcttctgattattgaatgcctactgtgtgtcagaagttattcacataccatcttttttcactcaaaacactctgagacaggccttatttatttgtattcctggatgaagaaactgaggttgagatggtggggaatatgccacatagttaaaaaagtagcaaaagtgggataagagtctagtgttgtctgacttcaaagcccgtgttctttgcactgaaaacaagacccttagcaaaaccctggagtttggctactgagactttaccagagaataagcttactaaagcagagagcatgagttgagggtgggagaagataggatccaatctatagaataggtggaaaattatacctttgaaggtttgtgcattttggtttggaaagtgatcaggagcccctagcgagcttgagtggcagagtgacgtgcacactggcaagttctccttttacatgggagcgctgtaccagacccttttgttgaagaaagaaggagtgtttggataaggtaaagaacatttggcacttagaaaatttagaataggatagactagaattgtgaagtcttaggcaaaatgtctctgtggggtcagagatcaagaggcgaaatttagtgttgcagaaaagaaagtgattggtcttgtcactgattttgcccctcataacatttcaagttctcagatgttgatgctggcaa

SEQ ID NO: 67183 - DNA, 1022 bp, Homo sapiens
agaggccaggtgcggtggttcacgcctgtaatcccggtactttgggaggtcgagacaggcagatcacgaggtcaagagctcgagaccagcctggccaacatggtgaaaccccgtctctactaaaaatacaaaaattagctgggtgtggtggcacgtgcctgtaatcccagctactcggtaggctcagtcaagagaatcgcttgaaccagggaatcaggttgcagtgagctgagatcccaccactgcactccagcctggtgatagagcaagactccgtctaaaaaaaaaaaccaggagtgagaaaaataagagtcattgaacttcatttttttaaaaaagaatatcactttgctgtcctttctaatatagcatttccccaattatgtacctgtttattgacattttataatgtaggtaaatttttaatcagtttttaattgatacctaattaacctcgagctcttgtcctcctgccttttttcacttctttactcttgcagcattccttcctagtagcttctgtatgtacactacgttgatagccatgactggatggtatatggacaagacttccattgctgtgctgggagtagcagctggggctatcttaggctggccattcagtgcagctcttgggtaagaaactaacagttctcctcccatatatcgctgggcatatagtaaatcttaatgttggattagctccatattgtctgcatagaatctgaagttaatcaattgggctttcaaagattctgggaaatggaagaatatttctcttagcacttactattatgattaattctaataagaataatgaccattgagcatctgctatgtgttaggcacagtgaaacccttcgtaaaccttatcttgaaaccttacaacaactctgcaggagaaatacaattattagtactttataaatgagaaagtagactctgagagtttgaataatttacctttaagattatgtttgcttttgaatccaggcctttttgactctatagctgatgttttc

SEQ ID NO: 67184 - DNA, 1091 bp, Homo sapiens
agcctttttttctgacaactaccatttattgagcaactatgtgccaggcactctcctaagcacttttccttgcattgtcctcacagaaaccttacaaagtttgtattattatcattattttatgcttgaggaatcagacagagacattattcaaccagagtagggttccactgctagtaagtggcagagccagaatttgaatgtgtgcccacctgtatctgaggtctattatttttcaccacatcattctattttccacttgatagatataatcttagcatgtaaagaatacattttcttttaggtagggagcttctcttctgtgtcagaaataagaatgtttgggtttcttatgcacagtgaattgctaacaaacctgacaaggtagttttgtgtttgactttagatcttcagtgttatctgtggtacgtgtttttctcctttgatttgaaatgtctattcctaatattctcaatgctgatagtctttgcctttttcctagggctgtgtgcaagaagtttgggttgcacgtgagtcgaatgatgctagccttcttggttctcagcactggcatgttttgctcatcatcaggtaagtaaaagggcagatgagggaattgcaggtcatcaccaggtaagtaaaagggcagatgagggaattgcaggttcaccaatagttcacagttgcatttaaaggaagcatttgtccaaatgtaggttatatttgtagaacatgtcaataatttgcagagcactgttatctacattatcttgattgacctttgtaacaatcctaccatgtaagtaagaaaaacattttctcacttttgcaggtaaggacattgaaacgtagatgaaatgatttactaaaagtcaaaattcataaatggtagagctggtagtctcaccaggatgttttctattccattcttgcatcaaccacccacctcctttcttggccattagtggaaagaaagtaattcttttattttgtttaaagaagttatttgtacataaagacctgttgttgatgattctgttttctactgatgatacattatttgatatgtattctatgtgcatcttctgctg

SEQ ID NO: 67185 - DNA, 1029 bp, Homo sapiens
aggctggagtgcagtggcatgatttcggctcactgcaacctcagcctcccgggttcaagcaattctgccatctcagtctcctgagtagctgggattacaggtgcaaaccaccacgcctggctaattttttgtacctttagtagagatggggtttcaccgtgtcttggtctcctgacttcgtgatctgcccgcctcggcctcccaaagtgctgggattacaggtgtgagccaccaggcccagccgagaatttattttaaattgttctgggttggtagtgcccgtggcatctggcaaaaaatttctctagagaaatggacccttaacccaagtgtctgaaaattaccagagataaagttctagtgaacaagaaattataataaaaataaatcagagcacagagggagcaaaacattatgggtgagaatcagcagaaataacagtcaacagaacgttcacctgaaaaacttcatttattgggaaataggaatataatgtaagtatatttaacattttcaaacaagtaaaagaaccaaaaacatgaacaagaaacaagagatgaccaaataaatttaaaaaattcagaacttataagaatcatataatatgtaatattatataatatgaataatatgtatataatatttatatttaagactcagtagataaacagcagattagacattctgatgagtaaactagtaaattggaagattgatttaaataaattactcaaaatgcagtacagacagaccaaaaaaaaaaggtaatatagaaaaggttaagaaatgtgtaagccacggctgggcacggtgttttatgcctgtaatcccagcacttagggaggccgaggcaggtggatcacttgaggtcaggagttcgaaaccagcctggccaacatggcgaaacctcatctctactaaaaatacaaaaattagccaggtgtggtggcacatgcctatagccccagctacttgggtggtagaggcacgagaatcacttgaactcaagagacggaaattgcagtgagc

SEQ ID NO: 67186 - DNA, 1052 bp, Homo sapiens
tgatcctgtatcttaggaccgaaaatagggttctactaaatcctatcaagtaaagaccagttagatagtttttaacagaattaaaatgaatgatataaggatatggtatttatgacctcaggaaagaaaacgataattagaagtacagtgttcccttcaactgttggtttcaaacgagaagtcacacttcagatttaatatcaggagctacaggtgatgggtgcatcaaaatctcagaaatcaccactaaagaacttatccatgtaaccaaaacccacctgtaccccaaaaactattgaaaaataaaaattaaaaaaagaaaaagaagagaacaataaataaaagcaagaagttttcagtcaggccccgctgacccacgacccaccaacccacgaactggcccggccctcacgtgcaccatgtctggctcctccagcgttgccgctatgaagaaagtggttcaacagccccggctggaggccaggctcaactgcataaaagtttcccaggcagctgcagacttcaaacaattctgtctgcagaatgttcaacatgaccctctgctgactagagtatcttcaagtacaaatcccttcagaccccagaaaatctgttcttttttgtagtaaaatgaatttcaaaagtttcccaaaccacttcttatgatccagtggatattcaaaagagagctaaatttgaagcctgtacaaaagcttatccctgtagcacatgtgctgtaatatacgaacttctagtttcatcagtctttaacatctacctctctgaatttcatgaatttctatttcacaagggtaactgttttatccacactggcagcagcatacaataaaactcagtatgaaaaaaaaagttttctttcccagaaaaaaaaatatgtatatgatatatatatcaggagctaggaggaaagtgttttctacttctttctcttttttttttgagatggagttttgctcttatcgcccaggctggagtgcaatggcacaatctcagctcaccacaacctccacctcccaagttcaagtgactct

SEQ ID NO: 67187 - DNA, 1027 bp, Homo sapiens
cagctttgtggccttcaagtgagtgattagttggcttgggataaatggagtgacataaatgcattgagctaaagtgtatgagttaatttatgccttaaaagcaggaagtggaaggagtgattgagtgattaaagtcaattcttcagaaggctgaggcaggaggattacttgagcctaggagtttaagtccagcctgggcaacatagcaagaccctatctcataaaaattttttcttaaaaatctgaatttttattaattttactgagaaaaaacaactagctattcacctttttaggtgaataacttaagtgctttgatgtcccttgccctttttgtcctttctatctagatttaggtcttctgattagcaggtccttcctgacatgcttttttttttttttttttttttgcttttgaacaggttatctgggaacaaagcaggacaagtctgggcacctgaaggatctactgctttcaagtgtctgctttcagcaaggttatgtgctgctctcctgagcaacatctctgactgtgatgaaacattcaactactgggagccagtaggtgatttctttagttttctctttttgttcttgattttgcagcataggtgttattaccaatcgagagacaaataatatacaagtgtgactcctagtaaaataactgtattttcttaaaaaaaaaaacaaaaaaacaggcctataatcccagcactttgggaggctgaggccggtgaattgcctgaggtcagaaattcgagaccagcctgaccaacatggtgaaaccccgactctactaaaaatacaaaaattagccgggcatggtggtgggcgcctgtagtcccagctactcgggaggctgaggcaggagaaatgcttgatcatgggaggcagagtttacagtgagccgagatcacaccattgcactccagcctgggcaacagagcgagactctgtctcaaaaaacagagatgggggctcattatgtcaccgaggctggtatttaactcctaggctcaagcga

SEQ ID NO: 67188 - DNA, 1046 bp, Homo sapiens
gccactgcactccagcctgggcgacagagcaagactccatctcaaaaaaaaaaaaaaaaaaaaaagtaactaacagcctcataaaattattgtgaactgaaaacagtgctttacatgattataccacaagacatgatactattggaggtgtccgatggggcatagctgtcaataaagttttgacagaggtggtattttaaactagtatttgaatttcaggagggcagtgaaaagaactttctaaatgggaagaaacagcctaagcaatgaatcatatataggaactgtgcagatattgatctttctgtgacatatgcatgaatgacacaaatgcaaagcagaccctggtcagccaatcttatcagtgagtgggttgaacatttaatttatgcttctatttacttccagctactttctttgcattttttgaggtctaatagatttttgcacataggtatgattggattttaattatttcacaggcaaaccatgtgtatgttgccaactcctgtggtaatttctgcttgtttatgataattagttagtgtttcttttctccctattagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggtaggtaatagcataggtttaagccttctgcgttttcatctctctcactaatgataacaaaatctcatagacagactcaataggccctgccaattaattgattcggtctctaaaaatacttgcttattttaataatgacagacttcatattggtgtctattttgccaggagtcaagataagtcctttcatgtagaaggtgctttgaaccatatcttcaccaggagcttaccttttgaaggttctcaacccagaatcttcaggatcaaactgggtaa

SEQ ID NO: 67189 - DNA, 1083 bp, Homo sapiens
aagagaagctaacttcagggaaggcatcatttgagctagaaggaaggaaatgatcatttattactcatttattgtgttatctagttactcaactctcacttctttttgttctctttgactgtagcagtgcttttagtccctcaatgcctacatctcaaaattaccttaaaaatttagctaattctccatattgtattgggaatactgaagtttttcctgtctcttcacggggcctggggagcgggggtgtggatttaatccatgtagtcacccactgttgctgattgaaagaatggatcaaagggtcccaggacttagagaagaagaaacagaaccataacatagcctggatcattagtacggtgtgcttgtgttatacctggctatgtaaaacaagggcaggaaaagatgctttttctcttctctggtttatgcaataagcttttctattcttgtcttttcccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccaggtaatctaactttgtcttttttgtttgtttgtttccttctgttggcaaaagaaatgtagtggccatttgaaatgcagggatgtaataacttctggtgcagtgatctctcagttttcagtgaagtggttggggcagaggaacagtccgcagctgaaccacctatgctactttactgtcaagttgaatattttattatctgtaaggtttcaaaaggaagggcagtcctctttttctcttacttctgtttggactttatctcttagtctacagaaatttataatgtcttctgacttagactagcttttcccctggtccttgcctatctagacttgtcatttatctgagtcttgcacttaaatcgctcctaaacaaacaaacgtacaaaa

SEQ ID NO: 67190 - DNA, 1025 bp, Homo sapiens
agacacacttggtgcttgcagtgctgatacctgctctttgccggcctgggtgtgcctccttgtcccccttctatccacccaggccgtttggtgcctcctcctcctccccctcctcctccttctcctcctcctcctcccttacctttccgttctctttcccctcttccgagctgccttctcctcctagctacagtgtggcctccctcccgttccctactcctcctgactcccctcttgctcttcccaatccctcctctccagatttcccatttcgcccctgtgccagcctcatcctccctcatcctgcctcttgccttctctctgccctttaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggccttgtttgtactgctccctattctgtggccgggaagctgg

SEQ ID NO: 67191 - DNA, 1047 bp, Homo sapiens
accctttaccccatttgtcttccagtctgccataacgaatgctggaaacacattaaaggctttagtaatttgtaataataactggctgattgatgaactgagacaacaataattagtatgctttttcccctaggatgccttgcagcagagattgactcagcaggacacatctgttcttcagctcaaacaagagctactgagggcaaatatggacaaagatgagctgcacaaccagaatgtgagttaaatgaatgagccttgacctcagtgagccccattagcagaacaggctactgcacgaagaactattagactggccatcctaatctcttatcttgcttctgggatgcctgccttaagtgtctgcagttatttttattccccattagactcatctctgttcctaggtgaaagcccacatcatactgggcaggaaggtccttgatctcctcttcaactttgaggacactgagatacagaggcaaaattgtggttctacagtctaattacttcactaaaaatgtggagagcagctgtgtatttttaccatcataccctctctgtgctgcatactgtaactgccaacattaactggttactaagtagctggtttccttgagggttagcaggcagtacctgcgtgccatgaattctttcttattcttgcaggtggatctgcagaggaagctagatgagaggaaccggctcttgggagaatataaagtaagaatgaatatcagtttggaaatgacttccactgacttttcatgaacagcccgttattgttgctcaaaaagcacttaagtattctattttcatcctttttgatttttttttatccttgctttttagaaggaagcatttttctgtgtcccctgatgcactagctctgaagaatagatggcacagctaggagaaggagtacaggactaggggtctagaaacttcagttctagtcttacctttatctctgactagtatgaatggctcatagtggtcctcctacaaatgccagttcccttcttcattactcttgaagaatccttt

SEQ ID NO: 67192 - DNA, 1024 bp, Homo sapiens
agatcgagctctctgcagacgttgtgcctaagacgaccgagaactttgggtagttctgcactagagaattcagaaaagatggggttccaataggatacaaaggaagcactttccacagggtcataaaggatttcatgatttagggtggagattttgttaatggagatggtactggagtcgccagtatttaccaggagacattcgcagacgaaaattttaaacttagacactcagctccaggcctgctttccacggcaaacagcggtcccagtacaaatggctgtcagttctttatcacctgctctaagtgtgattggctggatgggaagcatgtaatgtttggaaaaatcactgatggacttctagtgatgagaaagattcagaatgttcccacaggccccaacaataagcccaaactactgtggtgatctcaaagtgcggggagatgtagtccagaccaagactgaattaggccttcccttcttggtggtgttcttgagtaagataatctggactggcccctgtgtttgcttccctgcctgctgctgccccatttgatcaagagaccctggaagtactggagattcagaatccaagactgtgtaaataaagtttttttgtatgtggaaaaaaaaaaaaagaaatatgatccccaatgttagagatggggtctggtggcaggtgtctgggtattggaggaggatccctcgtgaatggcttgctgcatgccccatggtaatgagttaaggggaaatctgattgctataaagagcctggttacccactcccctctgtctcttgttccctctctcatgggacacaccacccttcccctttcccttccaacttccaccatgattgtaagcttcctgtggccacaagagaaacagatgctggcgccctgcttcttgtacagcctgcagaaccttgagccaaatgaaccttttttctttataaattacccagccctaggtatttcttcatgccaaagtaaaacagactaacacagcctgctataaactct

SEQ ID NO: 67193 - DNA, 1001 bp, Homo sapiens
gccagtccagattatcttactcaagaacaccaccaagaagggaaggcctaattcagtcttggtctggactacatctccccgcactttgagatcaccacagtagtttgggcttattgttggggcctgtgggaacattctgaatctttctcatcactagaagtccatcagtgatttttccaaacattacatgcttcccatccagccaatcacacttagagcaggtgataaagaactgacagccatttgtactgggaccgctgtttgccgtggaaagcaggcctggagctgagtgtctaagtttaaaattttcgtctgcgaatgtctcctggtaaatactggcgactccagtaccatctccattaacaaaatctccaccctaaatcatgaaatcctttatgaccctgtggaaagtgcttcctttgtatcctattggaaccccatcttttctgaattctctagtgcagaactacccaaagttctcggtcgtcttaggcacaacgtctgcagagagctcgatctttgtgcggccaacttcctgactgccattgctgacatcaaagaacaccatggggttagcagggcttgaagttgccaccaccatggctctgacccggaaacggaagtcgggggatcatatttcagcatgagatttggaggggacagacatccaagctgtatcataggtgtcaagtgctgtctgttgaatgaaagtccccagttggtgttcttttgacatgtggtgatctattttccaagagtgggtgaagtagtccaatagtattaataaatgagaaaactgacaaaagttaagtgtaagatacacatatgtaatagtgttgcatcaaagttgaaggcagtgaatgtaatcactgttgattgtgctaactaaatcagtttctaagaaactaagtcagtttattaggtattagggttatcgtctgtatatttgtgtgctttagatgttaaaagtggataaaaatccagccgtccttttctaaata

SEQ ID NO: 67194 - DNA, 1632 bp, Homo sapiens
gaggacaggatttggcccattgcccacccatactccaggtatctggtctgtttcttcaagctataaatttgagctaaaggtataggagactggaagagtagataggaagtattacctggttgggattatagggtaggagtgagcatttgggtggttactggctgaaatgcagtattttctttcagaatatctaaaatgtctttatctttttctaggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccaga

SEQ ID NO: 67195 - DNA, 3231 bp, Homo sapiens
attggggaagatttccacatatttgagatttactggattggactgttcagccactttctagagaaaccaatttgttttccaggttcctgatcatagcccagtctgtagcccaataattagtcagattgtattttcagttagttgcttttttttttttttctttttttgttgatacagagtctcactccatcgcccaggctggagtgcagtggtgcaatctcggctcactgcaacctctgcctccagggttcaagcgattctcctgcctcagcctcctgagtagctgggattacaggtgcatgctaccacgcccggctaatttttgtatttttattagagacggggtttcaccatgttggtcaggctggtgtcaaactcttgacctcatgatctgcctgctttggcctcccaaagtgctgggattacaggtgtgagccactgtgcccggccagttagttacttttctgtaatgtaaagttatttttagtaacttatttttatttcctttttaaaaattctagattcaggaggaatcagatatgtggaaaataagagaactggaaaaacagatggaagatgcttaccgggggaccaaaaggaaaatgctacccagcagttcaaggtgaagttgcagctctgagaactaaaataattctcatctttttcagaatcatcaacttttgtttaaaaatactttggtatattaaggataaattcagttctgtgagtccttaagccttccttctttcgtaaatctagacccaggcataaagataatggctgtgacgcatatggccctgctctttgtacttatttacaatggagagttaaaaaattctacctgaacaattatgaatgtgtagggttctgtggattctaaccttacctgatagcttttaactgaagattttatactggaatcttgtggtcactaagctgatcagtcattctattctctattaatctttcattctttcaggcttttctttttgtagctggaactgcaggtgcatgccactatgcctagctactttttttttgtagaggtggtgtcttgctgtgttccccaggctggtatagaatcctgggctcacgcagtcctcccacctcaacctcccagtgttgggattataagcatgagccacttgcctggcctcagacttttcttcaccctgtctattcaccctcttcaccagatcaacagccttttcacattaccttaatagcttgagtgtaaatatgaaggattatgcaggcttagttatcttccttgtggagaggcctaggaatgcttgaataattgggaagatccttacacgcttgtaagtgtaagagctacatatataagaaatacttaaactctttaggagcagggcttgtgattttctcatttgctgctatattcctgccagctagaccagtacctggtacataggaggcccttacaatttttttttttttttttttttgagatggagtttcgcttttgttacccaggctggagtgcaatggtgtggtcttggctcactgcaacctccgcctcctggattcagccaattcttctgcctcagcctcccaatcagctgggattacaggcacctgccaccacgcctggctaatttttgtatttttagtagagacagggtttcaccatgttggccaggctggtcttgaactcctgagctcaaagtgatccacccacctcggcctcccaaagtgctgggattacaggcgtgagccactggacctggccccttaaaaatttttgataaccgattagcagcttactggctagttagtagaaatggtaaacagaagctggatcagtggttctcaacttttttcctactccagtattcccatgggttagaccttgttcccactgttattgggacctctctatagtaagttgctggtttgcacagagggaagtgtatttcagaatctctagggtagtttgaagtgtcccttgctatgattatgttctgcttccctctttgcatgccctcctagttgagaatcagcgagtgaactatcacatgacatagtccagagttgatttcatctctctatgctttgcaataggatgggtactaatggtcagatttttttctttttttcttttttttttttcctgagacggagtctcactctgttgcccaggctggagtacaatggcatgatctgggctcactgcaacctctgcctccccgggttcaggcaattttcctgcctcagccttccaagtagctgggactataggcgtgtgccaccacacctaactactttttttgtatttttagcagagacagggtttcaccatgtcccccaggctggtcttgaactcctgaccccaagtgatccactcgccccggcctcccaaagtgctgggattacaggcatgagccactgcacctggcctggtcagatttttttccactggactttacaaatgtacagaggaacagataatcaaagtgctgggattacaggcatgagctactgcactaggcctggtcagatttcttccactggacttcacaaatgtatagagaggagcagataatgtctttgccttttttttttttttttttaaacagtatcatgttgtttccttccccctcagcttgttccatgagttttgtgcatgatgttccataaagtaaactcacagattgcttttacatctaaaagttcttctgctttctcttttagccggatgcgcagtgatggttttgatgaagaaagtcaaagatactattggaggccaaagaatgaaatttctgggacactggaagatgattttcttaaggctaaatcctggaataaaaagttctatgattatgaagcaaacatgccagacaggtttgtgattaattcctgtgagcattaatatttggcctgagaacgtgtacttatcaaaattaattgtccccacaaaaaacttgtgtacaaaagttcataccagcattattaataatggccccaaaaaataatggccaagtaatccaaatgtctgtcaactgatgaatgggtaaacaaaatgcgatatatccatacaatggaatattatttggcagtaaaagaaatgaagtacagatacatgttacaacgtggccttgaaaacatcatgctaagtgagaaggaagaagccaagtcacgaaagaccgcatattgtatgattctatttatgtactatgtccatacataactgtatgattccatttatgt

SEQ ID NO: 67196 - DNA, 2623 bp, Homo sapiens
gaggctgaggcaggagaatcacttgaacccaggaggtggaggttgcagttgagccgagattgcaccactgcactccagcctggcaactgagtgagactctgtctcaagaaaaaaagaaaaaaataataataaggctgggcgcggtggctcatgcttgtaatcccagcactttgggaggccaaagcgggcagatccatgaggtcaggagtttgagaccagcctggccaacataatgaaaccccatctctactaaaaatacaaaaattagccaggcatggtagcatgtgcctgtagtcccagctactcgggaggctaaggcaggagaatcacttgaaatcgggaggcggaggttgcagtgagctgagatcacgccactgcactccagcctgggcaagagtgagactccatctcaaaaaaaaaaaaaaaaattgtccccatgtagacagcatgatattatgaagtgtttttggaaaagtgcttcatagctaaagagcagagtgtaagagttcgttagtgtttcttaaggaaagcaatggcaagttctcttacaaatggacaaaataatcttgtatgtctgaagtgatagtgtacagtacaggaaatgtagctgttactgagctataatgggggcttggttctaccatatctctactttgtgtttatgtttgtgtatgcatgtactccaaagtctttctaatgttgctttaatttccaaaaatgtatgcattgctttaacaatacatgtgatgtgtcatattacagatggggtcacagtggttataaagagttataccctgaagaatttgaaacagacaggtaaggaaaataggcttactgaaagaaactaagatggtacaaaatctgtattataaattgatttcttaacttttacgaagaatatacttgccatcaaaaatgtagctagagaaacaataggtgatttagttaggaggtgatccctgttttcccattctctggttgatgtttggcatgtctgtaagcattttggtttttatatatagtattccatacagtaactcagtatggcagcttagaatttttaccttcattttaaagatgaggaaacaaaaactcaatgagaatattaaagtgttaaagtatacattaaagtgcttatttaaaattcagatgttaacctcaattttttaatctagaatgcaaaatattaaaataatacgctttttttttacataaaagcttctattttttaacttttcttattagtagtgatcagcaagatattaccaacgggaagaaaacatctccccaggtaaagtcatctacccatgaatcccgcaaacacaagaagtcaaagaaatcccacaaaaaaaagcagaaaaaaaggtcacacaaaaaacagaagaaaagcaaaaaggaagccacagatataacagcagattcctcgagtgagttctcagaagaaactggggcttctggtacaaggaaagggaaacaaccacataaacgcaagaaaaaatccaggaaaaagtctctcaaaaaacctgctttattcttagaggcagaaagtaacacttcacattcagatgattcagcatccagcagttctgaggaaagtgaggaaagagacactaagaaaaccaaaaggaaaaagagagagaaaaaagcccatacctctgtagccaacaatgaaatacaggagaggacaaacaaacgcacaaattggaaagtagctacagatgaaaggtctgctgagagctcagaggatgactaaatgggaaacacttttgttttccacatgactgtggatatttacagttcttactccttgtggttttgccagtgactcttgttcagcacggggcctgaggtcagagctgtcttgtgccatctgtatgttctgacagacgtcttgtcttctattttggcgttaagcttgatccccttttcttgttaaaagggaatctggtattttgttatgaaggtttcttgaagagattatttttttttgcaattaattacgtttagtgtagagtgcatatacagcaaattaaaggacccagaaagctggatccaatagtgacctgggtacaccaatcggaatattgaatttggggaagtcaagggctgggatcaagaggtggattggaactaatgccatgtaggatggtatgacaaggcaacactgtattgctctctgtttatatagcaggtgtcacaactaacttgtctttagccttggtgctttgatccttctatattttgaccccacaggtgtggtccggtttacttaatcaggacatgggcctaagaacaaaccttttcccttcatgataacatccatagacaacttattagaagggactagagtttttgcaaatttccctgctggatggggcctatagctatacttagtatatgcctaaacatggtaattggatagtaaatggttttctagttccattgctgtatatttgcctaaatggacttgtgttcaaattatttcttcaattgtcatagataatcctgtaccaaatggggaagaattaggaaataatcatgttgtctaatggtactctggattcagggcagcaactgccatttaaatgttgtcttgttcatttctaaatctgttcatgaagtt

SEQ ID NO: 67197 - DNA, 1055 bp, Homo sapiens
ctttggccatatattttttagcatgcattgtttctgtgccctgaaagtacctgaaaggttttaagcacagactcaggaaaatgtgccagtagaacaggccatctccaggaaattggctctatttgggtcctgaccttcccttcctcccaagttagcaggcttgttctttcgcaaggaatacacatcttgcctttttttttttttttttgccatgttttccttttcttggtcatgtataagcaataaagctgttttttgttcttcatctttcttaaccccaaattttcttctatgccttaggcttcgatggttcttccaacccccttaatatggcttagggtggtttttcaaaacctacaatcccccatttgcactactggccatggaacatttatttctagtgttcctgccaatcagagatctctatattaaattctaaaatgggattaaaagaagagttggagaattcacacttattgagtaactgatgtcatacaacctggaatttctgaattccaaataaataaatttcactctttgaacatttcatcttttactttttagcaccaacagacttgataacagcctgatgctgatctgacaatgggttgatagccttcccccactgacccttaaatctgcttagtaacaagtcctttgcttctgtcattctcctgggggatggcctactgccctcctttctgtacaatctgggcaaaccgactggtgatggcaagagtggtgtcaatgaagcggtctacacagctggagagacaattttcagtgcgagagtctaggcgattccctggcttctccacacatttatcccaacataactccatgaagtgatgcacctaaaaggaaagaaaaatagtaaccattggggtctgcagataggcctaactcttgtttattaacttctcactttttgacacctgacaaaaccattctttaaatcaaccacggagtcactttgggctcttctctttcttcatttcctaattagtcaccaatattgatccagatcctcgtccctacagattgtacattctcag

SEQ ID NO: 67198 - DNA, 1021 bp, Homo sapiens
tcaggactgcgacttccagagggagctctctttctgattattccctcaactcgtcagctcacagcaagtgaaatataccttcgggtaaacatctggacccctagactacagtggtcattgctgtgatttcggtattttcttctcctcaagagatctcccacccggcagatgagtcctcacttccatccccttccctggctggaggctacgctaagcacctcagggtgggaagacccctcacctcggcctcctagggcaccgcaaacggcactcagcctccagagaaccgccatctcgttcctgagggctcaaggtcatccaccaacccggaaccacttaggcgacaattcccacccacgacgacgaaagaaaacagggaagaggaaatgctgggtgaaccggaagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcggggacggggagggtgaagggaaaggaagtttcaccttccttggtggtcctgggcacgctcggaggtctgtacactggcggctcactggtgctcgatcccggctgcatcccattcccctcacgaaagacaaagttatggctctcctgtccctggtgaccggtagtgctcaggtgccaggtatataagcgtagcgtggagaaaagaaaaggtgtaaaacagggaagatttgggcgacgcaagggtacgggagactagttagccggcgacatgactgggctggcattcgaaagatctgggttctcatcctccctctgctccttgcaggccacgtgcccgtagaaaagatactcatccactgtgggttttggtgtcgccgtcaccccactgcctcactggattgtgaggatcatatgcgacaatgtatttgaaaacgactagaacattatcggaggaag

SEQ ID NO: 67199 - DNA, 1083 bp, Homo sapiens
aaggaaataaaaaacaattagccgggcatggaggcatgctcctatagtcccagctacttgggaggctgaggcaggaggatcacttgagctcaggagttcgaggctgtagtgagctatgatcaggccactgcactccagcgtgggcaacagagtaagactttgtctctaaagaaaagtcactagaaatagacttactgacatacacacgcaaaaggctatacagaatcccctaaagaagcaaacagtgacagtggagtggcaaatggagacattgcatttgaacttgacagattgtttttttgcagccaagttatctgtatagtcttctaatttcactgtggttttttattgatgttatgattttttctttttctttaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaa

SEQ ID NO: 67200 - DNA, 1041 bp, Homo sapiens
atttttgtatttttagtagagatggggtttcaccatgttggccaggctgctctcaaactccagacctcaggtgatctgcccgcctcggcctcccgaagtgctgggattacaggcttgagccaccacgcctggccaagatttttcaaatgcttctcacaagcactttttaatttacaaagcattactttagactttgtatacattcatgtgagtaaggggacaagaatttaaggcccagtagtattgcttgttcagaaaggtactgctcagtattggaccagcttgctgtgtagctggacacctgaaagacattttctacttctacaggcagagactgagcagcatcttgatgctccctagtgcattaacataagcagaatttacacccttttcagccttggccgagtgcctctgcttagccaacattcctactaagctcctttgtctcgattgtgtcttgctttggttgctaaaaaaaaaatcttaactaaaataacagatgttttggggtaaatatttaagtatagcttttggggacagatctaataatttatgttgccaacttgtgcttgtatgttgctaacttgtgcttggatgttgatctgttgaaagtcatgctgttttttttgtattttgttttctttccatagttgtggtgacagtacatggagaggtatgtgcagaaaatatttgtgtggtttttgcagattgctgggctctctttcagccagtgtggtggattctgtgttgaaaactgttccagtcagtattgcttcattgttggcccttgtatatgtgtgtgtggtgagctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacag

SEQ ID NO: 67201 - DNA, 1007 bp, Homo sapiens
ttctcaccagcacacttctcttctaaagggaagccagggaaacaattgtttctgcctccactgcatcctcctacattcagttccaagctagtgctgggaaccgaatgtgtgtaaatgaaggctttacattctcaaatgtgcaactttgctgccacggcttcagaccaaaacaaagatctggaggcactcattggcaggcttgggtcacatagatgttcatctggatctttcaggacacatattacactttttgaaaatatttagaactggccggaacttagtcacctaggttctccctattggttgaacaggttggcagccaattccacagccaatctcaacttttgttcactgccaaatgattcccctgcaacctctgagtttctgtgggaagaatccttccttactttcaagatgatctcagatttctaaccaaacccattcaggttacaaggaacttctgtgactcatgtgactcaagaaagaaaggagaaaggagaaatagctctgaggctgctggcagcttcccatttgtccacaccagtagattttgaagggcaagagaacaggaacgaaccatgtctgagaagccaatatagaaaaaaactatgttataaaaacatttttgtcacaacaaataaattatactttaaacaagaataatgaatgtgttccattcaaatataagtctctaatgagtaagttaaaacacagagaatgttgtctaattgtattatttgtgtgtgggtattaaagaacgaatcaaatggtgagtgtatgtgtgttttcaagaccagactttggggcaaaactatctcaattttcatttccctcaagtgaaaactggtcatttttcccctaatagtaatttctgttaagaaatgggcaaaatatatgtgtgtgtgtgtgtgtgtgtgtgtgtgtgtgtgtgtgtgtgtatatatacatatatatatacacacacacctatatatacacacacatatatacacacgtatttgtgtata

SEQ ID NO: 67202 - DNA, 2161 bp, Homo sapiens
gactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagacatccctcccagccagcagattacaatgctgccaaactaaggatttcatttggactttgtttttcctgggaactgcaggtacattttttttttttttaattctcaatctggtttgctaattaccccttcctcctactcctaggaggaacgctattattttgggtggttttacgtggactgctaaggctggtcattttcgtttagctgtgaaaggagcgcgtcgcccttgctgcccagccgaaccccgctccctccagggctgcgctgcacggggctgcctccccgagccgccagcgcccggcgcccctccggcgcgtccgcccttcccactttgtgcgcccgcggcggtgggagcagagccggccggctcctggggactcagcggccgcgctggtgatgggcagcgctccttccccaaaggcgggcggcggggcgggggaggtcgcggctcgggtggtgccgccgcacgggctcggattccgagggggaagtggcttgtcagccccggctccgggaagagtgaacaataaggctagggcagccgccccagatcgttatattcctgggtctaataaagtcaggatcgctgctttgcttcccccgccccagaagaataacggtttgcaaaatggggcaaaatgggcagaatcgcacggccgttgttgttggtgtgaccgttgttgcaccccagtcgacatgacgttagtttttcatttgccaaattgctggttagttgcaaagcctaccctcggccgcgagcactgaaggatgggagggtcgagcgccgcgttttgacaggaggaagtgcggaggggcggagggcgaggagggcgtgattggggctgcctggtgtgtgcgcgcgcgtgtgcgcgcgtgtgtctttacacgcgccgcgtgcccagtgttgcacggggcgggagaagaatggcaggtagccgcccgaaacacctcgccctgtctcctttctttgggcgaggttcccgatcctggcaaagtgtgaacaatagggagctgggaggaagacagtagtgatgctgccgcgggtggcgggggttgcgccgccgcccagagaacctcggcagtgtgcagggaggtgcatttcattttggctatttccatcccggcctccctggaaaattcttctgtgcgtgcccaccctcccctccagctgtcatccccccacctccacccaaggatttgcgctttggctctgatggacgggagggaaggaagaaaagcaggggccgcagagagctgggtgggttgggcggacattctgggcggggggcgtgtgctgggaagcgatcgaggaaagccgggcggaggggctgtgtgtcgcggtcgcagctccaggtaccgttgtacctgccctggacggccgacccccggttggggagcgcacggggcgggccagggagcacccagtgcgccccctccgcgggcggcacaagagcagcgctcggccgccgcctccagccaactcgggtccctcccacggcgaccaatcagtgcgaagctggctgggcgggaagccgcgagaggcttttattgcggcgcgggtggcggccaggagctgccaggacagtctcccggtgcttcagcctaacggtctcgctcactcaccgccaagagaaaccccgccctgcggccggtcccccgcctgcccggcagtttccgaggaaataaaatggagactaggtggtcaccgggagtgctcctggtccggccgcccgtgctcgcccactctcgcctctttcacgccgacttggagcatcccaccgcccccgccagcgctcactctcgcgccgcggaatccgggcctgagcgcgtcgccggggagggcatcctggcaggcacacctacgcgcgtgcgctgaccggccgaccgcgggccgggggctctactgacggcggggcggggccgtggcagggcccggagaggaggggtggggaccaagcctagtccgcctggccctgggtctccgctg

SEQ ID NO: 67203 - DNA, 1014 bp, Homo sapiens
tcattagtgagcaagaaggatatatatggatctggaaaaaataattatttagacatagtgccctctttttagaaggattttaaaaagggtattatgatacacaggactccttcagagattagaactaggcttaaaaaattggtcactaaatatgcctgcaattccatgttggttgtgaatacttcagagaaaaaaatggcctgattataaggttgaaaaccatcagcacaagggtggatctaggtcttgttgggcctgaagggtatataattttgagggccttctttaaggaaaatacaaaactcttcttgcttttgcgaaggttagttgaatacatgaccatgagaacacattgccaagtcccagtcccccagagccttggaaggagtccatgcagttgaggaaccctgaaaacttctggtccttctttagcaactatcctttggtccacttggacccacttgcttgggaatataaactaatcgttccagtttattaaacgtggacctcatagaggttgtatgtgtagtgctttgaagattagaatcatatattgaagtcaaagtcatttttagaaagaagtatttcacttttatttgacagaagatcttaaatgagatctgagctgatttgatatttgtcactgccgatattcttgtaaattactaactagaagaaaataaagcaattgctattattattcaaatgagtgagatgtaagtgcccgattggcagggcaagaagtagttttgccagctaaaggcatatgatattggagaggagactgaagattttgttttagctatctaaaaggagataaactggatatataataccaataattatatcttaatcatcacgttatggtttacaaaacactttgatatgtgcttaatcttcacactaattatttagtaaatattgactgagtacgtgctctgtgctgggtgctgggaatacagcggtgaactaaacgtacatcgtccctgttttcatggagtttccagtctagta

SEQ ID NO: 67204 - DNA, 1880 bp, Homo sapiens
aggagtagccagagataaggagaaaaaaaaattctgcaagtccagattgtaagtctttaaatggaaactgagactgagaaaggttaaatgacttaggcaggtggagctgggactgcaacttacgttcgttgtctgaattttatccttttctaaggcaaggataatttgaatatatatagcatctgaatacatgccaagcaaacaggaattcctgtggcttctggactgagtctgaccaaagtgtgggaggagtgatggggaggaagggcactattcagagctgtggtctgaaggaaccgtcctgccattctgcaagttgctgtcgttctgagcctgtttccccatctgtaaaatggggttaatgacacttcccttgtgggtcttggtgagctgaaataaaaccacatatgtaaagcagatataaagtatgtactcattatgtgctttaaaaaagttccctgtggtcagatattttatttgaaatgtttgtttaaaaaggtgtacagtactctgaatatgatgtgcaaagttctgtgctagaggcttagaggaaaaacaaaataaatttaaggttactatactgaccctttcaggtggttggagaggaagcacttttgcttagttcaagctgcgaagaaatcatgaaagatattatatcagtaagtgcccgaatgaagcaggcaggtaaaaactgggaaaattgagaggcaaaaatcatgtctattagttttaatgtctgggggaaaaaagaggtatagaaaagctagaactgacctggacctccacagatatgaaggtaaatagggagagagggcctgttttcctataggatgaggtggatctggccaaagaattgctattgaagagcagttaaaggctggaacttggggcaagccatatttaaatcttaaatgtcagacaaaggagaggagtcctgctggagatgacagagaaattaaaaatatatatatatgtttaagaggatagttaacaatagcaactgagcgtgtgctgcctcaggctctatgtttgggactagctgggaattagcagagagttaagtaggaacaaattcatatagttcattgcagcactaaaagggaattctggttttatatagcatccactatggtggtcggacaaaatgaagggctaacgaagggatttttattgctgtatgaaacatcaactagatgatactaggagaagggaggctagtgaagtccaatgaaagtatcttgcttaatcagtaggaacacctgtatgcggggaaaggacaccattgggcttagattcgaaagatctgggttcaagaagttgctctgctactaactagccaagtgaatttatatcagttatgtaacctctttgaactgtaacttccgcaatcgaatataagaacaaaataagataatatatgggaaatgcattgtaaatgaaatatttcacagctatacattttattagtagacatgttgctgaaaaataaaaatcaaattttatgtactgctagaggtgcttgtttgattaaagaaacccaactatgatatattttctaaagcaggaaattttggaaagatacacttgtaatgattttggataaggataaagggggcatagctgagatgttagaaataacaaagcaaccaagggtagatgatagatcccaaatggtagatgactgagagggagaaagatctttgaagttacaaactcgaggaaattaaataatcatggtactgtaaatatgatggagaaattaagagacaggttaggttttagaaaaagtttgggcctcctaataccttaacttgtaggtcagtatttttcaaactatggatgatgaaatctgtttaacgggcttccatatatattaagaa

SEQ ID NO: 67205 - DNA, 1017 bp, Homo sapiens
cccaactgtggtatattttttaaagcagataattttggaaagacacacttgtaatgactttggataaggataaaaggggcatagctgagatgttagaaataacaaagcaaccagcaagggtggatgatggatcccaaatggtagacgacggagagagagaaagctctttaaagttataagcttgagggaatgaaataaatatgcagacactggagaattcacacaactttaggtgagagttgaaggagactttgaaggaagaatttatctccgctgagaggaagggttgatgaggtaagtatgtgtgttccctgtttgggaggtgaatggaggaatcccagttaaagagactaggaagactcaaagatggtagtaatctatatttttatatgttcagtggagagaaaaacaccatgagttatggtcagtactttgcggggtttttatcacgcccacaagtatttatgtggcagtgtttatgtagcacacagaatgatatcttgcctataattcagaaggtaatagtgaacaaatgaagagaaccagagcttagtggcacaaaagcctaggttagaaaagtataataaagtgaagtgaaagaaagttggaaacaaataatatatataggtataatcccaatcttgttaaaaaacgtctttcactcaccctgtaatcaagactggaagacggtaaatcactatttatgttgtctgagtttttgataatgagcacatattgctttgcaaaacaaatagtgcagtaaaaacaagggcagcagtactaagggtggttaaaagtataaagtaggtgagaattaagtagaaacttgggatttgtgtcagaggagagtagtgatgtcagagggatttcagttgaatggtgaaattcaagttctttatttagagtcaaagactgaggaagagctgatgtccaggacacttggcaaagaaagaaggaaaggagggctgctagtttgggtgacggcctcatcatgaagcttcctgggcgcattgaact

SEQ ID NO: 67206 - DNA, 1027 bp, Homo sapiens
gcaggcacggtataagtccaactactatttttctctaagctgaataagaaatggattgggggtaattttttcttctgtagtctagacttcatttaattctcctattttcagtagggtgcttctgccctcaacaaagtctggtatatgcaaggacaaagtgcatctggttcaatctctctatttataaaaattgagccttctgctgaggtgaggggagtatgggagaagagacatatggctgccaccctcctgtagcttacagtttgtgtgtgtgtgtgtgtgtgtatgtatgtgtgtgtgtgtttgaattagtggtatcagaggctctattgactttaattttggagcagactcagaacccactgatgacctatctccttcagggtttctaattgctaaagtccaaagcgggcttttaaaatcttttttgaagtcttttatcttgcacgttttagggtaggatcgttgagactgaaagaagcttgcagttcttaaaggaaaagggacatgctctaggggtgcatcaaaggcaaaaacccgaacagaggaatgttcagacaacttcaagggattgacaatttaaagagttttgaggaaacttttctgaactgaagcattctcaagagattccaaggtggcctgagattccacatttctttgatagaaagacgtggacttggcagtgattttgcaaatcagaacaagaacaattttatgaacacattggcaagtggccatgtctcagacttgttgggtagttaaatgtccactagaaacattgacttaatccagtatttatgaaataactcccgtattctatgtagttggtctaggaattggaggtgaaagatgaataccattcagctttgtgaaaaattctagaccacgttcaaaaagttttttgtttatacttgtaatatttatgcctgtggaatgacacaaaagacaatcttgaaatgtcagaaaatgataaataagagttatttgttattttctcagcatttttttccttttgtgtgtgtaagtg

SEQ ID NO: 67207 - DNA, 1021 bp, Homo sapiens
tgctgccctgtgcaatattaagagaatagctttcacaaacaaaccccagttaaagttatttagtcacaataataaaagtacaattggacatattttaagaaaacataaattataaatatgtgcagttattttaacaatttatgaatgtatttctaaatactaaactttttgtttgtgataagtgagtataaaaatatatatacaattatatactcttaacttgctcaacatgagagatttaaaatgatgagttccactgtgagtttaatcttcactttcatctttttatttatttatagactggaacaaataaatcaattttttaattataaatttttagtaattgaaaattattaaatgtacaaaggaggagaacttttagaatttagaagtacaaaggaggaaaacaatttaaacctacagattgatttggtgggattggttgtatgtctgcggctgtctggagaatccaggtgcttaagtgccttggactagctggacactgaaacttcacagggaaacaaaaatgtctggaatgacttgttgatgttcttgaaatgatgctaatatctattctataaaacctgaaggtatgtagatattattgtctgtttcgagtcatgtatcttgggatttgggactgttggagagaagatcggtttgatttagaccatgataggtattgatctatatatatttttgaaatattttggctaaaatgcaatttgatgtggtaagtcttatccatatctaacattttatcttaaaactatatctgtagaagttgttttttaaaaagaacagaaaaatcgagttgcattttggtgtttaatgcattgattttaaaaaattatattcagagcaaaatgtttgagttttcaatgattttttccttaaagcattaggtgcaaacgtcaggtaattctatgattagaattgtgtcgtgatactttgtgggtgaagacagtccaaaaccaaaaatgatgagacaagtgaaatctttattaaggaaggcctaaca

SEQ ID NO: 67208 - DNA, 1005 bp, Homo sapiens
catatttttagcatcttttgaaaaattctgcacagattatggcatttccaagtagatttgaatttcacaagggggaaaatacgccattgtctgtgttcacatattttgacaaaatgattgtgtataatcatggagacaaagcttattgttttaaatgattttgttaaatactagaaagtagttcactgagttaaaaggtttcatacaggtttcctaaaaaccatttggcttagatatatttaactatctgtgaaactacttgttattatcctctttactattgtatgggtttggttggattttgtctgttgaacacagatcctctgattttatttcgattttatttgaattgctttctgtaatattcaactacatggaaattgtgtttaatttgggcttatgtagagtggtccatagactttgagtgtgtgtttgggttgctgttctgaagaacagaagtagccaagaagtagtctgaaaaagtaggaccataaaaaattagactggtagaacaaaaaagaaaaaaaaacaaacaaaaaaaacctgtaatttttaccattcaaaagtccttatataggtttcataataaatttttttccaaaatattactgatgtacttctccaaatgtttattatagacatgtcaaaagacaaaattatgacaaatttagttataaatcaaattgtcttttatttgtgattcataaattggggcagcctccattcaacaaaatagaatgagagctcccactgagcaatggcagaacagtgggtttggaaagtgggaacaaggaaacaactatagaaaaaaagaaactggttaacatcaggttacttccggtgactcttttgcaagttaaagcagaggagacttctttattgcactgactcaggtcgactggaatctcctgttttcaggaaaacccaatctgttttgggatctatctgcttctttaacgtttcagtttgattatatggcatttagcttgagtgactccattttgg

SEQ ID NO: 67209 - DNA, 1037 bp, Homo sapiens
ggcaattgggatgcacttccctataagatgttttatgtggtggttttgtccggattaaccaaaatgcaaatcttcatatcctctatagtgcctagcaaagggtcttgcacataggtgcaagttgtcagagttggctcagtttcactctgagccccttgtagatagcctttattcattcctgcattctacatgtatttatgcctttgactgagaggtaagatctaaaaaaggaatagatatatctgaattcatttgtaaaaagggtgctagctggcaatgtatgcaaaggtttggtggcagtgagtaaacaagaactggggatggccttgctcatcagatggggaagtaaggaggtcattggaagcagcagattctgggaatgacttgatgggagcatgttttgggaagttggatttgttgctcttcttttggaagctgggagagattacagtctggaaaaccagtagtcagggggtaggaggagctactgtagaggctgtgtgaggtgatgggaggtggaattggagttctgattgtgagatgtaaaggaaggcattatgcaagaaatactacagagggaagattgatgaacttagtgactgatttggatatgcaagagaggaaagaatggagattatttagatttcaggtgaggcgcatggtaagagtaaatgtcactagcaacagaattgaggaaggggaaaatagggacttttaattttttaaaaaaggtaatagtttggcttgggaaaggtgaccctgagattaaagtggactgtctaggaagaaaagccaggtataccgctggaaatagaagtctgcagtttttaggagagatcacgttagagacataaatctgtagttatttaagtagtagatggttctcgaaggataagtccatttagagagagaagcagagaggaccaggaacggaacttagccaagcacttatactctgaagatgggcagttttcatatgtaatagttattaaaaagtggtaccaagtcatttaagcaagttactgttttgtatattt

SEQ ID NO: 67210 - DNA, 1955 bp, Homo sapiens
tcatttagttgtctaattgtattgttttgcatctcattgaacttcattaatatgattattttgaattctctttcaagcagttattagatctccatttcttaggagttgattgttggagctttattagtttcctttggtggcgtcataattgcctgattcttttttatccctgtcgtcttgtgttggtgtctgcatttgaaggagcaaacatatcttctagtctttttttggaaagagttttttaaattgtatgttatatattagacaaaattatttaaagccagtaaatttttattcaaggaatttcacatgtgattccttctactgttcatcaaggttaccttaattcctctaaagatgcagtcaagatttatcttcaatgtaacccttttaaaaagaactgagacttaatccacaattgtcctgtcagccctgtcacaattattttattttgccttcttttcttctagttttaatggggttggagctgggtcatgtggctgctactccttttgcagtggggcctgtgggtggccagcctgttaccaggtggtttagtgggcatggatcctgctgtttggtctctggatggactggactgtctccaggactttggtctacaaggctagttctgggatgaaggtcagctttacagtctgtagagagcaggcttgattactaggttcatagacagttgtgtttttctctgggtccctgggacatcttcccactgggtcactggttgggtccttgggcaaacattactgccctggtctatggttgaagaaggctgaaactgagttgcagggttgctttagggcccacagctgggactaagctcagcagtgctacctggaagactcaggaaggcacgtctccatcttgtctcagtgctgctggcatgacttacctctgaccaccgttgagagggactgtagccagtctcagagccatttcagggttttttgtgggactgaggtcagcaaccctgctccggggacttagagagatatatttctctctgggaccctagtagatcagctggactgatctcagaccactgctgagagggactgaagccaagtctcttggccatttctgatccacaggtagagctgaggtctgtaggtttatcatccatggcgcaagtgggtgtgattttttctgggtcccagggtgaatggttttgatagaaggacaatgatcaaacagagctgtagctgagtccacaggagtatggaagccatttttgggtctggagctagggccatggtaggagagtctgtcacctcggtgtagtgctgtcctatcaaaaggttctcctaggccttgtgctccaatattttctccactccattttatgtaaatttataccattacctgatttatcaatttatcacaatctcttacttggctgtttaagcttccataaaggcacttttgctgtagagggctctcaaattattgttactgttgggagctacgtgcatctgttccaccatcttaccggtgttctcttgtgttttctgcacgtgttttgccatcttactggtgttctcttgtgttttcttattcaatttttacattagtattttaggtagaatgccattataggtggcatggattggaactgagaattaatatgatgggtaatagtatcaggattcagtatctcagtaagttcgattaatgagctaaacatgattaaatttaataggaataaaagcaaaattcacacttaggtcctcagtctgctaccccagggcacatcaaatgatcaattaaataaacaaactagaatttagaggcagcactttgaaaaagcctcagtaacttcactcaggttcaacaatgtgatgtggtttataggctattatagttcatctgactttcacaataagtacgtgttaatggctatgaactgattacatccactaagtgattttttgctgtta

SEQ ID NO: 67211 - DNA, 1082 bp, Homo sapiens
ctgtagatgatgtctcttgattcctcattttgtgagatgaggattaatagcatccctgtactcccttcagctctcctttttgtcattcttcttccaattgttaacatttgtttttaaaatttttatattattgatgtcaataacatctacattttgttctttatccataattaagttatcagtgattatagtttaaaaagttgaaaactgtactttttacattatgatgaacaagtaaatattgttcactgaggagccaagtggtatacgattattgtatttcctttcctatgaagaattattacagtttctactagtcttttttgccctttcattgtctgcctatgtgaccttctgaagtttttttagtgtctgcactctctgatacccaaagagagtatcaaatcttgaaatcccttattaaagaggaatccatgattcttctgcctgtctgctactctcttctgggttgattgaccctggatcagctgcacagctgtcaccctgggatgacctttcattgatcttcttgcctgaatccagttttggcaatataatgcctttttctttctgctttgccatctagctttgagcaaaatttcaagttattcccaaaggaagagtgaatgaaaggtaaactttatgcattattagtcaatacatttataataatgtctattcttcccatagatatctgatagtatctttattctgtcctgctgattacagggttaacaaggtgtgacttctagactgagaagaatttccacattgtaactggaaggcattactcatgatcttttagcctctatgattctgatgagaagtctgatgccaatctgatttttcattttttgtagatgactatttttctctctggaaactcataggatcttctcattatccttggtgttctaaacgttttaatgcaatctaagtgtggacctttgaaaattcattttcttgtttatgtggtggctcttttcaatgagaagacttatgcccttcattttgatacatcttcttgtattagcctgagatccagaaacctggtaatttagcccacagtgatgggacaatgg

SEQ ID NO: 67212 - DNA, 1165 bp, Homo sapiens
ctgttcaaaacattatgtttgcttctggttttcatctgtgtgtttgtacactttgcattgttgtaaactgtgtaatatgatgtctaacttttcctacttagcattattttatatatggtttataaaactatgtgcttaacataggcactgtcttctattttgtggtaaggacatttaacatgagctctaccctcaacaacttctttcagtatacaatcacagtactattaagtgtaggtatgactttgtatagcagatctctggatcttaatcatcttgcaaaataaacttcatgtgtactttcttttaacattggtaaggcattcactgatatgacataacgtacttaacctttcactgttataaattggcttgtttctaattgtttattatcataaacagcatgatataggcatcttgatacaaacgattattttgctttgggattattttcctggaattaaacccaaagtgacattatcaggtctaatgttgcatacctcttgtttatgcagtcattttggacttcagaatgacagggcagtgcagttgttttattctgcatttcatcattaaggaggctaggcattttctcctgtaatgatttatcatttgtctttactgatggaatgggagagcccctagtttgctacttttagctgaatctgataattgcatggaaaaagttggaatgcaggataacaatgtcatccaagggaccccgtcccttttctggcctgctcatcatacagtggttttctagggagatttctccagctaaaatgcagacattactggtaagggtaacagaagtcaagttttgagcagcaaaccttgtggtaaggattactttatcagctcaatttccaatgcgaacagctggctaagagcagtgcctcccaacaacaggacacaggactggtagggcagtgggcatgggaagcttgggtaggatagaataatgagggagtgggcacaaggatgcactaggcagggttcactccctttcctgggcttcctcctgtttatgagaaagttaatcaggaaagaaggatacttactgcatgagggagtgggtgttactgaacactgtctgggtcagagacatgattattttgagaaaataacgactcagaattaaaaggctactttatttccaccaaag

SEQ ID NO: 67213 - DNA, 1001 bp, Homo sapiens
tggctgagacttactgaatgatgagcttcgttatagggttatgggtgaccagctagacttctcacatccataggtcttttttgggcggtggtttggttcctcctggaaaagatcttccagtcttctgcctgggaaatggaagctttgctctggtgttctgggactgagtacaaggaaggagattagtggggagaggtctcatcattcagcttgcagacattcacttgatctccctgtatgcatctccatttctgttcatacctttttctgggcctggtgtctcccattcagtttctgttgacactagctgtgtatcttctgttcaggaggagtagtttaactgtagtattgagatggagacctggcaacctatctgctcattttacagactttcagacaatgcatctattttcagcttctgtctccagcctgattttctagtttttgagacttttaagtgtatttactctgcattttgaaaatagaagttaagaatgtctttcaagcacattaaaacatatcctttaagagtgtcattcaacaatgatggcttatttcaatttggttattctgattttttttccccttgaaactgttttcactacgtctccagtgtagaacttcaaccaattttctctaaacatatgaacttttcttctaaagagattctgtaagcagtctcaaaggcagctttgagcactcttcttatttgcttggtggagttttgtatcatattgctcctggctaatacatgtccttttttggtttcaaaaaattctggcagtttctcttttgattttgcatgattggttttataaaatgtcattctaaaatgaatggctgtgtgtacttcttggacatattttcacgcacaagagtcatccatgtgatccttattggcatctgcacataattaaactcatattttaaagacagcctttgcctttttgattgactgctgctattcactagggattcattcattgtggtaaggggaatcc

SEQ ID NO: 67214 - DNA, 1834 bp, Homo sapiens
tcttttgtacctaagcttaaaagtgatatatggtaaaaatatgtgtctgtgtataaaataacttccataataggtggaaaataaaaaaatttgaagtaataaggcaccgtgtcaatttaattgacagcttttatttctttcttagtccataaaataatggtgcatcttacaacacatggagacttagagttcattaattatggtaactaagagttgctgaaagtccctcttcttcatagtcttattccagtatggcctcatctcatggattatgaatataagttatgacactttttgatagaggatcagagaatttagcctcaaagttggactgtttacattatgatactccaatactggctttcagaataatcacagataggggggcaggggtcacatggccatttctatggctttcttccttgcaagctgaggagatctctccagagcacacctcaagaaaagcaaagtggtaatacatggctataatgaatgtagccaagacagtttcagagcaggattaacaatgactcatttcagccgtggaaatattttagtggtccacatgtctaattttatttcctgcaaaactctccccatatattagttgcaaattatccccctaaatgaattgttggttttaagccagttaatattggaggactgcttctcaaaattatggttttgatttcaaactgaagccattcttcttgatactaaatagttccatcgagtcaccaattgtctgtcaaactagtgaaactaaaatcatatcatctggaggttactcatctctcgatttctgtagtgattttaaatcagtaagttaaaagtcagaaagaaagggaaccaaacatctctttgttttacacactgaaatgttttctgatcccctggagatcattcttactgctcttccttaaactctggcatttggtgatagacacaacatcagcagtatctgggctcagtatggcccactgagcctgaatagagctgagtcaagtgcacagaatggaagaccaaggaaaggtcaacacaagctgcaaactgtcctgtgtttttctgaccgatctcccatgggggcctcaggggtgtcacagcgggagagtgcaataacctggtctaagtattttgctattcatggagaatgttagttagcctgagaaactgagccttgaactcagtttctgacggaaactcatagacattatgtttggcacacagtcatctcaattcgtttttttctttttcaaataggacagactcatgtaggaccacgtcggtagaattatcaaaaaattggcaaacaatttacctgcttagtcagactagaccttgaaatctgtggtggcaggaagtctccattgggctgatttaattggaagggttttttcgggtttttttttttttttttttttttttttttattgagatggtctcactctgtcacctaggctggagtgtgatggtgtgatcatggctcactgcagcctcaacgtcctggcctcaggtgatcctcccacctcagtcacccgagtagctgggactacaggtgcccaccacgcctggggaattttttgtattttttgtagagctgggttctcaccctgttgcccaggttggtaattggaaggttttaaacagtctctgtatgtgagagtgagcacatctagccatccagtgaggataggagtctccatgcaaccgaatgtgatttaatgttgttcctctctaggactcatctctaaactccactcacaggtcagaaaacttttccaagaccatgtctccacattttgagtttgaaaaaatgagatcagggtcttacaga

SEQ ID NO: 67215 - DNA, 1054 bp, Homo sapiens
ataggttgtacactagatgccagtatatcagtgttaaatttcctgaacttcataaaggtattgtgattgtgtatccctaggtgttctgtagtaatgcaccacaaaccagggaccttcaaaaaacagaaatacattctcttatagcatctggggccagcagtctgaaatgaaggtgttggtgggaccatgcttcccttgacagctctagggaagtatttcttcgcctcttccccacttccagtagttgttggcaatccttggcattccttggctggcaactgcctcactccagtctttgcctgtgttgtttcctggtgttcttcttgtgtgcctgtgtcttcacatggccttataaggacgccagtcattgagtttagtccccaagcacatgtgacagcatcttaactaattacatctgcaacgatcctatttccaaataaggtaacattctgaggttccaggtgaacatgaatttttgggagaacattattcaaccccatccagattatatatgagactctcctagtttttaggagatagatgctgaagtatttaggggaaaaggataatgatgtctacaacatactttcaaatggttcctcaataataataaaattatggtcatatttatggagagggagacaaaatacaatatggaataatgttaacaattgatgaatttcagtgaagtgtatgtgggttgtataatttttggaaattatctagaggtttgaaatttttcataataaaaacattttttaagaagcaaaagaaggcggggtgcagaggctcacacctgtaataccagcactttgggaggctgaggcgggtggatcacctgaggttaggagttcaagaccagcctggccaacatggtgagaccccatatctacgaaaatatcaaaattatccaggcatgatggcgcgtgcctataatcccagctacccgggaggctgagctgggagaatcccttgaacccaggaggcggagggttgcagtgagctgagattgtgccattgcactcctgcctgggcgacacagcaagactctgtc

SEQ ID NO: 67216 - DNA, 1812 bp, Homo sapiens
cagccactgcataataaacttgaaatatttggctctattattgattgatcatatagataatggccccagattcaatcagccatccgaaatactgctgtggttgtgcttggtttttaatttttttaagtcatttaaaacagacatagtcttaaatgctttctcttgaaaatctgatttaatagagtcattataaaattgctaggtggtttagttttattggacttttatatttggtggagaattttcattacaaaaattacctatttttttttccaatgttggactttttatgagaagaggaaagtgcttatacagatttatataatgaacaaaggtgagagagttaagtttctaattttctggaacagtaaaagatggtttatcccctatctttgctctggtcatagatgagaggatcccttccacgtgaaatgccccaaatgaagtgtgatagtgatactcggtcatggttagggagaggtgatgcttcctgtgtcactatactgacagctgtgtgtcaggacacctctgcgccattcgataggctgtgatccctctggccagcccaccaagagcaaaccttaatccagttgtgttgttaatcacacagatatttagggacttggctttaccttcaacagtcttccaaggagttcttagttctaacatttgcgtgatttcaatagctgatgataaactctctgcaggcatttagggacgtcgctttaccttcaatagccttccgaggagctcgtagtgctaacatttgcctgatttcaatagctgatgataaactctgagcagatgaggtctcttttttgaagacctgccgatttccacatttatctttgtttcctacagatactgtctcctgaataattcatatttttcttagtttcctttcctggctcctttcctctatccatccttaaatgctgctgcatcttggccatcttcttttcttttacactgttcttgggccatctctgccacttctgtggtgtcagataccactaataacatatgtatgtgtgtatacttggaacagataacatcacctgagttctaggtcccacgtattccattgcttcttagatatattacaatttctagtcaccatagacacataagatttcatatgtccaatatagaactcattaactttcccttcgcttccctccctgaaccaaatataccacatgagttctcttgtctgtgttcctgatctctgtgaaagcagaagtctagacgccacctttggctctttcattgccgtttttctgcatctgtgtggtagtctttgttaatgatgttcctgttatttctgaaattgtataataacatagcatggcatctgttgcttcacatttcacttcccattctgtgattataaagaggtcatttttgcaaggatgttcaaggccgtcatcagcttctcaaggatcctccaagtcctttgggagacagccatgcagtcctcatcccagttcactttaaccccttacttgttcgctggtccctcccttgtcaacaatgtttttgtgatttgagcagtttttcagcactccttacattgcctttatgaaatcttatatctttgtaagatttgtgaatattttcattgcatttgctttctatccttgaatacctacctcatttgaccatcaggaagaggctgggtgagggtgctgggttgatgggtggaagaggcccttgcatgaggcagggctgtttcagttggaagtcatttcctcagtacttagctcacccctgagtgttgcattcttaaggcaccattcgcttccccaccca

SEQ ID NO: 67217 - DNA, 2163 bp, Homo sapiens
taacctataaattaagatgctgttctcatagatctgttattctgattggaggagacacatggtgtaaacgtaaaagagtgaatgaatgaatgaatgaatgaataagatgtttcaaatagtaagaattcctatgaagaaaataaaatgctgtatgctccagagagtaagtgagcagagaagggggtgggtgaacaaagaaagtgccctctgattcagcccaggaggcagaggctgcagtgagccaagatcgcaccactgcactccagcctgggtgatagagtgagaccacatctcacaaaaaaaaaaaaaagctctctctgatattggaaatgagattggaacgacacagggagccgagagagagagagagagagagagagagagagagagagagagagagggagagagagaactgtaaacatgtaagcataaagtaagaaaaatcagcgtgggttggctgctttatggaaactttttttgagttattttgtggttgtgcccaccacactatacatcttgatgtagtttgcatatatttttaaagtgggttagcatcatcagctaatgcttattgaactgtcagcaaatatttatggagagcctcctgtgctcaagaacccttattaagtgcagagccctgaattatgagttacaaggattttcagaaggtagaattctagggtttaagggaaatatttcaaaggaattacaaattaatttgaaaaaactccagggccttcttagagaagcactgtacattccagacatagcatctaaagccaaaagattaaaccagatgggcaatcattttctttctcattacccaactaatggggactgtgaagatgggcagggactcatgtctagagcccacctgaagtcacagtggacctagaatgaagttaacgtcgcagttaagattttcaccggctactttgcttccccaggattttatattttttgaggaaacggaatgtctctgtcatacacagagaggtgctgacttccctgcatgccgtgtagacacaggaggagtggtcacagaggggacatgtgccatcagccttcttcttgagctagtggcacccttaaggatgcaggcggggaatatcaatatattattttggaaaaatcagaagcaaacattgtataaagtttaaacagtggcgacagaaggtgctggacactttaaaatgttcttgtgtggataaatattttgtatgggagaaagcacaagctctgaaaacagccagacacatggttagatggatgacttatcatcttggagtctgtgtctactcatctttaagatcgtagtagtaacgatgatagctgtcatttattaagcacctgctaggcatttaacgtacattatagccatgctgagctggacgttttaatctctattttatagctggaaaacaggctcagagtgagtaggcaacttacctcatgccagatatttagtatgtggcagacctggactcagacccagttccctctcttccagggtcttcccacccacactgcagtgtcccttgcaggcttgttcagattagcaaccttgaatgctaagtgctgctaagcaggctcacagagaaggacaacgatgaggcatgttccctcactgctttttcctcctacatcccaggacctgggatcaccttgagattgtctgtgaacaaagaaatcaatatgactcaatataattctctgtacaattacattttaaaattgacagcctctttcactgttgcttcaccaaaaaataaataaataaaacaaaagcctaggaattatgtttatgtgttttccaaatgaagaaaagaaatttgggatcctaaagagtatataaaatatgttgatgtagcatgtaagtggaaatggctaaaaggtaacagaacataaccaatgttgtaggaatttaaaatattagtgtcttgtttaatgacatagataacacacaacaatggtgctttgcatgtgaagtcccattatagtatgatgagtctcagtacaggtatggaagctgctactcaatattaggttaattttggtcttcatcaagacctttaaagatgatttcctggattttagttcttataatcactgttctgccttcagcaaggacttggtaatgataaattgttggtgtagataagt

SEQ ID NO: 67218 - DNA, 1109 bp, Homo sapiens
agaaaagaaaaagaaaaagaaaaaaggacacttgtttatagtatgagagctgaggcaggaaggcagagcatcgcctgttcaacagcagctgggaaggacaacactctgcacatgaccaaggaagtactgcaagtattgatttgggggttacaaataaatttcagagagtaggtgaatttgtaaatgcagaatctgcaaataatgaggaatgactttattactgtattatcatcgttttgtttgtttgtttttgagatggtcttctttggaggggtctcactctgttgcccaggctggagttcagcagtgtgatcacagctccctgcagcctgaccacctgggctcaagtgatcctcctgccttagcctcgtgagtagctgggaccacagatgtgccaccacatccatctaatttttttgtttatttttagagatgaggtctctctatgtaacccaggctggtcttgaactcctgggctgaagtgatcctgccagaattttcaatttcaaataaaaaacttaatttgagtgacttgcctaacttccacgcaggtaatagatggggaaactgatgcctatacttttggactttctttgttcagggtatgccatctactgaaacactcccttccacccagatctcaggggcttaccacaggtcagcagggatgtgggactgcagcaagccctgctccatacagtcattcagggattcaggcacctctatcccccagcccttcccagaatcccctgcatcccgtcggctgactcacaggaaagagggagtggcaaggcctggatgtagtttggggacattgctgtacgtctatccatactgcattgcccccacttacctgcaagggagcctgcagaatttcttttcctatgtgcccaggcagaaaaaggagtggggtttggtgagcatcgtggcgttttcttccttccaggagcacataatgatgttttaatcccattcttatattccttacgccatttttctgtgtccctttgagaagtgttcgagacttacagcttctacctgttgggattcaatttaagaaaagagtggaagtggaggttttgttttctatgcagtaagtttcctgaatt

SEQ ID NO: 67219 - DNA, 1094 bp, Homo sapiens
catctctaaaaaaataataattttaaaataaataaataaaattaattgatgcgatatcttacctttttgctgttgttttactgactctttggaatctggagtgtattttacacccctcaatttgggttagctacaatacattccaagtgtaccctggtcgcaaatgcatggtggctgccatattggacagcacaggtttagactggttgggatgtgattgtctgagaaggaaaacaggtaaaggaacaattgtatcattacccttaaaaaggggacagcaaacattttcagtaatgggcaaattgtaaatatttaggttttatgggctgtgtggtctctgttgctctgctgtcatagcacaaaagtagccatagacaatggctgtgttccaaaactttatgtacaaaaacagaaggcgggtgaatttgacttgcatgctgtagtttgtctaccctgttcttaactttaaaatacattgctctctcatagaaatcaaaataactttggtttggaattgtttgtatttttaataattgtgtatttagaaaccatcaatacagtaaatgatagcctctgtcatttatttcctctcttataaagtgatgggtgattcttactatgttttaagtgttgtttgttggttggtttagaaaatgaaagtgtttttacatcactattgattaccacttttctctttttttccccttctactcttcatcccttctggctggaataacatgtctggatggtttggctactgtattcctactcatattattctgttacaataggtaagacccttttctttccttttgaattattattctgcctaatgttataatattaatatgtatggttttgcttttaataagtgttcaaggaaatagcatggcatagtttccataaatttattctaaattaaattattttcagctacaaggaaatgtcattggtacagagtataagtggagatagattccagtcaactgtggaatatcctcttaaaatattttataaaacatggtttacactcaatacacaataaaaaaatagatatgtgcaggattttactgtcttatttttttcattctcaa

SEQ ID NO: 67220 - DNA, 1053 bp, Homo sapiens
tttggaatgccatcacttttaagaagtcttctgttctctctccagctggtaacaagcattccctcctcagagtctcctcattgccgtgagcatgtccagctttccagcttgtagtacatctccttacgccccagtcatatctccctccccaacctgcagggcccccgcctgacacagcctccagggccatgctccacctagcattgtgtcatgtgctctgcaggtgctctgcaagtgtttgttggaatgtaaatgtgcctagatgtttttgagtagtttcctttttttttttttcgattacacagcagatttattcaggctcactatttttagtgatgttttcattataatatttagcctcggtaatatttgatcaatgtcaataacatctgtttaactaaaggaaataaaactttgctgggtcaatgagaggtctaccaagtttgaatcgtttctccccaggcaaggaggatactctgcctggttccttcctgttcacctgttctttctcatgcctttccatatcaggctattgtctgaacaactttggacccataacttcttctgggcatggcagcataccaggatggatctagtaaccttcatttgacttttgagggaggataagaaagtaattagttttagttatttgtttcattttgctgcactttgctaattccttctgtgtgtgacacacacacacacatacacacatacatgctgtaaaacatgatttgtaggctgggtgtggtggctcatgcctgcaatcccagcactttgggaggctgaggcgggccgatcacttgaggtcaagagttcgagaccagcctggccaacatggcaaaaacccatctctactaaaaatacaaaaattttctgggcatggtggtgcaggcctgtaatcccaggtacttgggaggctgacgtaggagaatcacttgaatctgggaggcggaggttgcaatgagccacgatcgcgtcactgcactccagcctgggcgacagagtgagacctctgtctcaaaaaacacaaacaaaaccatgatttgtaga

SEQ ID NO: 67221 - DNA, 1050 bp, Homo sapiens
gccgtgggatcacgcacgccgtgactacaaaatgtaaagcaatagaacacacagaacacactggagcattaatctgaggttcttaaatgccattatgcattatttatacttcctgatacgataatatatcgcaaatgaatttacatgagagagataatatttctgcttttcccctgatgatggattcagaatggataaattcctttattttatttcaacctgtcttctaaaataggccagcatgttatagaaataggcttttctctttgaggtgagtgaagtggctcaactcaaggaaatttttctttggataaaagagttttttttttttcttaaattggctttctaactgtgttacattatctgctgatcagctttggaaatgttagaaattttgtcatttaaagctctgaggtgagatgaatagagccacaaagctataggtaaatgatgagaaaaagatgaattgtggtatgtttctaaagacttactctgttccctttaacagcatttggggaaaataacatgggagagacagcacagtttgataattatttgtcacaggagtgcccattagcctacactaatttgattgctgtgaaaaaaacagattaaaatactctgtagaaggcagagtcataacattattgagtgtccagtaggtttcttacttatttaattccctggatccagtctcagaagttggcattaatatcaccttgtttcacagtgaaacaaacggaaaagcagagaggtcaggcaactgacttaaaagcacagagctcgtaagagaggagggtgggctttgaacacaggcagtccaatgtcagagcttgaactcttaactataattctataattaccgcctccccatcccaaaacagcactggcctaaggcacacagaatccataacttcccctttatgtttacagacaactctcagttaccttaaattgaaacattacttttacagccatagataaataggagttgactcttttcaacaggagggccaaaggtacctggcatggaagatatcctgtccacaa

SEQ ID NO: 67222 - DNA, 1051 bp, Homo sapiens
tcaaaacccagtacaaaatttaatgtaaaaaaatgtagttcgatattcacttaaatcacccagatgctgttttgcctcctagtgcaggattttttaaacttgggttaatgagcatccagggcagtcactttcatattctttaactccaatcaatggtaataaatatattttatatcattatctagaatacacaagcaaatcatacagttaaatattcttgtgatatattcagatattaaaaataatttctgagacaaaattttcacaaaatattactaacccatcttatacgcatgctgtagtttatattgttcaatttggttcttctttattctatcattttctatcttgtcctccaatttcatgtcacaatgtacagcatacaacacactgctatagggaacccatggactagctttggggtccttttgaacccctgaaccaatgtgctaaatttctactaggtcatgtgcatttttccaggaagagcatttgtggtacttgtcaaatatttcaaaggtagcttcagtgacccagaaaagctgaagaactgctactatagagggtcttttgataagttacaggttattttgataagtttgtaatgcacttaagttccaatttaagatgatattaatgcaaatagtgacttaaattctttccccttttggtgggagagtttcttttttcccccaacatgactttttaagcaacaccatcactctatgtgaaatgaggtgttgggttagattattcttaagtctctcttaattctaactttacccaaatactttattagtatcaaaaagtaatacatatttattgtagaaaatttacaaacacagataaacaaaataggaaaataaaaattgcccattaaactaccacctaaaaaaaataagattaacattttggtgtctatccttcacgtcttttgtttatgtacaaacatatatactttataaactatatttttcatattgtagtataaactattttgtaacattttgctcactatagcatcatttctctgtgtcatcatatattttct

SEQ ID NO: 67223 - DNA, 1011 bp, Homo sapiens
ttggtgagagactgaggcccagagaattgaaatgacccaaccaactagtaagtgaagattgctctgatcctaatgttccatgttctttttaaaattcctgtacttaattggagtccggtgtcagccagtatagtgccagggctggtgtgtttaccaacttataataaaagtcccaccctcagcattttaaagccttacctgaggcattagccaccctctttagaacctggtcctcccctcgaggaaggatatttttccaatggaatcctctgggtgcaattgaatttcattgggtagtccctgaaattctaattgcagataatggctacacctcagaaattacttatagccttaaaagtttactggagaattctctccttattccccgatacagaactaaagagaggcctgagagaggctgttttcactgtgaagactttaacctcctcggctttttgggggccaaattgatccagtctccaagtctttttagacaattgctaatagctgcatgtttttgatggaaagtcagaagtcatttttttttctttttcccttatctacaatgttgcttgaaaggcatttggggccctctccgtgactgcgatgattaattcagagtctgagggagcaagagagccactcaaaggggaagcatagcatttatagagaggattgaagccctttaaaggcaggatatgggaaggttttgagacaaagttataccttaaagtgacccctgtgtcattggccatcttagggcgacctggctggagaatggcaggcccctcacaactttgtcacaggctgctgtttgctgaagacatgatacagcccacaggaacacgtttaaagattgctggcgcatgaagcacattctttatgttttgaaatgttttactatacttccttgacttgccttatttccataaattttgctttctctgaggaaaatttgaacacctttcacttttcaaatttcagtttttatgaggttgacattttccttag

SEQ ID NO: 67224 - DNA, 1704 bp, Homo sapiens
gaagtgtgcgtgtgaacattttactgtgattcatgagacagggtcactggcttggttcttgcccattcattttcataattcatctgtctaatttatcctgtgagtgtaggatgaacatatgaatttattaaagtggagattgagagataagtaatttttgtaaaaggaagtcgtataaagatcccttgaacccatccaactttagaatatggacagttcagtgagaaaaaaaaaatctgtaggcaagaaatgattctctaattttaatctcgtaaatgtccacataaaggtattaagattgtttatgtacagaaatatatttatttttgtaatagttgtattaatagattttaaattagcatttggtcttttctattttgcttcactaattacgtaaggctttgactattaaattaggttaatttatctctattgcatccatccaggattgggtagaaaaggtaaaaaggccaagtgttttcctaggatcactcaggatcaaaaccaggcttcaggcctctcaattcctggtttctgtgctttgcctaccataaagatattggttgaccttcaaatcgcatactcctttaatcatcttttctcttatgactctaattttcattttcccttgtgattttacaaggcagattttattatgaatgtactttgaagtgagaaatgtgaagcccttttcccgtctctttccctctaaaaagaattagattggccaggtgcagtggctcatgcctgtaatcccagcactttgggaggccgaggcgggtggatcacgaggtcaggagatcgagaccatcctggctaacacggtgaaaccccatctctactaaaaatacgaaaaagaaattagccaggcatggtggcgggcgcctgtagtcccagttgctccggaggctgaggcaggagaatggtgtgaacccaggaggcgaagcttgcagtgagccgagatcccgccactgcactccggcctgggtgacagagcgagaacccctctcaaaaaaaaaaaaaaaaaaaaaattagattgccagaacacaatggcatcttcacatttcttgtgatagtgcttaacatagtttgttgttacatctgattgctggtttctttccaccacactacaggagaggctgtgtttcctccttagcgtaagagtttggcatatagtaggtggtcaataaagggaatttcaataaatagcaaagagtgattcagcagaattgccaaatactgtaagttatttgtaacaaagacactttttccttcagccttttactatccggttttccagactcatgtgctttactggaagcccaaggtttcactgggggaatgtgagtgtcctagaagggaagaaagtgtggcaagactggaaaaccacataagcagacacggatatgacctcacaattagaaaaccatggcaccaattaaagagtctgtatacctttgcctctttgacaaattgtctttttgaattggctttgtgattcatgggctcaaatttgaaacattagtgtttaattcaatgaatggaaaatacttttcatttgactcacgaatattgtcaccatcgttatgtcacctggcatttgagattgtgatgcaactagctcactagttctaccacctgtaacgaatactgcaattagctgctttctctttcctagcctcagtgggttcataatcccttta

SEQ ID NO: 67225 - DNA, 1338 bp, Homo sapiens
tcacaaatttatcgctaacgcagtctgcatcatttatttttcttctgcagcatgtggcaagccctgtgctggtgagacatccatagatggttgggttgatcctattctgggaataggctgtgtgtggtagagagatgagggctgaagaactaaggctgaaggtgagcaagccctacggtgaaaagtaaagtcaatgaggccaattggaagaaaaaggacaggaagaggaatcccaatagatgacaggtgttggtatgactggaatagatgaatgaaaaagagcaggaatgttaatgggttgctgttggatataggagtatccaaatttaagattacagagatggaacaattcccagtggcaacaaaatccaggatgtagacatagcaaattattgcttaagtgaagtaaaaactgtttgtcaagtgaataacatgatattccttgaagcttttcacttgagcaacctttccaatttattagtttggaatttgccattgttggttggattttttttttttttttttttttgatacggagtctcgctttatcgcccaggctggagtgcagtggctctatctaggctcactgcaaactccgcctcctgggttcacaccattctcctgcctcagcctcctgagtagctgggactacaggcgcctgccatggcacccggctaattttttgtatttttagtagagacggggtttcaccgtgttagccaggatggtctcaatctcctgacctcgtgatccgcccgcctcagcctcccaaagtgctgggattacaggcgtgggccaccatgcccccagcctgttggttggaattgtactgagaacctgaatctttctatgactggcctagacagaatgctttgttggcggtaggcaaactgcaggactgttttcattggtaactcttgggaacttaaaaagaacctgaagtttgccagttagacaccgtggctcacacctgtaattccagcactttaggaggccgaagcaggtggacgatttgaggtcaggagttcgagaccagtctgggcaatatggcaaaaccccgtctctactaaaaatacaaaaattagccaggtatggtggtgcatgcctgtaatcccagctactcaggaggctgaggcaagaaaatcacttgaacctgaaagatggaggttgcagtgagctgagattgcaccactgcactccagcctgggtgacagagcaagaatacatctcaaaaaaaattattgataattggtcattaataacttgttcctatagttgtgttagctctgttggattttgatttggccaatggttacactaattttgaataagcttatt

SEQ ID NO: 67226 - DNA, 1042 bp, Homo sapiens
gccatatctttgcctgttatcacctaggagctcccaaaacacagtgaatgttgtttttttttttctttttcttgagggaagacaaattccatagggcaaattgttagaccagttatttgtgcttgtttagtttaacaagtctctgctcctggccatgtggtggggtgtgctatatttgttgagcttttcctacgtgccatacactactaaactctttacatcccttctataatttcatccttataacatacactatcatctcctacttttgttatgaagagactcaatttcagaaaatttaataactggcccaaatatacacagttaatatcaggctgtacgtcctggtctttagtcattttaactgtactgcctcccaccagggcttgatcattagatgggaggtgagtatgacactatttacaggaaaaaggtgtaaaagtgctgtttcattgggctgaagtgattggtgtaccacttctacttgggccattgaatttaaatgaattaacatttatttgtctatatggttgcgtgtaatggagatgccctatggaaagcacttgacaggtattaggtgctagtaagtagtcgtttttgtcattggaattgcttttcagtatgtttggcatgattttgcctagtcctgtgtttctcaaagttactgtgcttttcggtcccccaagaatcttgttaaaatgcagattctgcaagtccagagcagagcctgagagtctgtagttctaaactgttctgagccaatgtagtgctggtggccccaggatcactttttgagtagcaagggctttgtctttgagtgcagcaatgaatttcccatgagatggtgtgtagtttttaactgagatacagcaaaatcaccagcccagagcagacgtttgtccctggtctcagtaaaaaagtgaagagccagttgaactaactaggaattaggcattttaatagaaatgagaagaagctggggagggaatagaaatgaaaggaatgctccaagtcaaggaaatacatcttcctaggaaacacg

SEQ ID NO: 67227 - DNA, 1045 bp, Homo sapiens
ttgctctgaagtgtgaacaggttatcatggaaagatcttggtaggaaacctccaaagacaaactgtctcaatcccacattgctttcatcatcaaggcccctactaatgaggcaattaaggttgctaggatacagactttaaggaggcgcccactctcagggcccatcctctgtttgcaccaccctgagagttagtgcttcattaaattttgagccctagagactttattctcctcacccctgttctatctatctaacattgtcaaactggaagtgatcttagtaatcaccgtattcagccctctattttatagatacagaaactgggctccaggttaaatgacttgttcaatgtaagtaagagtgaaatcatatttaatggattccaagatgcacatttctcactgacagttgaactgacatcaggattgtcttatcattgatggcttttgactttagtgtcatagtttgattggcagtgtttcacctttcttcgtggtataaaaataatgatggtgcatcttaccgtggatgggttcttatgtaccatgaaacacagtattagagagtcaggtcctctgcctcctgattcggtgctcctctgctgcacacttggtgacaaggttatcctgatgtctgcatggttactttggtgattttagagacagcttagcattgtggctgagagcatgggatgtagaaccagacttccctcccacataccagccatctaacttctgcccaagcagcttacttctctgtaatcaaaggtggcaaaagtgttaactacccagtagtgtccttgtgagaatgaaatgaattaatccacacaaatcagttggaacagttgctgacacatagtaagcactcaataaacatactgttgttgttgatgacagtctcactgaccaagtcaccctggacccccgatggtgtctgtacaataacttgaaccaaataggtattcctctatgcatgctatatgaatgtaactgtattgagagtcctgttaaaccctggacaagatttctgagtatcagcatatt

SEQ ID NO: 67228 - DNA, 1074 bp, Homo sapiens
cttgcagtgttaaaaattatcaggatataaatcataatctcaatacaagataagaaaaataacaggttttatttttgattatctgaataacttctcttcagttttcatgagtacttataagttgattgtacttaaatcccctttgtaacaatgcaaggtaagtaaataattaaaacatggcaactgtgcagattagttcaagcctacagatatatttttcgactgaggctttagaatcaatttttctaaggcttagacaaatgcaaattttaaccagagagaaagcacatagttatattctagttattctttcgtgaggtggtctttctttgcaaacagataaactaaatgtatagttggtaatgcatatgagaatcacagagaatcatttttcacaggccggaggacttttctttgtattcctttgcaatgacagctgggggcaggtcatgaatgtatctcctatttccctgtcttcccatcttacctcactatgcttacagcattcatgttatgggctaaaaatggaaggaataaaaagcaaaagagcctaaagtacgatccacagatgacctcagctgactttgttttttgtttgttgttttgcttttttgttcaaagtgaacttttacgttcataattctctagcttctcaactcatagttgctacagatcttcagcagtttgccattcagtctcattttgtctgttcctttctgaagttgtccacaccttagtgaccccagaaaaacccttcctgatggcatgcagctaacttaagggtgtcaaacttcctattgataggagctgttgaacttgacagcctcgatagagggtgagtatgaggcatgaataactcaatttgttcttcttgatcacttagggggcttcatagcatagttctctctattagcatcataaaataaatttgcatgaaaatgtctgtgcattgctcttttggccttttcagagaaagcagatttactcctgctttaaggagctcagtctctactttcatttgacttgaggcattatagaggtcagaggacatggtctatccttagcggctaagat

SEQ ID NO: 67229 - DNA, 1023 bp, Homo sapiens
ttcctccatagatgcaatgcctaatgtcacaatgccaccgcatcaccacatcagctgaaaaaacatttggggaaagtcaggtctgcatgtctgacttgtgaattacattaactaagcctaaacctaatagcccaagtatgctagagggaaaggataaaagggagacttaaaattgctttgaattaaaattgggaaaaaatgagaacgtttgtagaaacttaaattatcccaaaaacatgtctaccaaaaagtagcacttctaggcatagtttgatatctatttcatcatgactgtcatttgtttgttcagcaaatgcttactagcacctactgtgagtcagctattgtgttaggcacttgggatatggcagtaaaaggtatgggaaagagtcattctcttgagctcacatcctagtagaagttttgaacaatagacagtaaacataataaatgagcaaatgctatagtatgttagaaagtggtaatagggaaaagaaagtatagaacagaataatagtgacttggagtatgtgtgggatgagctagtgtgtgggcagttgtcacaagtttgatttcctagaagatccaatccatatcatggcatctctcccccgccacacacactttgtagaataaatctattttaagatataagccaactgcttctcaaaaaggttaagtaacttgccctagatcaagcatctggtaagagagaaatctgtttaccctaaaatatttttatcataccctgctgcctcccagctcagtggctccctgctcccctgtttctgctgctttctgccagggatatctttggctcaaagggttatctcaggatggtatgctgcagatgttttatcggacacttgctttttctaggccactcagggttctagtgccagacgtagttcactgctattgttatatccttggaaatagcagcttataataactggaaattagacatgcatgagagggtaagaaggctaggatcgaaatgttaagatgtagaaagtaggttag

SEQ ID NO: 67230 - DNA, 1016 bp, Homo sapiens
cagtgcgttccagtttgagctagtttgttgggcctgaaatgctcatgaaactttcaagaatataggttgggcaggtctatgaccatgggaatcagaagcatgggagaatgatggcataggagttaggactggacagtcctcaggttcctggagataattaaaaccattgaacaggatcattgtttacaagaactattatggaagttgcttcccttctctgacgtatctctcagtgacagtagtaagtcctgtggggaattattgtaaacatattacaaatattaactcatttaaacctcaaaacaaccctagaaggtaggcgctattactttccttccatttttcaggtaaggaagctgaggcacagagatgttcattttcccaagatcacgtttatttagtggtggagattagaggcaaacctaagtagtttggttgaggagtccatgattttaattgttatgtcctgcagcctcatgcattatccatcaagatgggatagataagaccttagagaaatcagagataaagaataaagaaaacatcatgaggagatgggaggggagtttagtacagtgatatattcattgtctgctgggaagtagatagggtacccatgtttgaatttggttctcgtgagtttatcactccacggttgcataactgttgttctctcacattcgccatatgctttcctggaccagtagctagaataaactcattgtttataataacctcttcaactagctaacagaggaatgtgcgttaacaacaaacaaaccagaagcatgaaaggagctgacaaaaatgagcaacagcaaaatcaaatgaccacccaaagccatctttagcaaagaggaagagcactggttccccaggctgcttttgcgaagcttgcttcaagggctttttatgtatttatttttatttattatcatttttgagatggagtctctctctgtcacctaggctggagtgtagtggtgtgatctcagctcactgcgacctccgcctcc

SEQ ID NO: 67231 - DNA, 1051 bp, Homo sapiens
gcttcaattcccctgttagttgttagcaccgctgagcgtgtgaccttgtttttaatagcatggttattttcctttgttactttcatactctatttctttccatatttaactttgctcttctatgatctgttctaaattatggttgcattgtgtattgtgtattgctccttaattataaatcctggtgtcacactttctcctgtttttcccccatttgctttctgattatctaatttctcctctttgactggatttatgctcattgaatgaaccatttattttctactatctctttatgtatcaaagaagtaagattcttcagaaaatgtgatcaaaactttaggaataattttattaagtaagaatagttaacacctgcagtgtttacatggtgctagactctttaataactcatttaatccaaacagtcaggctttgcaatcatcttctccattgggaaactgaggcccagaaagttatataacttaacaaatttggccttgctatttcccaagatgtgcttccccaatgatgtgtattattttatgacataaataagttgattttcaaacatggtatttcttctttgtttgcatacattaggctatttacatgatgttctgttagttttttctacaaattgattaagaatactgttatgtttgtttttattttcccctaagtatgggttaatacctgattaacaaaatgaaagaaaatgtgattgtttactaattctgcaaactcattatttgttcagaagattgtaataaactctacccttgtataatgtcgagaataatcattacattttttagtcatctgaaaaagttctttaggattattatttcatccatatttaagttttcaggaggattttttaatgaaatataagttgtaaatgtgttaaggattgtcttacagaaaaaaatggaggttataatccacaggaggacacacctgtgcacaaatgctttcacacactatgcacatgtactagaagcatggttgaactattacagctacaaaggcagttgaccatttcactcca

SEQ ID NO: 67232 - DNA, 1023 bp, Homo sapiens
gatgaaaatgttctaaaattagtggcgctggttgcccaactctgtgaatatattaaaagccactaatctttaaaaggctgaatcatttgagagatgtgtattctatttcagtaaagctgttataaaatgatgagtttgaaaaatagaaaaattatgttaatatcgttttgtcatcaccaaaaactaattagttttttgtataaccagttacacaatttgtgacatatattttaaaataattcatttatttactttttatttgactaattggtatagtagtcaactaccaaacaaatattatctgaaaaaaaacaagtcctgtcttatggatgaaatattaagtttattattcagcatattgtgatttcagtaatttctaaatattaccaggtctcatttatgtgatgagtacgttgtggtggcaaagtactcaaatgtgaaagaaaatatttggttagagatccgaattctttttttctataacaacaaacatcttaactcagtaaacttctgagttcgtggcattatggttcaaaatatagccaacacagtttgtggtttgtatacattttcctttctggggagtctaacagttgatgacataaaatgggcagtttcgtgagacatcctacatagggtggctcttgtatttgctgaagaagaagataaaaaacagttgagttgtctcccatcttgattttcctttattgtgacagctgaagataaaaagtccattatataccaaatattatcatctggtatatctgcttccactaagacaaaacaaagatcaggtggcctataagatttcttcagccaaaacacaaacggacattgtggtttcagataaactgaaccgtggctcttggaatgggaagaatgctctctaggcccactaagggggttattataggagcagcagcagttgtttgtggcaggagaaattattcagaagattgctatttctgcaattctgggatgctccagctgcataggttggaactgataataccaagtcagtag

SEQ ID NO: 67233 - DNA, 1036 bp, Homo sapiens
actgatctttctctactcatgccataggagcccaaaaatgtcaaatgaatacactggcaccaagattcctaggagagaggcaggaatgtggatttcaagatttcttatgagactgcgcagcattgtgaacatcctgaataaagaagatatgtgttcagtgacaagggtgaacagcctcaattcatcctgcccttgaggttcttttcagcccattgctagttaagtaaataggccagcaatttagcataatgctctggtagcttcaggttttgctgtgttagacactcatttcatgtaggacacacaggcttgccctttttaatgttattatcacgttttttaacagcactaacagcacttatggccctctggatgtacacgtgggtgtctaagggccccctttttggtgataccattaattcaaataagaagatggccacatagaagacaggctttgcccactacatcttccaaatgtcagtgtcttgtgtttgacagtagagatccttataaatttgaagcctcgttcagtattcacattggcgagcaggctctagctattgttggcagagtgtctgcaaacaatatttttaggagcattggaattaacttttttaaaaattaatttctggttttagaagcttgtcatggttttcctttgcttgacagatatttattgtgcatcttctatgtgcctagcactgtgcaagacactggggcacaacactgaacaaaacagagaaaatccctgccttcattaagcttattaaatacattcaatgagtcaattaaacagtatgccacaaagtgatgtatattaatagggaaacaaatcaaacaactagggcaactaggattgggagtgccaaggaacagtggtgttggcaaattaggtgagtttgaaaagaaatttggatacaaataataggctgaattctgcccaatgactgggctgtagatacctttgtgacatcatttgtaccattgtcttgttattttatttgatctttcatgctatgtcctgcttctgttagta

SEQ ID NO: 67234 - DNA, 2282 bp, Homo sapiens
agaaaaaagtaacaaccattctctgatgtttttttaaatgtcatctgtaaaaaagcatcaagaatgtgcttcttaagtggtaatattagcagatttgagagtatgtcctagactggggacttgacacagaaaacagacttgggcaacagggtctgcagagattgagcatgggaagtgcgatgtgttgagcccttgtgaggctccagagcaagataaagatgcgcccactgttcagcttcttaaaatacgccagctgggtggtgtattccctgggtaggcagggaatttgctccttagataggccccctgattcaggatgtttagtgttagtggcagtttaagccttcgagagctgtttgggagctattttgcttaccagtgcttttgtgtacattcctctgtgttctgcgtgggaaatcaaggacgtgctggactatgcaactgccagagccacctgcaatgccatggaggcaaggtgatttaacacccagagttccacttaccgattagactgtttgctgagaaagcgagggccagctatttcttgaagatcagtaatggggagattggataacaggttttctggcatgttatatgggtctagggagtacctctttttgtatgtgccccaaaattagtatcattgataaaatgcaaggaatctcccttgtggtttcatttacttttacattaatttgcaggcacaggtggacactggacacttaacttgctcaggatttttattttagtgcactttaaattgaaattaaaaagtaatactgggcgtggtgacatgtgcctgcagtcccagctacttgggaggctgaggagacaggttcgcctgagcccaggagttcaaggccagcctgggcaacaaaacgagatcctgtctgtaatttttaaaaagtaatacatagcatgagtggcaagaatgggactgctgagaaaggagacagtttgagacatggtagtcttcggaagtccatcactgcaaaacatgcaagtagaaagaaatacacagctgccttgggttttggctagagatgttattcatattgggaattataaatgagttatgggaggggaaaaggaacaggtgtgttgggctgtggggtgggcgagaggcagtgaagggaccctggctgggtccacactctccagagggctctccttcgcatggtgcaggagcaaggccccccagtgagacagggctgggaactaaggagaacttaagcagactgggaaacagaatagttcctgtggggtctgggtcaggaagacgaggaggcatgcgtgaagcgtgtctgagcaccatccatgcttctcaaagttggtggtgtttgaatcagtaataaggcagcttcacaaagatttgtcttctctccgtctcagtgatctgtgacccaggcagaggaatggatagagtggatggtgggaatggtctgaggccaggaattggcttgaggggtttaggaaaatgctagcagtgcaggaggctgggctgtggagagggtggcttccaattccttaatcctgagccttggaatggaaagggaaggccggcaatagacaacagagggataaatggtcccagtgcaagaggaggagctgaatggagtggaatggcgctgtgggcgtggtcagactggggacatggagagaggatgtgtccaggggaaggccaaggctgacactgaccaaacagagggcagctcttgcctcttctgaggaaggtgggaacgtggacagtatgcttagagagagtcacgtttcaattaaatccaagaagggaaggaaagattgaaaaataggtatgggatacagagtagcttaaagtagtcctaaagcagggcatagcaggtagaggttgtagaagggaataaatctttcctttaaaaggaggtgggagcaggcagtggccatggtttctttccccttcaagaccagcaaataaaagaacatgagtaaaatatagaaatcgcttaaataacatgaatattttatgttctccatgttatctggaaacccagctgtttgctgaccattaaaagaagacagttatagacctggtagtaagttatttaaaaggagaactcagaaaatgtatttgttgaaagatgtttcttgacttgaattctccattatgcttttggcctttgcagaaagaaggaaatcacattatgtacaaacgttgttaattactcattaatctgacattttgatggcattaagcaacaaatattaatttgcgactcaacattgtgattgtatctaaaatgtaa

SEQ ID NO: 67235 - DNA, 2871 bp, Homo sapiens
gggtgcctccccagtaacaggcttagtactaggctctttacaaatgttatttcatttgtttctcatggggagcctatgagatgggaatttgattcctgtgttgggaggaaaaagttaggaaactgagacacggaagggtaaatttgggggcagctgtaagtgtcacatgagcaggctttttgacattagagtctgtcattaggaaatgtactagggcatgtccaccacataaatccctagagtgaacgacaagatggtttcaaaggatgcagaaacataagttttaaatcactgtgttctctgagtatgtaacactttacccccttttgaaaattgggacatctgcatgtctgtaatatgctagcctccctcttctctttgccacactgcctaggggacaggtaccagtgtgtttttggttcatatgcatgctcctttaacaacccaggtagaggttgccaggacctggacacaggaacatgtgcaaagtagctgggtgccctcttactctatcctcacctacctttgactgcagtccccctttgctgtgtttatctgtgctggttggagaatcatttgaggaaacagagctgttttctctgccatctgctgctgtcttgccaccttccggaaacagtggctttctgttctctggcgggtgtgtataaaccaagcaatttagagttaggatactaacgtatcatttcaaatgatacgttagttattttcagtttttactgtaaattttcaaacgaattttaaaaatcgaaaaaatagtacagtggatacctatttaccaaccaggtagattcaaattaatgttttccatatttgctctttctatacttctttttctgaaaatttaaagggatgcagacatcatgacacctaactcctgaataatgactgtgtctcagagttgtatctgctaaaaataaggatataatctctaaaataaggtcattcgcctacataactgcaatgccattttcatacataagaaaattaacacgaattctctagtatcgtgtaatacccagtgcaattatccctccgaaatgtattatgtatttttttccccaaactaggattcaattaggtttcatacattgcatttggcttttatatctccaatagttttagaatttaggcttttgttgtgacagaggtgagaataaaagatctggatgattttcaaaaaaatatttaaatcccatctcacatgaaggatgacttttcagattaaatagactattgatctagattattccggtggttttttacttggtagtaaatggcgccggatatgttaaagttgtaaaatatagaaatctctaaagtgtgtacatgaaccacatcttaacagaggcagtccatcaactgtaaatgtacatgggacctgagtactttgatgctgttgtatgtgtgagaccatctcataagcaaataatgcatcaagggttttggctcagcactggtaatggattataatagattgaaattaaatatgatataagtgacaggaaaattctgccaggtaagtaaataattgattaatcatcccccagttaaacctggcaagttaaattgcagggctggaatcgaatgcttggtagaagctcctctccacattttagtcctgataaaaactgtgctgaagaagaaaagaaaaaccagaaactgttcagaggaagggcctgtcccttgctgtgtcttatttgcggcatggcattgtgtgtattcgttgcgctgtggaagtagtgataagaaaatgaagatccaggaaagagctgtcacagaaaacataaacaagtagagatccatggttgcttggaaatcaacaaatttagaaggcaagtgacagcatatctttccttttttcattttgttttgattgtgataagtgggatcaatatgacttagcatagcaaaactggtcccagtgtgtgcgtgttactgtgtagctgccactggacggtcaaatgaccttggctcagtcactagcctgccagtagtctgggtgtctggtttctaatctgtaaataatagacttggatgggagatctctgaggtgccttccagctcttcagatctaagattctaacagccagaaacctctgtaacatagtgctctcctgatttcctcgtgtgattataactggtctttgtcatgatgaccctcggccgttacagtcttccatgtgtctcctgagtcatcaaagaaaaattaaggtgtgcacttagtttatatgaagcatatgattttgttctacttcttaaagattagcagtattcccctaacactttattaacgagaatgctttatgaatcagaatagtccattctgtgaccatgtagaataagagaaattttattgtaattagaaaaagatgtatatattttaaaaaatggaataaccactaatacattaaagttactgcttaaaagcccttaatttacagtaatgcagcaacctaagtgaaaaagagctgaccctactcattacccaaggcaatgttatgttggattttaattataaagatcggttcagcatttgtattttctgggtcagcagaatatgtcctgtatagcctttaacaaactttttagacttttaaagctatgatttctgcactgtaaaatgggaaaaatacagtacatgtgtcaaagagtagtaaaaggatgaaacgaaatcacaaatcgtgtatgtaaagagcctggggcataataggtgttgagaaatgttaatgatcatagccattgtggtatcactgagtccttggcaatttcattcagggtggagagtcctccaaccaatctgcatgaccaggaatcaagactcattatgttatgtcagtcatcttaattggc

SEQ ID NO: 67236 - DNA, 1050 bp, Homo sapiens
ttcactttccttaatggaatctgaggagaagcccgacctagggacctagggacgacagagccctggtcatctggactggggcagttcggacgtgcaggtgtggctcccagcagccgcttccatctctgctttcccgtcccaggattaggatgctcatgtcgccatgataacaggccgctgccctactcccagctggccagatcagtcacctgggccagttctggctgggtcattttttgtttgtttgcggagctttttttttttttccttttttttctttttttctttttaagttaactagatcaaactccatatctcatttggatttttctgtcctcttaatttctgtatattttttgggtctgattgtaaattagtaattctcttagtgaggcagaatgaagcgcagaacaccaaacaagattctgcttgaattccagccccaaggtgaggaagtgggcattcatccaagtgaaaatttttgttaacgttaggtaaggattcaaaggctctgacccaaagctttagtacgtctccttatcttagattgaattgatgcataactgtatgaatgtttttgtcaggcatcaccataggtactttcaaacctgctcactcaattcctgcagtagttttgggtggagggaattattctcccctttgtttacagtgaagactcttccaagtctcaggaaagctgcttggctccaaggcaagggctcctcccctctgctgcgctgcttctctgcacagccatatgaatggggctcttcactcttctcagagaggtcagtgggcagcaagataaggcagaagccaatgagtgactgtctcacctcctcactctcctccttgggctgagagctccagcatctcagctactctctaaaaggatcttgcagtaaccaaagtggaacatcactttctggtcttccaagaccagaccaactagtcggggacttccaaagggaacaaattgcctatacttccttcagaccaagcatcctgaaagtcgtttgaagttgcctggactactttgggtgggagcca

SEQ ID NO: 67237 - DNA, 1169 bp, Homo sapiens
gaaggacaaaagatgactaaaatgttgagacttactaagaggaagacattaacagaaagagagaacatgagaggacagaggcttgggtgtgaggatcaagggagatattgggttctgtgtggggcatgttgagtttcaggtagtagcagcccattgagataagatgtacaaaacatagatgaaaattgaaatggtgacccaaagacagcaaggtgagtactagaaatatatattgggggttaatgaccctaagttagttgtgcgaatgacacactagagcagaggaagataatgccaattgagaactagtaggaagagatgataggagagccaagtagagaaccccagagacagctatattaaaggggtggcatgagaaaggctctcagaaatacagatttgtcatgacgtgggcaagaagcaagtagagatagtgaaaagaaaagagaaagcaataatcttgaggtctagggaagacttagtagaaagacgagaatttttatggctcaggggaaggagaaaataagggagagaatacaagcaaagagctacttgttggattaagctgtaatcaaggaagaccacagctgtgtaccctattcctctgaggtggtagagaaggaggaacatatgggcaaagagggaaatgttgagatggagaaacatggcaggctggtggtcttcaacattcttgttaaaggagaaggtaggcatctccacatggaaggcttggagtagatgctttagggaatggaaaaggtactcgttagacctgtaggtgatggcctgggaagaaattgggtgattggatgtcctgggttgcccaggacagtcatggtttacacatgttgttccagcataattattttaattgtacctcttgtcactcagtttggaatatatattgcaaggtcaccctagagagaagcaatgaagacttaaagacaaaaggtgtttccctgagacacacacacacacacacacacacacacagagtaagaaccctggcatgttctgcttaaaaagctgaggcacacagcatgtcgtttgcactgttgggtccaacagagaaatgaatggctcaaaagtctagagagagcacctaggacatttgaaatttagttcattagaacttcactgttgagcagatgcacacatccaagttgaaa

SEQ ID NO: 67238 - DNA, 1006 bp, Homo sapiens
tcagcatctcctttgatgcaagatgagggtttttagatacagtgtagacctttatagagtagtgatttaatctttctaaattacatactgatgcctgtgagatttccacaagattaatcatctaatatcatcgatagcttgttgcagcttatttgtaaaaggtaacaagataatttaaaaaaaacttacattcatctgttttctcaaatttgatagtcataaatatcgtagttgataattaggagttacattctgtgtttcatatatttaaattgtatatatttcttaagtgagatgtttatgtattctaataattcacttttttgtgtgtaagcacctgttggaaataaaataatactagataattaggcaatatccagaattgcagaaatgtttacagtggcaagtaagtctccattttcagttcacctgtctccctcagaactgccactctgagaatccactgcatagctgggtgaaacttactagatattgtgaagaaaatgaagtctgtggtgtagcccttacagctgagaattaaactatcctttcagactttttctgcatatataaacatgtattagagaattatttctattacatgcattttatttttttttccttttatcgttttctttatagtcaaagcaaaaggggtggttcatctacagtgattctttttttgttttttttattatactttaagttttagggtacatgtgcacaacgtgcaggttagttacatatgtatacgtgtgccatgttggtgtgctgcacctattaactcgtcatttaacattaggtatatctcctaatgctatccctcccccctccccccaccccacaacaggccctggtgtgtgatgttattacacacaccccaaaagtgagaatgtagttgtagcttttagcaatgtgatttgtaacatatcattactcagtgttcattactatatgtattcattactcagtgttcattactgtatgtagctccttccttcccact

SEQ ID NO: 67239 - DNA, 1037 bp, Homo sapiens
ttgtccgacagcttggttttctcttctctccccaaaaagttgatccacatctttacatacctgttctataacttctttggaaactgtatgtatgttagggtgtgactggattctgaagccagaatttcacagtacacatttttccacatctgaaaggaattggaattgaattccgaatagcatttagaattgaatcggacaagtaaggcctcttccgggttaggctggataatcgagttaattcaaatccatttgaaggatgttccttgaaaaatgttgccttgtggaaaggtgctatatacacagtgaatgcgttatctgtctgtattctgagaactaaaatcttgtggtctcggtcctatttgtatttggtgtcttgtttttgtttgtttgttttgtttttgtttttttgcccaattcacttttactgcttttgtgaacacggctttggaattccagctcacatctgttattccaagggagatgctagatggtcgatgtctggtcgtggcagcctccctgctagcttgcacggtcgtgactagctcagttctgaagttcaacacatttccacctaatgtgccttatgacaaaagaagggcagcgtgtgtcctcccagattggtttacaccctgcatcacttaggcatgtgtaattgtagttcgttgcagtgttgatatccattacctagtaattaatgtactatcttccacttctgtttgagatgtgttattaacttctcagatctgtcctgctgctcctggtttaatctgtacacagtaggaagaaattctgtttcttaccaaaaattgcagagcaatttgatccagtttcttttgttgaaacgctgagctaattatatttaaccacggatgatagtaaagttgcactaacagcattttttaatcaatgggaaatgtttagcttgtgtggggttggggagctgggaatccagatgtgggggaggccaggcaaccaattctatagaaaaacgttaactgtgtgattaagcataagctttctaatggagttattac

SEQ ID NO: 67240 - DNA, 1028 bp, Homo sapiens
gctgcttgtttaggtttcatttttatgtctccctggcctagttggttattaaacagtgggcctaaaaaaactaagggcaaaaaggtgtttctctttcatactacatggaatagacattgggagtcatgaattagaattctctttggtggaaaatgaaaaatcattaaggttgtcttccaataccgctaaaagctaattgcattaaaataattatttatgctgtaagtaagggccaggtaatctgagccgatgttggtgttgcattgtatttgtgtttagaaatcttcagtagtataattaaaagtaaaatacagtgacttgatctttaggggtcttgctttctgtgggaagtgcagggttcaagagggagcaggagacagacagagaaagtggattaatgagtgctggtttcctctgtgtgccagaggctgtgaccttatttattcatgttatctcatgtaatcgccactacaaaactctcaggtggatgttattatcttcattttgcaaagatggaaacaggtgttcagagacattaaacaatttgtgccaaagcatacagctcttaagtaagtggcagagccagaatttgaacccagatctctctgatctattcccccatattgtttcccaaaggatagtttggggaggcatgtggcttgaaatgctcatgagaagggataactttcctgggcatggtggctcacacctgtaatcccagcactttgggaggccgacgcgggtagatcaccagagatcaagagttcgagacaagtctggccaagatggcgaaaccccgtttctactaaaaatacaaaaaattagccaggcttggtggcacatgcctgtaatcccagctactcaggaggctgaggcaggcagaattgcttgaacctgggaggcggaggttgtggtgagccgagatcatgccactgcactgcagcctaggcgacagagtgagactttgtctcaataaataaataaataaataaataaataaataaataaagagaagagataacttattg

SEQ ID NO: 67241 - DNA, 1104 bp, Homo sapiens
ctagaagagaagcctgggacagttacctggacagtaccatagtaccttctgagggagcataaccctggggacactttgatcttggatttctaaccttcagagctctgagacaaggaatttctctttaccctgctcagtttagaccagtttgtttcagccagccctagaaaactaacatagtacatctcatctcttattcccattaggtccttagttttgtcccgtcagcccaggctgggtggtggtacttcttccaagctgtctgttcacatacttttagcaggttccaggagctgccatcaaaaccattttgtctcgtgtattgcatgaagctcatcccctctacattccaaatagccgtcctcacctgtattcccagcagtccccctcccctccaactgatcctcattgtgttctggaattattattttctgtgccacagtggattccgtaagtactccttggctggatgtcaggatattatagcttgaggattgatcttggtatgttcttttgtctgggtcttttattttgccttatattgttcattcacagattttagaagattgcacattttgtttaattatgttggagacagactggcattttagctgttacagtctgtgggagaggggttgatagcaaaaattatgtggagtttaaattgtgttcggtaaaggaagtagaaatgaataaagctgttttaccatgaaaagtcggtattttgccttggatcttagaatgggtctttttttattttttttccttcttagctggaaatgttctaagtgctgcattgtctatttcgtttgccttttacaagtctgactgttataaaaaggaaatttgtatctgtatttgcaaatttgagcctggcagctgtgttttgaaggcttaatctgggatcgaactgagatgcaaatgatgtcgaatagtttttcccatgatgttgtcaagttttacttttcaaaaatactgctcgtggcagctccagcctccacacagggtctactgagttttagatttttaagtaataggcaattttatactgatgttccctcagaaaagcaatggcttctcgttgtaccctccctacacaatgcc

SEQ ID NO: 67242 - DNA, 1050 bp, Homo sapiens
aggagacccattatccaaggcttcaaaaacaagctgatcagtagactcagaccagttaggctctggcgcccgaatcctaaatacactaattcccttggttacccgttgtgtgaggcatgtgtgttcctagcttagtgcccagcacacagtatgttctcaacaagtatctcttctcttccatcattagggataggaccatgataacaactagtacaagtggttgttgagttctttccaaatattgtaagaggtgttaagtatataatagttaaatgcagaggccaaagaagggctgcatgtcattccagcagccatactcacccctccctgatgttcaagccttgactgatctgttgttcagtaactcttactgatcagccactgtcagtctggaggggacttattagtcttttcgacttcagtagcttaaaaataatctcttcctctttagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcgtaagagcctccttcttcttctgcattctctggcctctccttgccaaggagacatgtgggtagtggaaaggtggaaatgatgacagaaggaccagctgagggcctaaccagtcccattctctctccctaagtcttttctgaccttggccaacccagaactcacaaccctggttcacactggtcacagctactcccccacaggcgttcattctcaaaattcaaattacatagttcccagagggctattacgggtttctctatcccttccccaaatgttggctgactgttctgcaatttgggctcctctcccttcttatttccctctcccctgctggtaatggagcccagggctcagtggggtgggggatcattatctgaac

SEQ ID NO: 67243 - DNA, 1043 bp, Homo sapiens
ccagagcccaccatgagctggacaaagtaagaaactggctcataccttttatcatggactagaggagaatggggcatcacaaagtctgctccatgttagtgtctgcgtggaatggatgtgggcttcttaggaatattaaccccaggagaagaatggactcttttctataagattctcttgcttgtgcattgattattccttcaatttcagccttgtgggggcagagtcagagccagagggtgtggtcttgggagcccactttgaaacatttgtgggtacagttgcagcccttggatagtcagaggatggaatagaggaataagaggtgtatgtggacgttcaacttggtgccttaactttttgtgaagactgaggagtctttcccattgactcagtctgcattctatggaacctaattaaaaataaacgtcttatttctgtggtcgaaatcatgctactttgcatttctacatgctctagggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttggtaggggcagtgggggcccaggtcactgctctgccacaattccccttcctctgcacattcagtccatcagtaagaccctggccactgtccctcagaacataacccaatgcaaccatttcttgccagttccaccacctagtccaagccctagtccaagccaccatcatcctcacctgagcagtgggacggtctcatagctggcctccccgactctccctattggtccacttcattcacttctgctcacagtagtcagaatgacctaagtaccactcatctgtttgaaagcctccagtggctccctatggcaaccagaataaaattcagactccctgcaatggcctacaagaccagagatgaactagctcctgccttcttctccagcctcatctt

SEQ ID NO: 67244 - DNA, 1112 bp, Homo sapiens
gtctccagacctcaaaacaactgttgagtttagcgaattcagttgtatggccacattttttttaaattttttattctgtgacttttacaatatagagattcagctcttactttacctttcttttattttattaacctttttgtttttcatgtttattttacctttattttactttgccctctaaaacttccctttcaatggcacttggcacatattccttccaatacgagttgtaatattctcaaaaatcgtacttattaaggaaaacacaatagggaaacctatgaggtttaacctcattcatgtggactccatcaactgaaatctatgaacatttggccagattggattgagatgtgcctatgtgctatccatcaaaaaaggatttgctaaacaggctgtcagtatgcattacctttaggcaaatatttgaactatatggatgattttatgtagaagcaggcatttgtaacaaaagtatatagttctattattgttttctgtttattaaaacagcatcaaagacctcaacatggagaagatatataggcagttgtttatttgcctacttagggttactgtatgaatttgaatataaagcacatgtagtctttcaaaaactagctatcattctcttggggttttttggttcatttgtttgtttccctagcctgaccttttcctatattcatgaaataagtcacatttgtgcagtgttatcttttctcttccacacaaagttcagcaatttcagagcataattgttttaaattgggaaaattcaattttctctaatgttttaacatttaacttagctttggaatgcttgtgttttcttgcattacccaaaacatttggaaaatgaactcatctcaactcatctccttcccatcctgagcccaccccagagcccccatccagttccttgcctgatttcttcatttgagttaatgctaacacccttctcccagtcgttgagactccaagtcacctggactccttcttattgcttcttttggttcttctcacccctccttgccctctgttcagttgccacttattgaaccttcctccagcatctgtctcaaagcttctctttgctgtttcccctc

SEQ ID NO: 67245 - DNA, 1099 bp, Homo sapiens
tcaccttcctgtgcctcatgccacactgttctcttcccagccatctcttcatatgtttttgcttctttgcttttattcagtcagtttcctacacttcaaatgactccatctccaccctagagttccacctcctgaaaatctcatggtccagccccaaagccgtttcctctcgaaggctccatccagggagcgatcttccgccatgtcctgcctcctgcattccttgcccttatcacttttactctataggatatttctgattattatggtttccgtgttgtcacatgcctacatcattgtaagccttggagagtcaggtctgcatctcctaaaacacctagactagggtcttgtacttagcagacagctaacctttgttggataggtgcatgccatcatttaaacccagaaagctcaataattagataaactcagagaaatgttttgtcttttcagcaaaacccaaaatcacatatgtagagaaccagactgccatggaattagaggagcaggtcactcttacctgtgaagcctccggagaccccattccctccatcacctggaggacttctacccggaacatcagcagcgaagaaaaggtatcatgctccccaggagtttcagggccttggaatgcagactcaaagcagattgagtctgctcatgcccagttctctttggggagctgggagatgggttatggtcaccagaggccacagccagatcccggggcctccctccccaaccctgcaggacatggcctgctcatcatccccttgtaatggaataggcacaattccttggataggttggtgggggcgtgatgtatgggcatgctcaagttagatgttctggggaggaggcaatggtgattgtcaatcccagagttatggagctgtgagggaacaaagagaaggcaatatcctggtccaccaggtgacattgtcatcatatcaagggcaccctaggaaagatctcccagaaataaccaggctcaaaatgaacctattaattctttttcttgtgtttgtatactcatgctatatatgcacttatgcacaaatgcctggttgccattgtgtctgcctgtattcttggt

SEQ ID NO: 67246 - DNA, 1143 bp, Homo sapiens
gactgttaagtgcacagcctcactgagaggcttcccgcctgtggcacaggaatcacttagtgctgtcacaggttgggtgctttattgtccaaaagtcatggacccactgggattagggaagagagagaagggttaattatcagccactcttaagcagctacagatctcattctgcttggcctcatacaactttccttgtcattctcatttagagctggttgaggaggagctgagatttatcagggagcattaaggagatgttaagagaattattattgtaagtggaagtaataggtttactcccatgaaagcagacacctcactctgtttttcagaagtgtccttatcatgagtgtcttactttggacgtaattgactttcaagtgaatgctgcccctagggctcagaagttccattctctcctgtttgtctcatttggagatgaagaccataagtccagatgagtgcaaaagaaggctcaggttatggccagtttcattttgtaagttctaaaagcattagcacttttacctggaaggagggagacaaaaacattttgatgagaagaataattatcattaaccttcatatttttggggaaaaaaggagttttcttgccatcaatatcttttcatacttgcccagagctcatctcctccttctgctgcagcctgggtggtcagcatgactttttgtctggatggctggtaggtggcacaccctgaagttgtgcaggagccatagtaaaagcatttcaggggaagatagtctaatgacactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaagtatggctgttcacgcaactgttttctaagcttcccttcaaccatttctagactattctgagtaaagacttggaatatcccctgctttgttgtcgttaaggtcctgttcttgcgtacattcatttctctgcctcttttgttacaacatctcttccttatggaaatgttctct

SEQ ID NO: 67247 - DNA, 1050 bp, Homo sapiens
aaggatttctttaataatttcttatgttgggcacttggaatgtcctgccacaggtacatgcaccatggaactggcaagtgggcagacagaaaggacaggctggcagtgcaggtttcccaggatctcatgaggtagggctgctgctgctgctgctgcaatatctgctggccggaggctttgcttccattttagacatcccaaacaaagtcatcttgggggacctagccccaaaccaatcttggtacttagatcaggctgcctgacataactgagtctcattttctgtttcggatactcccaggttctcatgctgcttcccagtgcctcccccattagatggtacctaaagtaagaaagccattgacacagagaggagagaggaagtgagacgggtcacagacaagtgatggcctagtctcccagcccccatcctgccatagcactgttgcccttcaccctgccttgggctctgacatgctcccttcccccccacccccggcagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatgtaaggaataaatggggaaggacctgggggagggaggggcaaggcagggtcaggatgagagaggaaaacatcagcaaggacctatgtgcaccctgtgtgttctgcttacgttccctgcagctgaccctgggctatttcagagctctgttcccaagccaccccctacacaccatctccaggcttcttacaagcctgctgtgcccttgagtcttcttcccatgctgtgcacaggaattctagaatggccctgacctctactataccaggcgctggctctgctttggagcacacctgccttcccagtgccaggagacaggatatgggggcttcataatcatggcagtcatcctgacagtcattgttatttattgcagatgccccaaagctacagggccct

SEQ ID NO: 67248 - DNA, 1021 bp, Homo sapiens
actgttgggatgcagatgcacagcaggatctcctaccactggagttgtgctctggttataccccaagccccaaggaagagaaggcacagagtcagcagaggccagtgtgctgcacaggcaggtgttgctgccggactcctgggctgccaggtgtcaggtgagaccagcgcatttggcactgactcatcgcttgaagttcgttgagatgtctcaataatggggttgctttcttggttctttaatagacctttccatgtttagggacatggatatatcagagcagggatgagcagggggagctagtaaaagccacaaacacttaatggactcttgttttcaagctgccagttagtaagcatggcttacctgtttggaggttcctttgtgtgtagttcatgaatgtgcatgaaggtaatgaggaagctgtgaccccagaccaacaaataaaactctaacctgtgagaatgtgcctatttcatgtattttttaagccaaatgtctgcatgccatcaagacactcaggaggaaagctcaaaacctctgtttgccttgagacgggctgcttgtgtcagactccttacaactagctaggaatcttcccctccatgactgagctacccaccttcataatttcattgcccaaacattacctcttaatttgcttctgtaccatgaagcaaaatagattatttctttttgaatatagagattatgaatgagtctctacttttttttttttttttttttttttgagacggagtctcgctctgtcgcccaggctggagtgcagtggcgggatctcggctcactgcaagctccgcctcccgggttcacgccatactcctgagtctctactttttaaaagaggcatcttgagatttttgttttcatatgttgtcccccaggtggcacattgcaagtataactatgcaaacaattcaagctaaacaaagaaaagagagggaaggagacctgaattaaccagaccatccaataatgatgagttatgattctttgttgc

SEQ ID NO: 67249 - DNA, 1059 bp, Homo sapiens
atcttggttccagattttgcctgaagaaggaattaggtgtctctcccctgacatgtctttaatttttaaacatcagacatttctgcccacagacaaaatgcttagttgtgacatccaaagggaagaaagtttgagtcattttattttgaaccacttgactactgacccaaattgtaggtcccagtggatactgagataaaggaaagatgctcacaattgggcagcagcctgagtttagcatgaacatatttctcactagtaagatgaaatgtggcacatgtgaattgcagtggaactaatagcagagtagctatcagcatgtgaatatccatcgatcatcaatccatcagtggggttgaaaatacatatctcccagttttgcttctgtgtgtgtgcgtgtgtgtgtgtgtgtgtgtgtgtgtgtgtgtggacccatttataattatgagggaataaaggtattctaaataaaaccaaaggagcaattgcttagttgtatataatccctgcaaggcccctttggtaggaaggtgcctgaatctgtgtaatgccagacaataagaaagaagcacacattctgtcagctcacggtggcaagggaagaggtagcctggttaaagcatttctctcaggttatttttaaccagcggtgttctttacacagaaaggtgtcttcatctcccttctttgcccttctccctcagcctcaattggcaatggccaaaactttccctggcctcttaaatttaaggtcagaaacccaaaataccttttaacaagtcgagatcactcagtcacaacataggaccaaaaggaatgcttaagaaaagtgttttttttttttcattgtaaatctcaaatttatgacttatcagtgcaaccacgattctaaagatataactttaaccacaacaggttgggtgccgtggctcaagcctataatcccagcactttgggaggctgaggtggaaggatcacttgagcccagcggggccaacagggcgaaacccccatctctacaaaaaatagaaaaattagctgggtatagtagcagacgcc

SEQ ID NO: 67250 - DNA, 1006 bp, Homo sapiens
ggctgaggcagaaagattgcttgagcccgggaggtcaaggctggagtgagctatcttcatgccactgcactgcagcctgggtgatgaaacgagaccgtttcaaaacaaaaaactttaaccacaaatggcccaaacatttgcttaatgtcaaactctcagcacgttgggccaaaggtacagtttctgctgtttagtgtcaacacagccattgtctcaaccatcagaaggaaacccattccctagtctgcactggcctcttcctttatatgggtcttgacttcagggaggctcaccgaggtctcaggaataacatgggtttgtggagaaagaagtgagataagatcctcaaagccaccatctctggcatgcatccacccagcctcattcagcccatactcccctcctccttatgccataggaaacatgaaatgactcttcttaatttaatacaatcttttgttcttctagggcacacagtcttcaccttaagactctcgggacttttccttgatgacccatattctgtttcattgcccttgtttcccaaggatgctgagacatttctggaatctgtggataataacttgcttttttcttttcctttaacagtctcctggattgactttgacatctgggtcctgacagcaacacctccccatttcaaaacaagtttacatgctcctgatgtggtattaatatgtagtgttgcagccgtagctaatgcttattggtgttgttaaccaaatgctctttatgatttattattcttctatttctgggcagtttcactgccctcccaatgtttcctatatatgctgctaatttaatttgatttctccttttatttagtctgtgattttgttgttgatttttctccctgcccattgtttacatcagtttttaatttttttgtattttccatgtgacctcctccactttcctttcaaccaatatcatgtgcgtgcgtatcatgtgactttgtcatgtggcttgcatggtgctgatg

SEQ ID NO: 67251 - DNA, 1057 bp, Homo sapiens
aacaagcttggtcatttctgtgcaatgctataattcggaacgaaacaaagcacaatgttaataaggtagacactaattcattcctctgaagagagatctcttccagacattttaagccagggcaagaaatgtttaaagatgttttctgcagttgccgtagaaacactccttagcagtcatcttggctgttggtaaaaaatgtggccggtaccaaaaaaaaaaaaaaaaaatcgctgacagccttagagaattacaaagctatgattacgccctcctggaaccatgtcctcatccatgacagaccctctcctgccatctgcaagggggcaagctgaagacttattcaggtgagccccgcacgcagcaggaattgtcctttaacaataaaatttaagagaatgaagaggtcagggccaataaaatccatggaggagagcaacaaagcttagttaaggacagttatcacctcctctccctgggtattagcaaagatttaagctgaattgggcctcaatgagaaaagtgagagtaagctggggggtgaggggggagctttctgctgtcagtgggttgtacacccaacaactggtgacatctgatgttccctgtccaccttgtaccccctcaaaaaaagaaaactgcctgggatatgcataacctaagctggatgctccatctaccctgagttcagtgggacagcgtttacagaatccagcagcactgcgtgaagtgtggcgactcagaaggagaagggaggttataacagggattgagccctatcctttatggttacttggctcctgagcctacagggcttggcctgtagaggattgtgacagataagcttagacacctgtcccagaaaagaagaagtgaggatgcaaactttgattctaaggtcatggcatcatgtcactgcagggcttcctccaatgactccacggagccgtggctttgtccaccagctactgaggactctgtgtaaatgggactccccaccagcagcatgtgtgagatgagaagccccctgcacccctctgtccatgtgctgcatgtc

SEQ ID NO: 67252 - DNA, 1038 bp, Homo sapiens
tggtgaccctaagagaaggaagagatgatgcccatttacttacaaaccctatctaccaaaggcctctcaatggaaacagattaaattgaaccacttgtaatagaacaagtggagaaaatagatgctggaaagcaccatcaatgaaagcaatccggtctgctagagactgtgatggcagcagttctcctaggagatacagatctgtctccagggatccaagacctaaccttgctggtctcctttttggccaaatccctcagagaagaaggagctcttcaactgatcactctgcttttccagaccagccaaatgccaaccccaggcaggagaggtgggcatagaacatacagctgcagcctgttggggggccccatagaccctgccatgttcaagtgtggtgggaagacggccttgggcagcccccctcatgcctgccctgtcttcagtgcttgcccggctcttggctcggtggtcatgattcctcctcccaggaggagacaggccagagggctgtggcctgcctatgatgcagggatgtatgtgcaaaaatgggctaggagagcagcaacaaaacgggatcagtgtgtggttcccagtggttgtttgtacatggatgtgtgtgtctgggagacgtgtgctggacctccagtgagttggcaggtgagttttacactgtaggtcagaagcatcaattggtccaccctgcattgacaggaaggctccccagtgcttgctggggtgggtgtttctccacagtcgctggtcagatggtcggtgcagaaggcaaggcacgtgggcaaggctgcaggaaatgtcctcattataccttaacaggatgttcaaatggaggttctccttgcttttcctctgccccttctttctctccattctttggtccattcctttacaatcgacagcttggagtgaatgtccagatctgtctggccttcatgggacacttaggaggtgagatcaggtgaggcttgagtaagccctttgcagcaagacagattccttatggcaattgctccctggggt

SEQ ID NO: 67253 - DNA, 1115 bp, Homo sapiens
cctgcagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcg

SEQ ID NO: 67254 - DNA, 1037 bp, Homo sapiens
cctatccctgagcacttgaggagccacagccccgcctgaaatcagtgatcactgcctgcctgtgctgcaaagccttttgccctggtccaggggaaacacagcagcgccctccaactgcctcattatccggtgttctcagacaggcggggctcagtctgctcccaggactcacgggaggccagctgaccaggctcacccctgttccccaatctgtgagatgatgttgtcatccctccctctggaaggtatagaaagaccctgttttctcaattctggggcatagaaggtccccaggaaggtgtcactctgggcatgaatgccatgactctgtcctctgggccctccccacccgcaggggcttttgctggcagggtctggaggtctcgcatctcagtctgttaaccaccagccatctctctcccactcaagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgtgagtgcagacctgtccaccttgctgaggtttgggctctgctccagcccagggacccagcagctgcaccaccctgcgccatcagctggtgcctttcctttcattgcacgttctccatttggaaccctgatgggggaaaaacattagagaaaagtttctcaaagcatggtctttgggggttacctgtttgaaatgtagactcttgagcccaatcccagatctcttgtattagaatctccccagagtgtgaaaatccctgtgtaggtcaaaatgagggaaattgtcagaactaaacctggggaggagctgccatggggtagggcagcattagagggacacacttaccttgctttcgtacattgtttattcattcattcatccatcactcaacaaatattta

SEQ ID NO: 67255 - DNA, 2651 bp, Homo sapiens
gcccctgaaatcagtgctgggagcccagcccagcccagcaggctgcatttacatccagctgagctgttgccactgcagctggtcagggtgaggaggagctgcctctgctgcccccttccaccaccccaggtaaaaacacagcctctggcatcaacttagggctggaagaggaaaggactcgttcttctgactcagtgcttctcaactatggctgcacattagagtcacttgggtgcttttaaaagtcactgtgtccggaccaattaaatcaggatttccgcgaacacagctcgggcttgggtgatttttagtgctcccaggtgatttgacgggcagaggttggagccgggtgctgtcactggagaacccctcctcctccctgctgtccccaaggcctggatgcaggggcgagatgtctgcagaccgtggtctcagtggttctgttttcctgattctctgcaggaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagagg

SEQ ID NO: 67256 - DNA, 1076 bp, Homo sapiens
tgttcttaactcttcctgcatgtaaaacattcctctccttactaagtgtgacctgcagaaaagtcaccacatttctcagagccccagtttcctctctataaaatgggagcatcaacacctacctctccttctgtggtttggatataatatacatgaagtacctagcataggtgactgacagatagaaagtatttacttaatggcgactctttttgagaacagaaatgaccatgagcccattatctgccccctcccaccctcacggatctgcttatcttccttggtcctccgtctcactgaaggcaagcatgtatttggctctgtttacctttccctctctcctgtgactggtggcaaacatgaagatcccccaagagccagctgccagccagaagcctgccttcttacatgaccccatggcagcagggcctgagagcactggtcttgggtgggatggggttcagagcaactcagggctcagggatagggtagcagcgctccttgtcagggcctggggccaggggtgcatgggcatcaacaggacccagtgtgaagtggaaggtgctaggatcaatgctctaaaatcctctttgcaaacagatactcctctgttacttgcagtttgtcctcagtttataatcaggaaaacctgttgattgcaatgactgtagctccaatcatatattcatcaggatgtcattagttcttttctcctaaagccccagagctgcatccccctaccctccctgatgccctagaaagaggagtgctagcccagcgggacatccagttgcccaccacctcctccagcagctcccggccctgtgggtggccacatgccagccaagcactgggcttctgtgacctgaagctgctggatgacttatttccttttaataagactcctaatttgatctcaatttcaaaaaggcaaaatgatgaaggagttctccctggagacattctgccctgtggtctgattttgccctggggctggatcaggctttcttggctgctctgaggctcagccctggcttaggtaggagggagccttagggtgctggcaaagcagggaa

SEQ ID NO: 67257 - DNA, 1041 bp, Homo sapiens
ggaggaagggcccattttcgcaggtgaagaaaatacccatttttgaaaattcatgtaatttcaggtagcattacttttctcagcaattgagagaatggggaactaagggtagaactgaaataaatgcatcacagggctattacacagaacagcagatttcttcatagaagctattcctgacaggtacagcaatttggaggtaggatctcttgtaactgaaaagcatgcttttcactccttcctcacagtaacacagaaaactgcattgcagctcttcttagcctatgcagatgcagtccctcgggactgtttcacctaatgaatagtttatactaggttggtgcaaaagtaattgcaatttttgccattaaaagtaatgtattatggcacatggagtaggcagaccctatcctcttccctggtcaaggcaattgatagctgatggttaagtgcatgttcattctggttagagatgaatcatctaattgagcatgtggaagttggcatggcaactgttacatgacccttgagggtacctgttctgatggggaacctgagaattccctgggatcttgagggtacctgtcccacctgggaatcaaactttctttttttaggaaaagagtgtagattatgggagaaggggaactgtaaggggcttgactcagtggatctatgggccaagtagaagaaacctccttcctaaagagcaacaagaactatataaatgactttgagagatgaaattcaagaaaggtttcccaaaggaaagtttttattaaaaaggcaagtgtgcaaacagtgtaaatccatgcaattatttgataatggttcctgtttctgtgtggatcccgacttggtgacctgttttatggtcagttttgcaaatgcatttctctctgaaatggagatcctccagatggcactcttacctcagcctgggagcctcacaaggcatctagacctgatctgtggaaatgcaagccagagaaacctgaccgttttaccctgagcttatattctgaccttggtcagctccgg

SEQ ID NO: 67258 - DNA, 1102 bp, Homo sapiens
tcctgagatgcgttgtatagtgtaaagtcatttaatttgcaagtaaactcaataatttgatttagtaaagtgaatgcagtcttgtgcaggttccatttttccaacacactgttgcagtttaaattttacatgtgattcttcaggaaaattgtctggacttggccagctgatgcctctaaatcatagattgactaaatccctatttgtaatcacatcccctgctttgcaacaagctgtgcgacattctattggagaaacaggctctttcatgcaggcaaactaaattactgacaatctgttgaaacatattttgtgtcattcttatatagaagtattgtcagagaactgatgtagtgtctagtaagttgttccaaattggttggaaaacatgttgtagctgacccacctggacagcatgcatcaaagatctgctgccctttccccacttctgagctggcccaattctattctattgtgtttcctctgtgcaaaaccaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtatgtataacccttctatagaggcatataactctccatagctacaagagagtaatagtgcccttgatagcagggcttttccctgtttcctgatgttagtcatgcaagactttcatattgagtagcagtagctggggccttttcatgatctatcataatgcagatctcattaccactttcccatatttgatagcataaagacttctcatccatattattttggtcttgagtatgtggtttggcatgctgtacaagtgatctggcaactgtaagaattatagccttctgacatctggatggaaattgttgctcactttaaggagcagtggatgcttttttttttttgagacatggtcttactctgtcacccaggttggagtgcagtggctcaatcattcctca

SEQ ID NO: 67259 - DNA, 2620 bp, Homo sapiens
tcttgaactccttggctcaagtgatcctcctgccttggtctctcaaaatgatggtattacagttgtgagccactgcaccggccagactttgggcagtattttagaataacttatggagctttaaaaatatacatatttactctcttcctagggcatttgatttatgtctgatgtaaggcccaggtgtgtttttttctttttttttaagccccacaggtgattctgatgtgtagctggaaaagaggactatcttagttatcttagtttgttggcttctgacttgtatatcctagttttatattgagttagcaaactagaaactgttaattgaatgactgttagtgggtagatagcagaaatataagacaaaatttcttcccaagctgggtagataagactaatacgtgtagaagaattaaagtagtgattttcaatcctggatgaaaattaaaatcacctgggaagattttaaaacatataaatgctgtgatttcactcttagagcttgtgatttaatttgtttggggtaaagtctaaacatctgtggttttttaaaattcccaggtgactctaatctagtcagtttttgaaaactagtgaattagaaaataattgaacacttcattatatgactgaagtaggaatttggagaaaggtgaagtaaacctgtatttccatagatgtatccgtgtaaaatttcaaggacattattatgcatagctctgctaggttttcagtgcaaaaagttgactcaggcaaacatcttgattcccttaatctttctttattgttaatcaccaggatagttttataggataaaatcccattcaggcagaacagcctccctctgggagtgggagtgatgagattgtatcttgttatgtatagcatttagaaactagacagttattaaagcctagaaatacattagagaagttgtgactttcatcaaccccagcttcagtaacaggtggttgctttgtttttctacccctccttctggcctagggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttggtaactgatactttcaatgtaggaaagcatatggattatgcagcttgtcaacatagtatctttatagtttttgaatgagaaaattagaaattaggtggtggtcctgagctgtatcagaaagtgggagggcatttaatttgcaagtgtttccagttatataattttataaggtgagtgtagtctttgtgggagacttttttacttttttgtaacatgatttcatggtacgttagagttccaaactgcagtcctagtgtgcattgaatttgccaggtcaggattcacataataggatttataatgtgacaattttgtttgtattgttggtaagagctcactaatgtcagtgctagttcttttgcaaaaccccaagacagctcccccatcttacatctcccttagttttacttgggattactaaaagtcaaaagaaatgaaatgtggagtaaatcaatatgttgatcatagcagagaatctatgtgtttcacttagcttttcaattcttgatttttccctagttggtatagatacatcagaataataagtagttcctttttctatagtaatttttcttagctgactcgggctctaagcaaactactggaaaatattatctggagggtggggtttgaggaacgggctaatgtattcaaagtgattgtttctagtagctttagggcagctttatgatattatctagcaattatttttatataggcagaacagatacatggtttatgcatctcttgtctatcctggttttgcagtgtgtaattgagcagcttttaaaattttttattctgtttttccatcatagggacagaatgctttttggcccaaatgcgggcacagaaaggtgaacttctggaaagattatcaagtgctaggaacttttcaaatatggacgatgaagagaattattctgcagcaagtaaagcagtccggcaggtaggaggctcttgctagcactgaaatttgtattctatccttagatgcctttttttttgtttgcttttttaaagcagaaaacaatatgtaacaagtattcagttgattccctgcacccccacctttggaaaatctagataccttttacaatcatgtttaagaactttttcttcccctctcccaccaagacaacacgaaactatcttttcattgactcaataattgcaacttgttacctagaaagtctgttgtggcaagtagttgattcctgaacttagatttgggaatttgaaatattggcttttatcttaatgctcccctttcttaagtgatttatcttttttgctgcagttttcctatcctcaggttgatgagtctgcttttcatctaccagggatatcactatggttaaatgttcaagaagcatatgtccttagttactttacctcattttggcataatgccactttcccaatgaactcacaaatgataa

SEQ ID NO: 67260 - DNA, 1039 bp, Homo sapiens
gaaattgataaatagaaaagaggctttgggttgaatgcggctcttcttacaatcattaatgcatccaggtgtttggaattgtagtctggttagtaaatactggttgagactatatttccatctagattaatggtgttttccagcaaccaaggcaggtgttctgtgcaactgtagttttagcttatgactctcactgaagatgcacttagtttaaatttttttcttgtttttagtgtattcttaggcatttctgttaagtctatgttttctttttagtgctgttcaacttttctactcagtgaggaatatcttccatttgttccatgatgttgtaccaacatatcacaagtaagtaccactgtatctcatttctatataataattgtatgtctaagatgtggaagttaagttaaaacaaataattttatattcccactaaagatattttgtttactaacattcacactaaaatgcagtaaatcattttaaaacgcatatttaaaggatttggtcatttattactaaattaattagggtattataatcttgcagtgtagttcatgatgcacattttaaaactcaaaagaactaccttgttttgctgctaagcattttcagaactgcctttacttaactttcagcctctagttcagttttctttatttgaattaaaatgtttagatgtttttcataaatatctttgataacatgtcaacaaagctattccttagccaagaactctgaatttcagagacaaaaatctgccaggcacagtggctcacacttgtaatcccagcaccttggaaggcagaggtgggaggattgtttgaggccagaagtttgagattagtttgagcaacatagtgagaccctcgcctctaattaaaacaaagaaacaaaaaaccaaaaaaaaaaacaaaagctgtttactatttaaagtattttttagttcagatttttgaatattgggatgtttttaactaggctcacctgttgtttttattataaaagcttattgtgaaccttattagttttattt

SEQ ID NO: 67261 - DNA, 1854 bp, Homo sapiens
ctagcagtttatcttggctagaaagtgtaaaggagctctctagccattctctctcttgcttaggaaagaagatggatcagtaggcttgtgggtagaggaggggtcttgctcaatttctttccagtccttggggaaaataatgagctagggagtgctttgcaaggtgaagaaataggattacttctgccctggctttgatttatgctacttggctgtcagcctttctgcctacctctgggtatgagccctctttggtgtgttgtttgccctgagagtaaaacttcagaggctgtatttaaaggacatgctattgtacctggtgtattttccaacactggattttgaaatttagtgtatttcaagagaaactttctccccctgttccctttcctatatccactttggcctacaaattcattatatacatatgtgtgtacatagacacatatgtgcatatgtgtatgtgtgtcaggtatttgaagggagttatcctgaaaattttagattctgttctcaagtagaatattagttaagagaagagggcaggtgtgttgaattatttgttataacacaccctacttgttaaacttgtttggcagaaagaacatagaaaggaaggtctgtgaaactaggacctcatttttctttttttttgaaacagggtctcgctctgtcgcccaggctggagtgcagtagctcaatcatagttcactgcagtctcaaactcccaggctgaagcgatccttctgcctcagccccaactacttctcccaccctgcccccagtagctgtgaccacaggtgcgtgctaccacgcctgaccaatttttaaattttttgttagagacagcgtctcactacgttgcccaggctggtcttgaactcctgggctcaagtgatcctcccgcctcgacctcccaaagtgctgggattacagacatgagcccctgcacctgacctcaaaaagtcatttccttttttaaagtgatgccaaggacatgtatgtcataattcatatttggttgcattaggagtatattgtaatagaactgcattggaaatatcagagaatgagctctgaggaatagaagtgggaacatctcatattggtgagacagctgatatttttcttcctttttcttagataccagcagtttggaatcttacctacaaactgaacttcatttatacactgaacaatcgcacaaagaggagaagacccctatgccacccatcagttctgtcctcttggcattttctgttcttggagaactacacagcaagcttaaatcatttggtaaggcatgctactttgtttcatttacacaaaatctcctgaggcccagtattaaagggaagacagaaaagatgataaaatattctctgcagagtattagtatagggtctggcctcttgattcatcaaagagaattgtcctaaatattatcccttttattaagggattgggttttttttttttcaactgttcctatttttttttttggtttttgaataatttaaataaaaatctgtagaccatctgggaaacttcagtggtaaaacctgcaccgcataatggttggtgtgtaatgtcatggtatatgtattttggttgttaggttcaaagattcatattttttttttgacatgcttactttttagaagtgtttttttttgagatggagttttcgcttttgtcgcccaggctggagtgcaatggcatgatctcagcttactgcaacctctgcctcctgggttcaggcagttctcctgcctcagcctcccgagtagctgggatttacaggtgcctgccaccatgcccagctaatttttgtattttcagtagagacgggat

SEQ ID NO: 67262 - DNA, 1305 bp, Homo sapiens
ctagggaagttgaggctgcagtgagctgagattgcaccactgcgcttcagcctgggcaacagagtgagaccctgtttcaattaaaaaaaagaaattcctaatagaggtgtctgactctagaatgagttatcacttggcagtggggatacctttctagtaatccaggtgggtgagctctctgatgaaagatacctgcttaaattaagaatagatggtgacatgaggatattatgttgagaggaatgggtattcttgcaataggataagggtttggactagttggacctctaaggtatcttcctactacattctgtgatttttattccagtcttaactagcatttaaatttcaacataaattatgttgacctagtaaagcttattgatttgctttaaattttttatttcttaggtatggtatagcttaaaagtacttgtttttgatgtgtgaattaggtccgccgggatcttcacgtatcaaccggtgaatttacagacttaaagcagcagttggaaagagactcagttgtcctaagtttgcttaaacagttgcaggaggtcagtaaactcaacttgaaccttagtgttttggtggtgggaaggtctcattagtcaatggctatctcctgactataatgggtttttttgtcttcatatttttttttctttctttttttttttttagaggggggagggggagggaaagtgggagcatttcttaatgtttaaaagcaaacagacttgaaataataggatgtataaaatattatacttaacttttcagttttccactgctattgaagaatataattgtgcattaacagagaagaagtatgtcactggtgctcagcgtctggaagaggtactaaatgctctccccaaagcatgcgcaataagtgctcttcttgttttcagtaaattttgtattttttatcattatgcaaatatattctaattgccctgagtccagatggaatgtttaacagtgattccatttcgttaccaggcacagaaatgcttgaagttattaaaatccagaaaatgctttgatttaaaaatattgaaatctctcagcatggagctcacaatacagaaacagaacatactttatcaccttggagaagagtggcagaagctgattgtatggaagttcccaccatcaaaaggtgctgctgacctcaggtggactgctttgcttcatctgcctgaaccagtgtagtgtctgaatatattctacatttttgtattagtagatgagggttcattcataatcttccatgtctgtattgagcactcatgttagcaa

SEQ ID NO: 67263 - DNA, 1096 bp, Homo sapiens
agtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttacctttggtgtgcagtatggtctttatttaaatatatattttccatttgggaaatggacatacttggtatttgtcttgttccaatttttcttctttaaaaccaaaaagcagattagagggttgataaactggatggggactgacgcgccagtgtttgaaataaaaggcaacagtcaattattgagcagcacctagtggtaactgaagctttttaatctcattggctatttgcattgcatgtaagcttatctactttgtcaaatttttgaatgcaaaaacagcaattttcttagaatggagtttcttatgtagtcattcctcagcagacaccggcaattgctgggacccctgcatataccaaaatccatgcatact

SEQ ID NO: 67264 - DNA, 1288 bp, Homo sapiens
ttcagtttttatttagaccaagcttgtccaacctgaagcccaacacaaatttctaaactttcttaaaacattatgaatttttttttaacctcatcagctattgttagtgaggttcatgtgtggcccagggaagccaaaagactgtacacccctgatttaaaaccatgtgtatacactgatatattgtaaacatttgaaagaaaataattaccatcatatctatgctagagtatcatatctacttccttgtattttaagaagacaattggttagaagaccctttcgtaataaagtaattatatagttgttatatagcagtgagctaaagtttggtttatttgcctttgctcctggtttggcctgaaggaataatcatttattagtaactggccagcataatgctttgacctttgaggttaggtaaggggctaatagaaggcttgttcacttttactcagaaatctgtttagctgtatatgtaaccatctgttttccctccacagaaaatctgcagctgtgcctaggggagtttctacccagacttctagatccttctgcagaaatcatcgtcttgaaagagcctccaacaattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaa

SEQ ID NO: 67265 - DNA, 4422 bp, Homo sapiens
ggtatatgcctgtagtcccagctacttgggaggctgaggtgggaggatcacctgagcccaggagttcagggctgcagtgagctgtgatcatgtcactgaactccagcctgggtgacaaagtgatactctgtctcaaaaaaaaaaaaaagtacagtatgtttttggtgccagaatgctaaaagagtttcatcccttatgaaatgcaagaaacttaaaaattccatagttgtttttgtaattcgatatgaattttttagaagtctttttagagtcaagagactgcctagctcctaggcatcaatttctgtgtgcagaagcccacagcacactattttctaaccattgattctgcccttaataggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaaggtgagaagagaatattcaggtgaatcccttggtctgggttgggctagatggactcctctgttggggaagttttgccctgtgccttttcattgctttctgaactttgtcccacacagatcaatcagcattatgaaggtggctcaagcgaaactgaaggaaattggtccagatgacatgaatatggaagagtacaaggtaaagtgttttctttaagtctatagagcaaaaacattaattcctgaggtaaatggtacctgaggcaaaataaacaattttgtgctattacaaactgacttgttcttccactttcccctcaaaatcctggtaaagaatggataaatgatattttcttgccctcagaatagcaggtctctttattttcattcttcatttagagtgagtcaacatttcacttcccttaaatacctattttagccttgtcctaggcagtaaaattcttgaaatcatgcttttggtttgttttaaatgataaagttttaaaaatacgcattaaaatacatagctacacatgttttcaattgcatcccatgtaaaacaatgttatgtaccacccaaggtgtattcaccacacttactgaacttgaacttgctctgtatgactagaaatgtccgtgtccttccatattttcaatatctggatggttttaccagtcctaaagaggtcattcacttaagctagagctgaatatcttttacatagctgttagaaattaggataaaatccgaagctcgtaggaaataagtacttctgttactcaagtgaaaggaacagaacattgaaaattaaggtcagtggtagacttttattttaaatgttgagtaggtttttatctgaaagcttttgtttgttatttttgtggctagccagatgtgctcagtaaatatttgtaatgaatttaaaacttagatgggaaggacactaacaatctattatgatcatgattattaataatcgtcattctttttcagaagtggcatgaagattatagtttgttccgaaaagtgtctgtgtatctcctaacaggcctagaactctatcaaaaaggaaagtatgttggccttttattttaccaagattattagtcaggatgctgttctctgtagatgcctacctgggaatactaagagtcacagccatgcataacctcccttgtcacatacactagtgtgcctcttctcttgcagtgctttggttttgctctaaacatcacacatggtttttcatccttcaaatgattagatgtattagctgcgagataatattgtgccaggctgtctttgtgatcaatgaagatgaactcagaaaatgaatttttgagttgacatagaccctagtgagcatttcttgttttagagatgggaaaacctgaggcctagggaagtttcatatttgctttggatggctaggccaatttgtagaagagatgagactggctacggtctttggtccttcactttttcagaattgcagccaagtaggttcttgaaatggggaaaagtgaggtctaagccctagattttagtaaaagagcactcagctgttgtttatctcccatttttctaaggtaccaagaggcactttcctacctggtatatgcctaccagagcaatgctgccctgctgatgaaggggccccgccggggggtcaaagaatccgtgattgctttataccgaagaaaatgccttctggtttgtactgtttgtaaagccttaaggtttttttgttgtttacctctgctccttgaagccaggaaaatatatggctttcaaaacagactatctccaacaggttgtagatttccccccaaaattctcatgaacagttttacattggaacaggttttttttcagttacttttagtgaatgtcattcttcttcaatgataactgatagaagttaagatgagaatcagtcatccctctgtgtgcccttcatgtatgcctgcattatagattttatcacattgctttcctactaggttgtaaattccttgagctcagatccttttctcactcagccatttcctctgtgcctgtcatgtaggaaccatgtaataaatgtgtgtggaaggaatgcagcattttttccatgttcacatttaagctggtagacttaaagttttagtgacttctgacactccatttttttaaaataaaggtaggaactgtaagaattggtcctgctgttctgataacatcattgtcacatactagtgaagactaactctctcctggcctgatttgcactgtataactacatggaaaggcagacctacatccccttgcctccccaggggtttatgtgatgtgtgtcctttggagaactgtaaaggggtggcctgccttcagagtgtgggcttgtgtgtgttttcaccaatacccagcaaatttgcccttcacagaagtcaggccaatatttctaccactgcctttaccttgttcataccgaatgggtgagattaagtcatgacatatactcaatagctttattttctgatttatactttgacatctgtattagttataggtgtggcagggccactttgaagctgaaaagggatcttgttggtttgatggatctgaattttattagagccatgtttttatattttaaatcaccaaatagattgacattttgaatatcctactcagcttctgaagtaatgcaattatagggatttagactctttccattattgagtcccaacccctagtgtgcatcagaatcatatagggagctttcagacagtcgtgaagctcaggcctctccctagcaattaaaccagaatccctgggaagggccctgggcatcagtgtgtcttctgcaggtgattctgatgctcagaggagatagacaaccagtgaacaggtctttggttgaaacaggtgttaagcatgaccttgacttacaagtttaggccaatgggtcataaactttacagcattagaatcactttgggagctttcataaaatcccagtgtcccggtcatctaaacactaattaaatcagcttatcagaagtgggaaccaggcatcagtagtttttaaagatccctaagtacatccaatgtgcagtaaagtttgggaaccacttgtttagactgttattaaagagatatttatctttttcagactcttccccacctaattctaccttttatctgtaggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcaggtatatgctcttggtaataatattctgaggttttgagaattgtagaaatttcagtgttctcacttgatagcactggttgccaaacctttttaaggaattggaaccttctagcatataagtaaattaaaaatggatctgctctattgaaacaagaggagggagcctgggcctctgcccctcttaacctccctttagcttccccatgactgccaaatcacctccatgggcaaccaacaagcctggtttgaaaaaagtcactgctctccaggaatgtcagacttccattactctctcatgtgccaaaagatgaactcttttatagtttaaaaatcaaaatctgactgggtgcagtggctcacacctgtaatcccagcactttcagaggccgaggtgggcagatcacctgaggccaggagttcaagaccaagtctggccaacaaggcgaaaccccatctctactaaaaatacaaaaattagctaggtgtggtcatgggcgc

SEQ ID NO: 67266 - DNA, 1040 bp, Homo sapiens
aggtttacgcctataatcccagccctttgggaggccaaggcgggtggatcacctcgggtcgggagttcaagaccagcctggccaacatggtgaaacccctgtctctactaaaaatacaaaaattagctgggcatggtggcatacacctataatcccagctacttgggaggctgaggcaggagaaccgcttgaacccgggaggcggaggttgcagtgagctgagatcacgccattgcactccagcctgggcgacagagcgagactctgtctcccaaaaaaaaaaaaagtccttgaaaagtttttactttatggagtcatatttgtatagtcgctagtttccagactattttaaatgtactgtttatcctagtaaaactctaaagtatttgtgtgtttaagatatacacccaaagtacagaactaaattggaattctgaccttagacacttcccctctgagaactataatttaacttaattcttcagcagtgccatattgggagatatttttaggcatacatctttctttatcctactgaattagaacatagagcgtaggaatagcttgtcttgggcagggtgttgacattatatagaaggacagaggcagtgggtgcacataggaatgggtgtgtgaaactcagcttgcaatacatgctggccaaagagcacactgctctgctgccctttagcactctgttcagcctgctttcatacagtcttctgctgaacctttcttctctcctttctctctgtgttttgtgcccccttgtggtaggtgatgctgagccctgccatgcaaggggtcatcctggccatagctaaagcccgtcagacctttgaccgagatgggtctgaagcagggctgattaaggtatctctgtttttaaaattctaattcttacaatataggcatcataatattggggaaataattctataagaagggaaaaaatggggttaaggctgggtgtggtggtgtgtgcatgtagtcccagctactcaggaagctgaagtagaggctcacttgagctcaggagt

SEQ ID NO: 67267 - DNA, 2194 bp, Homo sapiens
tgttattcattcacttagcagatgtttaatgagtgcctactaaatgtcaggcactgttatcaattgttgcccttacattgtccatacaggttgagcatcccacatgtgaatatccaaaatcccaaatgctccaaaatccacaaaactttatgagcctttttcattacatgatgctggaagggaatgctcattggagcattttgaatttcagatgttggattttaggatttgggatgctcaactataactaattgtgcagattttctaaaatatgaaaaaaatttgaagtccaaaacagttctagtcccaatcattttggataagagatactcagcctgcatttctgatggattctatgtgcatgtatttttagttaggagtaagataaagatgaaataccctgctttcttcttttctaaaaaggatgttttcgttccttgtgaccttttaactctatctttgcttttcctcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaaggtatctgagaaggcatttatgccagtgatccagtaacatctcatgctgtactcccctagccagccctatacccttcagctggctaggtgatgccacagtcttcacagtatatttcatatacagttggtatgccaggtacaacctgatggaatgaattgtggcattagaatgtgatttctgatgaacagaagcagtatcagaaagactaactacctgtgaccttcactgtgtatatagttttgcttatttcccaggttatgggagaaactatgatagggttaataggtagactttatgaaaaccattctccaaaggtgatcttcctaaaagatgcttgtttgtagaaagttttcttaatggatagaaatatgacaaagttgggagtgcattaaattttacagaatcatctgtgggttcaaagtttacagactttatcaatagagttcttgctgaagtagccatttcttatagttattaatttctagggaaaatctgcataggcttttgtaaaaagctgtgttaacagggttgtatattaaactgtatacattctgcttgctttttatctgagtgttctagactatttatcattagatgctaagacctttgttcaattctttatcagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgagaatgactgggaagcccaagttcaggagagccgggctttcagcagcgatggccagttttctcacatttctattattctgtgtctctgctgcctttaaccaacccctatttatttctcctgttttttcttactctttctccccactctgctgccacagcttaaagaagctgaacccaagaagcccatgccccaggaaacaaaccttgcagagcagtcagaacagcccccaaaggctaatgatgcagagtctactgcccagcctaattctgaggtctctgaagtcgagattcccagtgtgggaaggattctggttagatctgatgcagatggatatgatgaggaggtacagagatgagtgcaggatatagttgtttgttgtcagtcttatatttccttctcttgtgactatattaaggtatctgccaatagctgatattttctcgttgcaaaaaatgattgtcaagaaagcctatttggttttgaccttagttaccattatttaaaagatagccatgtttctattgtatagcgctcccagcatatgtatatctacccaggcttatacttaatggggccactgcagagtctagatggctcagaaaagtaaaattaagttccctttttggtattatggacaaaagattgccttctaatttaaaatagggaatcttttttttggatattagtccattgttttacctccagatataaatttttcagttgtccagtgagctaaacaaatgtggattgaagttatttt

SEQ ID NO: 67268 - DNA, 1097 bp, Homo sapiens
gataagtggtcacttaactctaagaagcatgtggctgaattaaatatgttaacttaaattttgttgccaaataaaataggcatggaacaaaatagctgctaacctttgtaggtcccaaatatgctaagcattttcagcatgagtggtcaaggtgattctatttttagataaacagagttttgaattagaaggatgcatatgtttaggttatgtttggttttagatctgaggagtttagagttgaaagagtcttcagagaggtcatgtagttcagcgatctggttttcaaggttttggaactgagacataattgatcaattccaaggctgtgtttttgtggacttcatcttgaatcaacaagatgttttaatatgaaccccacattaatcacatcataaacagtaatttcttaataacctaaactttatcagattactttgcttcacctgactggggaatgtacattctgacttacaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcaggtaaaagtatcttggcagaatctatagattggggaaaatctgtactgctcagggagaagaacagtcttgtactgctttttaaaaaatttacaacttactattatataataatagatttaaaaaatatagacagtataaaaggaaatgaaaaggaaaaacaagtttgctttactactttcttccttgaccatgggtcccactcccaacaagtacacaatgttaggtttcttatgtagtcttcaagacacattgtatacatatgctagattctatttatctgtatcttcccctcccccttttccccaagtagattatttttccattcaactctgaacctttttcattaatcgagtatttagcaatctctatatttttagtaaaagaatcttaa

SEQ ID NO: 67269 - DNA, 1232 bp, Homo sapiens
ccctttgacctcattgcccatattgctcagactaaccttaccccccttcctgtctccttttgtctagggaacaaaaagatgatggaaaatacagattcttcccagattcctattcagagaaatttagccttaccctttgttctgctttctcatttcagatcctgtctgaggcatacattttacagccaagtgacccattaagatcttttcctaaacagcttactctttaagaaattttggcaattataaaaaataatgttttaaaaccttaatgtaattatattgaactaaaagctttcataacctaaagtactagctgctttaaaactgtatattgcttcgtggttcatagagggaagctgaaatcattaggaccctagcaatattctttgcttagttaaagtagcctgtgtgacatagaatgagatcattttagtgaagcttttgtttttctttttccaaacagatttaaagacttgtattgcaagtactactcagactattgaacagatgtactgcgatcctctccttcgtcaggtagaatgaaaattgatgggaaagtagtcaaggcatgtgctaatggtagatacaaaaatcaaatttgatagttttcttttaaacccaatgggaatccccctaagataaaagaataaacttaagatataaattgatgttgttctgtttctttattttaggctaaagaaagcaatataccttttaccaaaaacaggacctaacacatacttgtttgaattctgccacatggaattttttcatattgtagaaaggtttgctgtcagatactaataaaaattacttacaaaatggtactttaagtagtgcagtgggaaaaactgaactagagaacagttatcctttctttcccaaagttccatgattcttcaagatctttaatttaacaacatgcgttcaagctttatttctgtaataataaattccaaaagagagttaggacagaaattcttaactatccacagaagtgtttgttagaataaattctgggaatggaggggtaaagagcctccaggagtgtctctgaacctattctggttaggggcatggactttcagtggcttctgtatgaatgactggaatgggcagaatggcttggaggaggggagccctgtttctagaatggcattgaggcacagtcccattgcttaacaggaatgcaccatgtaaaacgcaggcttccccattttttcttttgt

SEQ ID NO: 67270 - DNA, 1204 bp, Homo sapiens
ttccaggaaggatagtgtcactttagttggcttcatcttgtaaactctgtagttgattccttgattcttccaggcctagtcttctcttttccattttccttctcttcccatcctcatgggaaggaataatcagtgatcagagaacatgagctaaagactggccgatctggctttggattcattttcattaccttccagcttggtgaacttgggcatgttgcttaatttatttaaaccttaggctcacagttggtaaaatagggatagaaaagtatctacctcacaggccagttgtggtacgtgagatgatagagaaaaaggttggctctgtacctttatagagttaatgctcactgaatacctgtactttttcatatagcatcttgctttccaaagtacataatttaggccaaggtatcttttggaaattatcatatgagcatgatttttgtcttcctcagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaaggttggctcttttaaaatttgtcagttactctttgctttttctgttttttgactatttggaggttaagcacctcggtacacttcctgacattactgtacatgctacagaatttcccccccgccgagatggagtctcactctatcacccaggctggagtgcagtggtgcaatctcagctcactgaaacctccgccttccgggttcaggcgattttcatggctcagcctcccaagtagctgggattataggcatgtaccaccacacctggctgattttttttttttttttagtagagatggggtttcaccatgttggtcaggctggtcttaaactcctgaccaaaactgatctgcctgccttggcctcccaaagtgctgggattataggtgtgagccactacgtctggcccatgcttttgaattttgacatggtaattgtgacttcttttgcacttttagtgccctgtaaacttggctcacacacccccattatacagatatggaaagatctccccctcaaaatttctgggaaatga

SEQ ID NO: 67271 - DNA, 3031 bp, Homo sapiens
actacgcataaatgggttaatggtttttagtctggccgggcgcggtggatcacttgaggtcaggagttccagacccgcctgaccaacatggtgaaaccccgtctctactaaaaatacagaattagccgagcgtggtggcgcatgcctgtagtcctagctactcgggaggctgaggcaggagaatcacttgaaccggggaggtggaggttgcagtgagccaagatcacgccattgcaccccagcctgggcaacaagagcaaaactctgtctcataaataaataaataattgtttttagtctttatcttggtaaaccaagcccctaaaaattctaattattcccttgatacatttttataatggaaaaaataaaatgattataaatttcagattttattttttaaggttacacatatctgcttgtatatgtgtgacacagtcctgggaaaatataaaagaaactgttaatggataccattaggtagtagaactgagatggaggtagatgacttttatggtctgttttatacttttttgtatttgaattttcgtaccaggtacatgcattacttttacagtttaagaataaaaatgttggccaggcacagtggctcacacctgtaatcccagcactttgggaggctgaggtgggtggatcagttgagatcaggagttcgagaccagcttggctgacacagcaaaaccccatctctactaaaaatataaaaattagctgggcgtggcatcgcacacctgtagtcccagctactcgggaggctgaggcaggacaattgcttgaacccaggaggcagaggttgcagtaagccgagatcgtgccgctgcactccagcctgggtgacaaaatgagactctgtctcaaaaaaaaaaaaaaagaataaaaatgctcactatttcttcttctgtaagataaccttgatatatttttgaaaattgaatttcttgtgtatagtatagacatcttttttttaaccacttttgctctgattctactaaactgatagaggtgtacattgtatgaagtagttggtcctaaaagttgtataaaggaattcagtagatgaacatgaaaatgattatgtcttgtcttctttgtttttttttttttggtgttttgttttgctttttttgagacagagtctcactctgtcactcaggctggagcacagtggcatgatcttggctcactgtagtctcaacctcccaggctcaagcgatcctcctgcctcagcctcccaaggagctgggactacaggagtgtgccatcatgcctggctaatttttttcattttttgtggagacagggttttgtcatgttgcctaggctggtcttgaactccttggcttcaagccatctacctgccttggcctccccaagtactgggattacaagcatgagtcaccatgcccagctgaaaattgttatgtcataaaattgaagataagtttcttaaagaaaaaaatctcttgggatttagtgtaagtattgtattaaaatgcagcaaacctgggaagaattaaagttgtaaaatgatgacttaaaaattgccaggcgcggtggcccttaatcccagcactttgggaggccaaggcgggtggatcacgaagtcaggagatcgagaccatcctggctaatacagtgaaaccctgtctctactaaaaatacaaaaaattagccaggcgtggtggcgggttcctgtagtcccagctactggggaggctgaggcaggagaatggcgtgaacccaggaggcggagcttgcagtgagccaagatagcgccactgcactccagcctgggcaacagagggagactctgtctcaaaaaaaaaaaaccaaaaaataaaaaataaataaatgaccaaagcctaaatgtaatatgacatcatgagaaagtgtaactggcatgactttgattaggagcctatttgaaatgtttcctgccagatataaaacttcagattgttggcaatttttagttttgtagttagagaatttttaccctatagattgtttgaggaccctattaaatattgtatagcctctaggaataagcctttccattgacttgctgtgataaacagatcttttgtcagcgactcttaaaatacaaaacagccttgggcagtagagtaccactgtctttgtcgcttaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaaggtaatgaaaacattttttttttaatggtatgtattgtttttctggtataatttaaactatgcaccatctttgtacttgattgacagtcacctataagagcacaggagctgtgagctctttgtcttaaagggaagggttttgctgactgtcacttgggtgggagtgggcccaccagtgcatttgtcttatccgtagaatggttgggttatttcagaggcttctcaaactgttcaggatagtgttcaggctccacccagtgatgccttgttttgaactacaagccagctgccattaaaggcctttctcagaggaaacctcaagccctgctcttccaaaacatctcatgctcacacacttgaagtatgcatgactaagaaacatcaaggaaagagagacttattcttgaatagaaaattagtacttgaaaaagaactggctagaaataagaggacagcttagaggggcttctctagtaaaggcagagggaggcaaagtcacaggagccctctgattttattccatccagtcatgtgcaacaatctttattgcctagaggagccatgaaaggtagctaggacatttgatatgtgttacctggctaataaaaacactaatactcaataaaaagttagacttttttgtcaaaaaatcttaactattctccccaacacatcccccgcc

SEQ ID NO: 67272 - DNA, 2090 bp, Homo sapiens
ttttcggccagacatggtggctcacacctgtaatcccagcactttgggaggctgaggtgggtggatcacctgaggtagggagtttgagaccagcctgaccaacctggtgaaaccccatctctactaaaaaatacaaaaattaatcagacttggtgatgggcacctgtaattccagctacctgggaggctgaggcaggaggattgcttgaacccgggaggcggaggtcacagtgagccgagattgcgccgttgcactccagcctgggtgacgagtgagactccatctcaaaaataataataatattgagtccttcaatccatgaacagtgtatagctccatttattaaataagttaatagagatttaagtccttattaatatctctcaacagtgttttgtaatttttagtgtacaggtcttgcacatgtttgattaaatttatctctaattcctgcttttaatttcatttttcatttgttctttacaagtgtatagaattgcagttgattttttttctttttttaaattgattttgtatcctttgactttactaaactcacttattagttctgatgtatttttttaggttccttaagattttctgcatgcttacatcatgtggaactaaaaggcagctttacttcattctttactatctgcatgcctttcatttgtttttcttactttattgcattggttatatcttcagttaagtatttaatagaagtagcaagagtgggtatccttgttcctgattttagggggaatgcatcagttttaaccttgagtatgctgtcagccgtatgttttttatagatgccctatatctgattgaagaagtttccttgaatctttagtttactgagactttatgtcattaatgttttataatataaattgtgtttgtgggattatttacttaggtacatgtacaggagcaaggagcttattcgaaataagagagagtgtattcgaaagttgaaggaggaaataaaaattctgcagcaaaaattggaaaggtgagttttggacaccttcatgcttagaaatgtaaaagaatattaaaaacagataatttgtttttctttaaaaattaactcaacgtttaaatattaactagaatattttataaaacagctaagaaaattttttgtctaagtgtgaagcagtcttcaggatcagctagtattattcatgggggtaaataatagtcccagactactgaagtgactcagagtcacacagttagttactgcagtgtaccaaggagaaactgagttctgattttatagactttttttctactccccttgccatctttttcacaaacatgagagaagcaagtgtcacgatggtcccgtccacttttggaaaagcagtttctgaagtgtctaagaaagataaaaaacagtgcttttctacctagagcagtgctaactgattaaaagggctaatatttctgatgcatacaaagttctttctcttttggaggaattttcacttttttgattgttggttttacactatttctgtagaatggttttctgtaatttccttaggagtcagtttaatttctttctcgtctagatagatcccgttgattttgcgcttaagaaagagatcccatacacagtcaatagcttctcctccctttatccacttaacagttttctttctaagaccaccacacctccacctactcccttattaggccattaatttccctgaagggcaacactttccataccaggcctaagatggaccctgcactgtacccccaccgctaccactgcagcttccactctcactccagaagagcttatacaagatgtattgtgactagtcatttgtctttatagagacttaagctgaaaaccagttcctcaaatactgtcctggaagtgattttcaggacttttaagtctgttagtattttactaaacctttaagttttagtgatactttgtaaggctggaaattttaaattatttttatagaaccaaccataccaactggatgcagtatcatgtgcctataatcccagctatatgggaggctgaggcaagaggattgcctgtgctcaggagttt

SEQ ID NO: 67273 - DNA, 3164 bp, Homo sapiens
ttttgagacaagtccttgctctgttgcccaggttgtagcgcagtggcaacatcatagcttactgtaaccttggacttctgggctcaagaaatcctcctaccttatcctcctgagtagccaggacttcaggcgtgtgttactgcacccggataatttttattttttgtagagacaggggtgtcactgtgttttccaggctggtcaaactcctggcctcaagtgatcctcccaccttggcctcccaaagtggtgggattacaggcataagccacgaagcccctggtctttttccagtgttactggttttcattgttcagtgtctagattgactggctcactagaggttgctataaaggcgtaagtgcatttctaaccagctatcaggaagttgctgaatttaaaatgttgtctctgtggagccagaagataggctttagatagtcatagtgatgtcttttttaaaaagtctctctctttgcctaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagaggtacgttggagatctttatttgctgtgccagtgacaaagccagttaagtaggagtgagcttttgggcagactagtttcccatcacatattaagtaactttacacttagcagaacttgaatttgtcttaagtctctcatcagttgatgtgagtcagtgagtatcagtactttgataaataatttttactaaaactatgaatttgagttactcgtgtaaaggttgtatgctgcttctgatgttttaagtatgatcaagtttctctctttctgttgaagcctacctgtacctgagtagggagaacccactgcctccatattttcggagggtaaaagtacagtgattaactcctatggtatgccatttagaatattttccctattatagtatttactgttctcaattgtaaattctgcctttgcttttaacatttttaaaatttaattttcatttgtttatttatgtatctattttttttctgggttggaaagacgggggaagttaaagggagagcatgggtagttaacatctcagtattccagttaggttaagaattagtgaatagcatttgtaacataattctttacacagttgggattgttctccattgatcatacattttgagacaaaactgtggcttatatatgattccaactcagtaattactataggagaaagtggagctttcctgaattaaaatagggagcctaacatgagccatatgaaaatacattcactgtagagcagtgttggaactcagagagctgctgcctccctggattttcaaggaaaaactgattcctaatggaggaattacgtcatctgtaccatctgtgcaaacctggtgcatcctcttacaaaagagggagtcttcaccagctatacttaggcctgtggagacctgtattccaggatgggaattctataaaaattaaacaaaacaacaaaattgtcatgctcatttagatttcaccctgaggtggtctcacaggctgtgtgaattcacctcattatgctgacagggtatctgaagggaatgttgcttgcacttgtggtaaaggaaatattttaaagctgttgacaggaacctcagacatacaggtgaattgaatagaaaagccaaatctgatttagcttttcctcacctgtgatccctgactgttgagtcttttttatgtcagtgccttccttctttgaaactcaagtaacatcgtaggttgatttgactggcttctttatgagacctctgtaagtttttgaaattcagagatttttcttagaaattgagaaattgtaaaaccatgaggctatttcaaatttcctttgtatatataaaggagattcaaattatggttaatagactaaaacagcatgtaatatatgtacacatatgagtctttttagctggcacatggagttgtctctttagctacatgctgcttcgatcataatttcatattctgtagttaggctagctgttaagtttttaaacctcttctgaatactgatgatgtaacgaatgagttatgtagatgcttagtgcggttcacatattcaagggtggtttattctgaggatgatggttgagtaaaattctgttgactggctagtaaatttggagtcttgaggaatgttgaaccatattctgtaagagaatgagattctaagtgttgattccctttagtgtttgggataaaaaaaagttctagtatgagtttgccttgagtataagttctataccaaaggaagaaactttaatgagagatattttaaatctggttattgtaatttcctaaaattaatttttctttctctcacatttctactcttgacactagcgttggtttacaaagctacctccagtgttgacctttgaactctcaagatttgagtttaatcagtcccttgggcagccagagaaaattcacaataagctggaatttcctcagattatttatatggacaggtgagttcttggctgatttttttttttcctgaggtattacagcagtagagatgagcacgtactaagtatagtgtgcgtaggaatcacctgggagacatgataatatgcaaatttggattctatgagtctaggttgagggtctttgcctttttctgagacctcccagggttgtgctcatgttgcttctgatctccggaagcaagactttaggtgaaagccctcctccttttgggggtaggaactacctgaattctgggggtgggggtgctcctagcagacttacattatagaatttttgtttttttttttttttgagacagagttttgctcttgttgcccaggctggagtgcaatggcgcaatctcggctcaccgaaacatctgcttcccgggttcaagtgattctcctgcctcagcctcccaagtagctggaattacaggcatgcaccaccacacccggctaattttatatttttagtagagacggggtttctccatgttggtcaggctggtcgcgaactcccgacctcaggtgatccgcctgccttggcctcccaaagtgctggtat

SEQ ID NO: 67274 - DNA, 4589 bp, Homo sapiens
gtcattttataaacactttttacaatattatttcaatgactgcttaatagtctattgtataaatgtagtatagtttatataaactacttcttttggctgggcttggtggcttatgcttgtaatcccaacactttgggaggccaaagcgggcagatcccttgagctcaggagtttgagaccatcctgggcaacatagggagaccctgtctctacaaaaccaaaccaaaacaaaacaaaagctactccttttgttagacattaggttgtttctattttttacctaaaagtattaatattctttgagctaattttttgtgcacaaccattatttccttagaaataacataagtcaaattgccaggttgatagttttgcatacttttaaatatgaaataaaatatttgaagtgaaaaatacatatgttgctgcagttattttcaggaaaggctatgaatccctttctttctttatttcagtctctctttcaattgcctgaatttcgaagacttgttctcagttatagtctgccacaaaatgtacttgaaaattgtcgaagtcatacagtaagttggtgtcaaggaatttcttcactgttgtttagtccctttcatccctaaggcttctagatttttgcctaaagctgatatccgtgatactctttggcttgtgctaattatttgttttcatttctaaatggctcattttccttttttgggataacatataagggtatgcaaaaatgtaaaattaagtaggagtaaaatgagaaaaacagctccaagaatatgtgggtggggagaccctgaatacctgttgtgtttgttgtatcctttctcttcctgagctgcttaggcaatgtgatgctggagagatgccctgatgccagagacctgagccgccttagtctattttattctgtttttgccaaaggtcgtagcctcctcctagcaatttaacccttcccaggatttcaccttggcgcaatgcattttcctcatgagaaggagggcagcagcttcagaaagtggacatttctgtttttccaacagtgctgtctctggcttctacatagttattcttcagtttagagtacagtccttaccagagtccctgtaacacacatagccctgtgactttgacctagatctaggtaaatataaatgagggcatgattattgacaacttttttttctttacacgttctgattttctaaatgagatattgtaagagtacatgtactgtgttttctacaggaaaagagaaatatcatgtttatgcaagagcttcagtatttgtttgctctaatgatgggatcaaatagaaaatttgtagacccgtctgcagccctggatctattaaagggagcattccgatcatctgaggaacagcaggtacaaaagaagccttgttcttgagtttgaagtcatgccttgtcagtgttaatgcggtactgcttcatttcaactgcgtaacaagctgtgaacatgactaagcaggactatggatgctcgtttctgacttttgttttgcctacagaacaggtggtgagagagaaagcatgtgtgtgtgagagagtgtgcgtgtgttgcacgggggctggcagttctaaagagaagaagaaatagtagtagaaagaatgtagaattataccggggctattgatgtagaaaggaggagattggaaaatacctcaatgagctgtaacaaaagggataccaagaaaagtagtcctttgtctgcacctttgtcttggaatggtccagatggaaatagtatctttaaaactatctaaacctgagttcaggagcttttcggagcttttctcagcaacttctctcttctagactttcccttccctacctcctattaaaaaatagccgggcatggtggtacgcacctgtagtcccagctacttgggaggttgaggcaggaagatccctggaacccaggagtttgaggctgcaataagctgtgattgcactactgtactccagcctgggtgacagagtgagaccccgtctctgaaaaaataatttaaaaacaaaaacaaagctgtcactaattagatcatcttcttcctcatatgattttttttctttctctatttgaaggtcctacagttctacaaaattctcaaaacattgaagttttctttctttattcagatctctgtattgttctagagttccttgggcctttttcttaaaaagtcctacttggaagattttgtttatttttctttctttgtcataaatagatgtggctggaagtagtagagttccagcttccttctagctacaactttcaggttgcttaatgcaccttcttttttatgtatagtagctgggtttcagtgttcctatgttttcatgatattcagcccccaaaaataaacgctttcaggctgtgcgcaatagctgatgcctgtaatcccagcacttgcgacgccgaggcaggtggatcatttgaggtcaggagttcaagaccagcttggccaacatggtgaaaccccgtctcagctaaaaatacaaaaattagccaggcatggtggcatgtgcctgtaatcccagctacttgggaggctgaggcaggagaatcgcttgaatctgggaggtggaggctgcattgagctgagatcgcgccactgcactccagtctgggcgacagagtgagaccctgtctcaaaacaaaaaaagaaaagaaaaaaagaaatgcttttatagtagtataatcttaattcattggtgggataaggataaattttaatttctcttagtattgcatctaacttttatgcaatttgtgcctctcttatagcaagatgtgagtgaattcacacacaagctcctggattggctagaggacgcattccagctagctgttaatgttaagtgagtgttgagggtttgtttgtacatccttccgactcacagtgggccagtgagaattatatgctggaaagttactctccttaactagaaattgctggtttttaaccatacctcctgggataaccactgaggtagtcctcatcatgtatccctgtcgccttcagctttcccctctgaggatgtaccagtcatcttatcctgcagcttttttttttttctaactaaaggactgtaactgttaactttgttaataaactcagcatgtgctgtaaaatgtatttgtaaaaaggacaaatcaacctctgttgtgaacatgatggtataatatgggtacttaaatttaagatcccttttgaggtctactaagaatgtgtagaggataggttatagtcatttcagtcactgagagaagtgaaacttagggcacgatacggatatccctctgagaaatctgtgttttaaatggtttcaattctaggtagaagcattgtaactataaaatagttttggaaacggcaactcaacgtagcaatttaagaaggacttgtaaggagaaactttttatttctgttgtaccatggagaaaaattttttgtatttatttgtaaaactatgcaacagagttcattcttacctttatactgcttctataccttgtatacatctatcattggatatagatgtatatactgaaagcatatttgtctgcatgtgtgactccactattaggctttaagctccttaagtccagggattgggccttcttgtctttgtgtcttcagagtttagcacaatgctcgaaagaaggtgttcaataaatatttgaactgaactaattgttacttatttagatcatacctggctctttgggggttgatgaaaatgcactatttttgcttttgaatgatgcttggattttatgtagcacatatcttaatccaaacaatccagaattgtctccttttcctaaaagcagcagtcccaggaacaaatctgaaaatccaatggtgcagctgttctatggtactttcctgactgaaggggttcgtgaaggtaaattctctgctctgaattttaattctagacctttgatcatatctttattactgtgtccctttgaggaggcagtatagtgaataggcttgagagtcagcagtactcagctctgaatattggttctgcctcttggtatctgtttaactgtggataaactatgggagcttctggatcctcagtctcttcatctgtaaaatgtgcacaatctttatctcagatttgtcatattaatacttgcacagcccaaatctgacattaatgtcagatagtgattttactcggttttctctgtgttgcttattctaatataatacttaatctcaaaaggttttattgagtgagactgccaaaaatgtttttctagactagaggcttttcactctggaggcttatctatctaagctacatgcaaggcacataatttatttttaattatgaagagtttagaatacattcaaatagagcaattttacaacctccatgaacccagccttagcccacagccagtcattccccatctcaccccactcttaccaatctgatactctttttaaaacataacccaataccaatatgactctgaaaaatagcattttaaactatcaaatatctagtcagtgttgagatttctaatttgtttt

SEQ ID NO: 67275 - DNA, 1175 bp, Homo sapiens
ttcagttgcattacagtcttacagttccttatatagctagggattatccagtaaatactttttctggtgttttgaattatccacgaaaagttatagcatcctccatatgctatattattctttaactattttcttttttgctgtgtggcacgctgcacaatataggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcaggtatgatatttttaagagataactgtgtcttttggaaataactttgtaatttattaaactgaaatgtagaaacatagctttcaaaggattaaaatagatatttaaaattaggggagtttttctggcattattgtgtatggatttagatgctttgatgtctaagttgggcagtactaaaaagaaatctgctgtggttgtaaatatattgaataggtgttttggataagcatttagtggatactatattatagcagtgagagtgaataaggaggaatcagttgttgaaggctatcatagctatccaggtaggcgacagtggtggcctggagtagagaagtggcagaagtcatggaaggagagaagtgaatgcattcttgaggcgctgaggagatcaaatctacaggattggtgggcagttggatccaggatatgcctgcagtagttgagtaagagtaagactatgaggtttctagttcgagtaaccaggtggattatagtaccatttgaccctggaggaggaataatttgggtgtgtgttaacagtgggtttcagttcaggtttttttgttttttgtttttttctttctgacacagtgtctcgctctgttgcccaggcaacagtggtgcgatctcagctcactgcaacctccgcctcccaggtttaagcaattctcctgcctctccagtagctgagactacaggcatgtaccaccaggcctggctaattttgtatttttagtcgagatggggtttcatcatgttggtcaggctggtctccaactcctgaccatgtgatctgcctgcctcggcctcccaaagtactgggattagaggcgtgagccaccgcgcc

SEQ ID NO: 67276 - DNA, 1050 bp, Homo sapiens
tgctgggattacaggcgtgtgagccactgcgcctgccctgcttggcatttttattgtagggctgacttcatttagaatgtctatgttaattgccagcccccttttttgacacatcgtgctttagactgttcagagaaatcatgagtagtagtatccgaagcaatgggaacaaatctccatcaagatttcacttttgtttgggtgttgtgggaagtcagagcatggaaactccctcctgtaatgaggcatttaatagacgcttcaagcacattagacctactgtccaccatagtctcataattctaccctagaattatgcctgaaagtactcagtgtgtcaccagggtaataaagttaatactcaaaactggttttaaattctatgattacttttgaaatttctattgtctttttctcccataggccagtaatggtgacattactcaggcagtcagccttctcactgatgagagagttaaggagcccagtcaagacactgttgctacagaaccatctgaagtagaggggagtgctgccaacaaggaagtattagcaagtaggtaccatatatcctgtcttggtcctttgctgaactagcagaaaataacaaaccaagtatatgtgagttccctgtcaatcacatcagccctttgaaaataatagtaataacagcttattactgagctattgctatgtggcaggcacaattctaagcacgtaaaaagttctggccgggtgcagtggctcatgcctgtaatcccagcactttgggaggccgaggcaggcggattacgaggtcaggagatcgagaccatcctggctaacacggtgaaaccccgtctctactaaaaatacaaaaaattagctgggtgtggtggtgggcacctgtagtcccagctgctcgggaggctgaggcaggagaatggcatgaacccgggaggcagagcttgcagtgaactgagatcgcaccactgctctccagcctgggcgacagagcaagactccgtctcttaaaaagaaaaaaaaagtttcatttgttcatttactcat

SEQ ID NO: 67277 - DNA, 1024 bp, Homo sapiens
ggcggaggttgcagtgagccgagatccggccactgcactccagcctgggcaagcctcaggcctgtttatccaagatgcttttagttattctttaaatgtacccaggtttactttctgactgacatgtttgtggtttttttgttttgcaaatatagagctgccaaatgctgttaaatcaactgagagaaatcacaggcattcaggacccttcctttctccatgaagctctgaaggttggtttccagatctctgttagtcaggaggctttaaagcagctgtctatattatagttatgtcagttcaagctatttctattcccaaattaaagcacatatagggacagaagctctacaggtcaaatgactgacccaatgtcttcaacatgtaaattataaggggctgggggagatttgtggttcgggtaaccctgcagggtataaaagagatttaagaaacatcaaccagttgcactgtttaggccttatatttcctgatccaaaccagcaaactaaataatatttgagtcagggaagtttgaactggttatctgatattgaaaaaacctgttgttattcttaaggtatgtatatatatatacttttttttttttttgagatggagtctcactctgatgcccaggctggagtgcagtagcacaatcttggctcactgcagcctctccctcccgcattcaagctgttctcccacctcagtcagcctcccaagtagctgggattacaggcatgcgccaccacacctggctaatttttgtatttttagtagagacggggtttcaccatattggccaggctggtcttgaactcctgacctcaagtgatccacccgacctggcctcccacagtgttgggattacaggcatgagccaccacgccgggccatgggttatatttttaaaagatatgttctgaaatgttgaccagtgataagatggttagggtttgattcagaatatctacgagagtataggaggtttagagaaaataagaaaggttatgactaagtg

SEQ ID NO: 67278 - DNA, 1004 bp, Homo sapiens
tgtagcctatgactatagtctgactacagcagaacgactgttggtgcttctttgaggactttatttatttatttattgagacggagttgtgctcttgttgcccaggctagagttgcaatgccgcgatcttggctcactgcaacctccacctcctgggttcaagcaattctcctgcctcagcctcctgagtagctgggattacaggcacgtgccaccacgcccaactgattttgtatttttagtagagacggggccatgttggtcaggctggtctcgaactcccaacctcaagtgatctgcccaccctggcctcccaaagtgctgggattacaggcatgagccaccatgcccgacctctttaggactttagagggatgtttcagttagttatttctagttgtgtaatactttagtgttgcattgggcccacagctgttgaagaacataagatactgtttctattatagctgggagtaaatgtaggctatctctctgagacatactactaacttaatttaagcataaccttaggaatggtataaattagatttcttgttgctgaattaatttcgaactactttgttttcaacattcatctaaaaagatcattgtgtctcaagttgggccagccagttgtttagattgagctgtacttgcaaatcggtgttttgtattgtctttgtgtaaaacaggataaaatgatagagtgaagatgttaaggctgaaggggttgtaaactgattttgtgttagctggaagttaacaatttaggtttttccatgatttaggttaatgaagagaaaacatttcatactttataccctttgaaattatgtatttaattgagaaaattctagctttagctgtactttttaattagtcaaacacagagttttaaatatgttggtgttatcattggttaattacatgattggaaacttattgtcagtgaaaaatgatacacactaatggcatgtgcaggaaagcttaaaatagcacatctt

SEQ ID NO: 67279 - DNA, 1149 bp, Homo sapiens
tgtgcatcagaatgatgaaaatagcatcactgtttgaaggaatggaataacctataaagcttctcatcacaatgctaaattaggagttttaacgattagtaatgaaatattttgcattatttcatcagagagttttaacctagttactgtgggatcaggccaggtattgattgttacagaaacttgatagcttaaggtttttagtgtctgaataatcttgttaattgctgattgtgggtgagttgtttttgctctaagaaaatctccttcctgagaagtgggctagattgcaccaaaaccactgagtagcagtgaggtcaaaaagcttgagttccttcctggtaaaggtttgtgtttgcctgtctttctttactgcctctgggcaagaaaagggagtactttttgttttgtgaaaacaatgtgaatttagctcaggaaatgcaaacctgttggctcttgcaagttatttgacttcattgtgagaggagtacaggctttgtcttgtctccttgttgggtgtgtactttacatatagcaaggtagagtgaagttaatatttaaatcctctttctgtgaagttcaggtgaagtgagttagtaatatggtaggatcctgatgggtttagtgttactgtaaaattaatatttatataaatatatatatatagtacgaggatttggagtgcgggttctgttaagaactttagctaaatctttacaagactgggtcatgtcatagcatttgtatatgtatataaataatgcatgtgaaatttgttattcataccatactctttacattttatttttatttttaaattatggaacacttcatgaatttgcatgttattcttgcacagggtccatgctaatctctgtattgttccaattttagttaatgtactgctcaagcaagcacttagacccttaatagctatgtgttttatagctatctttgatttagcttttaattcaagtcatttgatgataaatagattttgtaaaccttaatttcctaacgtgtgcaatgcctgcctttgttattaggattacatgcatgtaaggtgcctgtttcctgtcatatgttaagccaggtatggtgatgtgtgcctgtagtcccaacaacctggaaggctgtggtgggaggatc

SEQ ID NO: 67280 - DNA, 1059 bp, Homo sapiens
taaatgccttttcttccttcgtatatcttccctgctgaggagcctgcagtgattatccattgttcatcagatcaaacctaaactcttcctgacatttagaaccctttgtaatccaatcccacatcacctctctgatctctgttatttatttatttgagacagagtcttgctcttgtcgcccaggctggagtacagtggcgcagtctcagctcactgcaacctccgcctcctgggttcaagccattctcctgccttagcctcccaagtagctgggattacaggcacctgtcaccacacccagctaatttttgtatttttagtagagatggggtttcaccgtgttggccaggctggtcttgaactcctgacctcaggtgatccgcccgcctcagccccgtaaagtgctgggattacaggcgtgagccaccacacccagcaatctctgttatttattaaaaatagaaactacacacgaagacccagctagtaataacttaaaattttaccattgctatatttctaaaactgtaagcatgtaaatttgatttctcatatctttccctgatattttcccagtttttcaattagccctaccaatatgttgttaaaaattgtattttccttcatttttggagatgtgttcgatatgtttgtcagcctcatttctcatatttagttggaacatgtattcaaagaaatgaaaaatattgtcttaatgtattctaaaataaggaaaaagcaaggtataggacattatgtatcatatgaaaaaatatattcatgtgcatagacaatttcgggaaagataacagaaactgttaatggtagtagcccctgggaaatagaactaggtcgggaagaaggtgatttccttttcattttatacccttttgtactattggaatctcttagtacatgtgaagaaagagatggaaaaaatttaaaaagtaaataatgattaattccttttttttcttgtttttaagtcccagttttaacccctctacatgatataatagtggctaaattttaaacacttttaatggtttttaaaaactt

SEQ ID NO: 67281 - DNA, 2744 bp, Homo sapiens
tctggcttcagaggtcagttctatttgtttttagcacagtgatttaaaaacatgggaaaattttagtttggagactatcatattgatttagagaagagactattttaagggagagagaagtcatatttaaatttgtcgtggctcagtcatttaagaccatgtgcctattaatcagtggcatcttcatttacctctgccgcagtttgagtagtgaccctatttcagcattctccgtttgagactgtgtgtgagctacttgatgagcatttgtatgtaagtcatagctattttgggaaggcttggaactccagtggctgtggctggctggagtactccgattcctggccacctgcagagtgatgacatttactgttcttcccagtgatttgccctatacggaaagctgataagcttggaatgcttgataatgtttgccccttttatttttgctaataaaatgcttcaagttaccaggataggttgaaggaacttacaggaaaagtaccttttgatcttacaggaaagattttaataacttcttcctcatcttggtaagtttcatgttagaatggattcttttattttgaactctctgaggcattctacctttcccttaaaggatatttcattgttctagttgaggagagctatccttccctgacactcagaagctatttaaagcctagactgcttcccttcccttattggtcagttgtacacaggacagacaaaaccctttatggcctcccaagaattttagtgcgagaaatatgtagtactcttgaaatatgctatcagtatggactcgaatctgagagtagacactttatgatttcactaaatcctctagactgcaaactggtattcgaatatctaaagaggttacatagtgacagattcctgtattttaatcaattcttgacttcgatagcagcaaaatttactgttattacaggagaaacaacttgaagtcagtttggttcttataaacctgtcattcttggcagctgtactgagggttcacatcacacattctttatgtcagctgaagccttataaaaacctgccagtttcagtgaaaatttaatgccctttttgctttctcttgatttattgacctttcgtttccttttgtctcattaactgatttttaaaacatcagtaagtcagtgattggttccacaactctcatgcccctctgcccccaaatgcaaacagtatttttttttttttttgagacggagtctcgctctgttgcccaggctgaagtgcagtggcgcgatctctgctcactgcaagctccgccccccgggttcatgccattctccagcctcagcctcctgagtagctgggactacaggtgcccaccaccacgcccggctgatgtttctgtatttttagtagagacggggtttcacagtgttcgccaggatggtctcgatctcctgacctcatgatccgcccgcctcggtctgcaaacagtatttttaagacttactggcaaatagcatcttaccaggcgagatctctccatgtgttctgtttcatcaaagaaattaaatcaatagtaaaatgaagcaagtacttaacaaggaaaataatgctggtaatagtaatagctaatgctaattgagcatgcactatgtgccagactcggtgctcagaacttaacatagcattctctcagtacttacacaactccatgaagtttctatgagaaggcttatacttgttaagtaattcgtccaaggtcacccagtgaggatatggtacagttggaattgtatctaggcagttctgaccccaagagcccaaggcgcccctggtcctatctcatagttgatgggcccattgccctggatcacagactttccactactcttataatgccttttctagaactctcctaatgttttaaacttccagtcctccctacagtctttctaaatagataatcttcttttctacttgactgagctcgctgatgtctaaaaagagctccctgccttctgttttgtccccctctccctacgccatctcatctcttttctcttatttcagtggaaaaggttcccttcctttttccccctttcatttcttagagataaacctagattaatggtttttactagggagagattttgtaatctaggaagcatttggcaatgtctggagactttgattgtgactctggagggaggatgctactggaatgtagtgcgtagaagccgggaatgctgctaaacatcctgcagtgtacaggagtaagcccctctaaacagagttatgtgtaaattgtataaaatagtgctgagcttgacaaactctgatctagatgatgtctctcttctctttctattatgtcccttctccttagtcctagtctaacccccagacaccttcactgtcttctcccttgctactcacattatggtccacagaccagcagcattcacatcccctaggatttagacatgcagaaagttgagtgtgctagagccagcttgctctgcctctccagctgattttgtacatctctttccagctctgtgttcaatgacctcgtgttgataactgtgccaaggtgggaatatttataccaaggaaacaagcatacactgccaatcagcataccactgcctgtacccccactctagacctattcaatcagtttctgccttttgacaagattcttgggtgattcatttgcatattacattttgaatttgcattttccattttac

SEQ ID NO: 67282 - DNA, 1040 bp, Homo sapiens
gctacaaagcctgatgggaaatcctttattccacggtcattcggcagtttcccacggcgggggaacagttttaactcgcccgtggggagggtggagccggaggtcagtcctacaaatgaggttttgagggcagagagcggagaagactcaggaacgcggctcccaggattcgcaaacccagttcccggacactggcagcgcggcccgcagcctccaccggctgtgaagctgaccaacagcgacaggcggggccgggatcacgtgaccgacgtctggtcagccgggcgtgcgcgggagcacgcagaactgttcggccccgggccgcgcgccttgcgtgcgcgcgcatgccgggggcggggcatgtgggccaagcctccggcgcgcgctgcgggcgggggcgggacggagcggggtggagggcgggggcggggcctagtcctgagaggctgggccggcggcggctgcggcgggagaccggtgacccgcggctgggcgcctcggccatgactgcggagctgcagcaggacgacgcggccggcgcggcagacggccacggctcggtgggctccgcggcggcgagcgggagctgggggcgggctccaggccctgaggggagcgtgcggggcctgcagggctgcgggttgcgggctgcggagggcgccccggccgggcgggacagggggtgcgcccgccagcgtgggtgagaaggccaagggctctgcggggctcgggccgcggagattgaggactgcatcttcgcgtccgtgggcgagctgaagttgtagggggatttccagattttggaaaaccaaatataaagggctggacgtggggttctccgccgcagggatcagtaaggtgagccctcctgggccccgtccggggtgagaaacttccgaaagcggcagcgttggttggttttgttttgctttgacttttaaatcagttttatggcggcgtttttaaaaggttaaagcagaccgaagttatctcacttaaagtccggaattaatcaccgtcttctataagaccaggggtcc

SEQ ID NO: 67283 - DNA, 1047 bp, Homo sapiens
aacaatactaaggctcagatgtcaagtctcttttctagggtcacatagatagtaagaggcagagctggattcaaatttaggtccttaccccctggtactttgctgcctcttggagtcacttagacttgaagaggatcatgtctatggaacagagcgttttgaagattgcttataggaagtggagtaaataacaggggggataagtagcgagtttgttttttttttccttgcttctgtcataaaccacgtgcccatcattttatcctctagtttctgggtcagatgaatggagtcaagaaatccagctttctgttgtcattgacgacagcatttggctgcataccctgtggtctgctgttttgctgatcttgggtggattctccacttcctcccccttcacccccattcccctgttgctcgttcaggtacgggggatgtgagtgagaggggttggggtggggatatctggaagttgatctcatcacccctagccggaatctgctctgaccctgcctcctcgacagctcagaggcttaacttgtggaaagtgtggcagagctaaacgtagccgactttttccagtgggtgcgaaaaataaccgccactaaggtgtgtcttcttgatgcttgtaccgctcagaaatagactgaggttgtgtttgtttttgctcaaactttcctaaagaggaaacccgctccccaaagttgaccagatagatgtatcatctttccggatgtgaattatttcggctgtgtgctatgagaactgggtatggtgggaagtaattgtttttctggctctcatcaggtcctggttcctggttgcttttctttacccgagagggccacaaaagataccactctcctgagacttccaagttccccttcagcaagaccctcattcctctggggagagagggagagttggccatgttatattcgaaagagcctgggtattggaattggccatatttagtggtgagagcctgtgatacttatttaacctttctgggccttgtttcactcactacatttttttttttttttt

SEQ ID NO: 67284 - DNA, 1036 bp, Homo sapiens
gcccaagactttgtctcattaaaaaaaaaaaaagaagaagaagaagaaggaggcaccctggatgaagactcaggctccagaatttactatctgtatgtcttgggcaagtggcttagcttctctgagcccctgtttacttttcttttgaaaatgaccaccttgtccatggtaatgaggataaaaaacgtgtaaagtgcatagcagagtgcaggtgtactgggtagacatgtatgattgcgctgtagccctgttatggcccggggagaaactatgaaaggaaccagtgaaatcttttgttttgggcactgctaaattgatgatagtactaaccctgtgctagcagccagctggtgaaataataggtgaataatgttagtacattgtgaatataaaagtttccatttgcaaagtgctactgctgttctaaagaagccacatttctaataaatgattgcttaatcctgtgatgctgccacagccccacagagtttgggaatgtttgggaattctttctgaagtgtgtgccgcattcttttgctttgccttttgggagggtagatgtgactattggaaatggtcaaaataatgcagtagcaaatctgttgactatagtgagtgataagcactgtcggctgctgtgtctgactcggaaggcagattctggaaggggtgtgtggggaaggcttgttggctcagcactggggtgagtgttggcctcacttcttaggtgggaagtggacaaggccaaggggcttttgatttccagctactatggctggactcccagtgaggaaggagtcgctgccatggattgcctgggactgggaagactccttttaactgctgtaatgtttctgcatttgtggtttggcctcctgtgagtttgggctccggggcggcacttctgttgttaaaagaacagaaaagaaaacaaaacaaaacaaaaaaccaggactgtcactgttagatgttggttgaggctagaaagaatggattgagttttgaccccctacaccccggggagtagggaggcctg

SEQ ID NO: 67285 - DNA, 1093 bp, Homo sapiens
gggatctggcattgaagcatctgttgatccactgtctcttcgccactccttgtcgtaacacgagaagtgattcctagctctgaggtgtccatgcagagaccacagacacatgcagtgactcaaattggttctgagatgggccagtgtaaggtttcccattaggtagatttcccacagcttggcttaacgtcctggtggcttataagtgagcatgcctagaactgcttgtccctatttttgactcggctgcatacgattagggtttgagtattcatgtggcctgctcctattctgggagtgtcattcatttttggagccagaggatgtttaataagcacgaattgtgtgtcaggctctgtgcacttaacagtgaagactgctacaacatccctgccctcaaggagcttaagtctagagtgggagatgagtatgactatgcaatcatcatacaagatggtaatgtgtgcaaagtgctaagaaatctaggagaaattcagagtaggagagtgttttgtgccagagggtaacagaacagcattttgaaaggactcggtgaggggaagccgaagccacctatggaagtgggtggtgtaacctgcgagtgtaggctgggcctgcagggagagagcagagtgcagggtttagaagagatggacgagatacatctgtggaaggaatagcaaaatgatctgcattctccctgaagcactggagagccactgaaggactgagtaagagggtgacatatttttgtgtctggaatagaagggactgttgggcttttttttatgtagactaggctagaatataaggtgaataaagcctgttggagaacttgaagactggccgtctgtgttggggtgtggctggagtgttgagaggcctgtgccttctgtgctggttagggccctgtggccccattctgccaggtgggaggccccatccttccactcctctcttgcccttgtcaggcactgtaggccctggctgttgagaagcatccctgagatgaggctcttccccagagttagagccatggggaaagaatgaaggctttcgttgatagattttctgatttcagcagcagcatgga

SEQ ID NO: 67286 - DNA, 1036 bp, Homo sapiens
agagctcgggaacgacgtcgattttgcccatcactggggccacatactgggtgctcagtgttgcatagcctgggcccactctggatttgcccctgagcatggggatttggaggtgtgagtcccgacactggctctcactccagatgggtaaagaatgcaccttgtattcccacctttctgaggcaccccctctcctgtctcccacaggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggtaggtcagtccagctgatgggtggatctgggtctctgggagccagcgtctatatttacctccaaggacgtaaagtggaggtggtgggctgagtcagccttcagtccttctgctcaaggcttggacgtgcagaggctgcccgtcgtgcaggtaaatgtggacagttctcccagtcccctcctgtggaccgtcggttcaaagtctttccgtgttcaacacaggatgctcattaaaaaggcaggctcttgggtcccactctcagaaccttttattccatgggtccagggtggggtcccagattcagcattattaatatgtattcccaagggattctcatgtaggtagacccaaaatgaattttgagaaaaactgacctgctgggtctcttaacattgtctgccctgcctcccaccactcttgatgccccgccgctctatccatacacatttctgaagtcagcttcgggcttctgagggcaagttgaagcagtgatcctactttccccacagtaacaaaggcctgtacttggaccttaaccctgtttagggaagacaaggagggcatttaaacgatgagcaatgaaatatcactgctcagccagttccaggtgatgggacaagggagggggtacaaggtaaggaggctgggccaggtgctg

SEQ ID NO: 67287 - DNA, 1024 bp, Homo sapiens
tgggagttttgctctgttgcccaggccggtgagagcctattttcatatgcattttaacctgtatacccctgacttagaattttatattggctatagccttcaaagtggggctatattcttcaatataaaaataatttcatacaccttttttttctgttgactatgtgattctacagaatgaaattgatattaactagaaacaattgcagctatgacaatttggacaatatctaaagttatttagtaaataaggaaattcccagggtttgtagaatctcagggaaactttgtaataagtaaataaatcttcagtcactgttagacaacacaccttgccaaagtccaaatcatctgtcaagaaggcctttgaaactttgttctcactttctgtatccaccaccggcctttccatctcattcaaaaataaacccttacaatctagcaggatagtaaaagcattacttatctcacacctgaaatgtcagcttggaacaactagctcttgagacactgtcccctcccaatcactctgttggacattgcatttttggcagtaaatttctgcattcttatccttatccttgtgctagatcctgtggctttaattattttaagaatgataatgatcctatgcaactcatgtctttcctgcatcttcaagtagctttatcaacctacaacctatttccttcaagatgatttcttctttatctgaagttttttcttgtgctaaaggctgccaaagacgtatgtactgtctcctgttcttctacctctgcatttaaataccactcattttaaattagctggccatagtggtgcacacccgtattcccagctactggggaggctgaggagagaggatcacttgagcttgggagatcgaggctgcagtgagctgtggtcacattccagactggctggcagagtgacactctgtctcaaaaataataaaaaataataataaaaataaataaccctcatttttacaactatccaaaaaagttttaagaaagtcaaacac

SEQ ID NO: 67288 - DNA, 1022 bp, Homo sapiens
gtccttgggaacacagtgtgtgtgtagggtcttcgttgagcagtgctttttcttatccttcctgttgtcatcttccccttaggataatttgtctttggtttatctgactgggaacttaatattttaatttatttgtgtctgttttcccctaaagtttgcttatcaaattgcagcattattaaaatatgtaaaataaaatggttaagtactccgtagaaaaacagcattttagtgttgctgtattaaaaagtgtgaaaaattctgagtatcctattccccccatccctatcccctaataactggtattgtttgattaatcaatacaaaagtccgtttttagttaaagaaaatcattctcttgttcttgataaatgttcattttcatggagtggcaaaataatggcgattggtcactatgttaagccatacagtgctgtgaattgcaaaagtgattgtgtttccagttccttatgggcccccttccccaaataaatctaatgttcagtcataactaggatgtttactgtagccaaaatggaaatccgtgcatcattttcaaaagaagtttctgattacgtttctgttgtttttaaactttgtcatatcttatttgtaaaatttgagtattttcccttagttgctttatttaaattctaaacacctttttgtttgtaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggtaactgcccaatgaggttcggggggcattgtttcctgctgtttttaaatttattattcagttttaaagaacctcttatttgtagatgaaacttctttcttaagcattgtgaatagtaaactttatatagcaaactttatatatccctgaaaacgggtaacattgacacatggattttgaaatt

SEQ ID NO: 67289 - DNA, 1802 bp, Homo sapiens
tgtttcattttaggaagtagtcatgccccacaagatgtcagtttgtcatatccccaacatcatgttggaaattcaagccctacctccacatctcctagcaggtaatatttctcacttattgttaagatcatttatcaggaattcttatagggaatagcctcaaaacacatgagtaaatagtctccttcattattctcttatctcttcattctgccgttattacttgccttttggggttgttgttatgtatctattctaaggggtatagaatgtgtctattctatagacaaacacattgtatatagtccccttagaatagatacgtatataactatttgttgatttgtagcgacataaccatacccacatatgtgtacagtacatgtatacacttgaaacaaaatttctcaaaacattatttaccctcactacttggattactatttcatttaaaacattttaaaatttattttacagtcattaattggttgttacttacagttgaaaaataccagttagtcaacagtctattggactaagaattcctagaattggattctaggtctgcatctatcaattgtgtaatcttgagctagtctcctttctttagtcccgtcttcccatgtgtaaggaaaataagttgaattaaatgatttgtaaaatctcttcaggtactgagtattagaaaatatcatatttacttaaatgattttatttgctttggggaggttcatattttaccagggacaatttttcccggtatatccataaagctatttaacagtcatttaagaaagatttaataaatacctgccatatgtcaggttcttcaccatatcttttacatatatgatttcatttattcctcacagcagttttatgagggtagggattatttttatctctacctcttatatgaagggaaatgaaaaatggaggttaacttgctcaggttcagtgggctgggattcaaacccaggcagtgtagtgtgattgagcccagccactatgatgtattatctagaggagcttaaagtctaaatgaagacacatattatatatatttttgtgaatacctgttcaattactgtaataagttctctaaagaaagagtacaaagggctttgagaaaattttaagagaaggagatgatatagatgaatgtggaactgaaagaagccagtgtacctagatcataatgaatgaaaatggagagcagtaggggattttggtagataggctggagagggtcttttaaactataatcaggattttgagattttaccctaaaatggagtaggaaggcagtgaaatgttttaggtagggtactgataggaacaagtttatattttaagagttgtttggttgcagtgggagaatggattggagggggcaagagtgaaaatagagcagtgaggaagcttttggtagcaaggcattgatgttggaagctattgatggatgaggttgatagtttagattaaggtggtgccatgagctggagagaagtggatggatatgaagagatactagaaagtggaatagtgagccagcaatagtgcaaaaagtgtaccctcccggtgttctttcttgccagctgaaattaattaacagtgtttaaacatttcttggtaaagttggcatttaaagcacttccagcccctttaatggagtcttcaaaggcatcctaggtagaggaaaataaaaagttttccctcttagaatttcttggggagaaaaaaccaggtgcagtgacccattcgtatagtcccagctacttggaaggctgtggtgggaggac

SEQ ID NO: 67290 - DNA, 2040 bp, Homo sapiens
ttcaggatgctcaaaattaaagaactgatattctaaacagcaggcaatcagtgaataaaagtatgttaattctttgtgtacaatgtctctgaagtcagtgacataaaaaaaaaaaaataacacacacccttccttttatattttcagtatattaaaaaggaacagtacaaatgctgtggtattaaaaaggatccttatttttcaacaaatgaacttttataaacaattctgtaatgaaatgaaaacagtatcttaatacaagcttttgttaaacaagattttaaaattttaaaattagaaaacgttaagattaaactctttcaaaggttcaaacaaaaaaacaacctgtacaatctccattacatgtgtctttgtacacagtctgggcactttgaaaatgttaaagtttttaacgtttgactgacagaagcagcacttaaaggcttcatgaatctattttccaaaaaagtatgctttcagtaaaacattttaccattttatctaactatgcactgacatttttgttcttcctgaaaaggggatttatgctaacactgtatttttaatgtaaaaatatacgtgtagagatattttaacttcctgagtgacttatacctcaaatgggatttaatgaacaatttctaaattttagaatgaaacagtatgtgtaaatctacacatgtatgttcaactagggtaaagctcaagagcatgtcacagaatttatacctaaattatataagaagttaagcaatgcctttatccccaaactttaccaataagccttctcaaatagaatgttagtaaagtgaatcactgaaaagtttcatttttgaattaactaaaataccagtagccattttagactgtcaacctggatgttttcttgattcactagcaagaaatttcttgcaatacaaaaagataacaaataattaaaatatctgctttatcatacaacttcaccccctcctaaagtgtctaaaatgattaggaattgtagcactttcttttgcataaaaccctttcctcttcataaaaccctgaggtgaaaggttattaatgtaataaaaccgcaattcattttgtattaaactgtagctttaaaaaaatttataaagaaatgtgacaacttgtaaagctgctctgtacagtttttcaacaaaatatttccatatcaacttagtcaaagggcctaaaatgaccctataaaaacaatgtccttttaacatgtgttagtgtcgagatgagcgccattttccatctctactactgtctcttctgttatcatagtcatggctccagtcatcatgattcctgtcttcatagaagaaatcatctctctttcctctgtaatgatggtcagacccatgatcagtgtaacgctgttcccggctataatgtctatctgctaggtagggataagaattcattctgactttacgctgtgatgatggtgtaccttggcgccactgggagcttgaagactgattgaaactatgactgtgtgattgaactgatggtgaaaatcctgattgatccagaggtgaagaaccaaattttccaccatatgacatttgtctcaaagcactgttcatctgaggaataggaaaagtggaaatgttaatacttctagatatcaaagctaatatgtatttggtcagttaacagaaaatgaaagaaaataaagtcactcttgcctagatggatccacaactaaagcagtacaatagcttcaatcattccaatgtatacctacaagatacatatatatacataaatactactctttgtcctcaagaatgcaactcagaataagtcacacaaaatgactataatgcaaaatcactgtgtaaaaaacaaagaatcaggagatcagtatcattaggaaaggtttcatgaaggtggcatatgatctgggtattaaaacaatggatggaatattttcatattttaagggagagatatgccaagaaaaggaaattgcacaaacaaaaataacagggaaacacagaacaggttcatagaataccaagtaat

SEQ ID NO: 67291 - DNA, 2077 bp, Homo sapiens
tatgtatatatatgtatcttgtaggtatacattggaatgattgaagctattgtactgctttagttgtggatccatctaggcaagagtgactttattttctttcattttctgttaactgaccaaatacatattagctttgatatctagaagtattaacatttccacttttcctattcctcagatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtag

SEQ ID NO: 67292 - DNA, 1101 bp, Homo sapiens
ctctatgagactgctctcaattcagacatcagccacatgctcagggattcccaggccacccacacttctggccaactggctacaaattcaacagtttccactactttcttaggtttaataacttgctagaaagactcacagaactttggaaaaagctatacttaagattacagatttattaaagcaaaagaaaacacatcaaaaccagccaaaaggggagatgcatagagtgagacccaggcgggtcctgaaggtgaaacttctgtgttcactccctgtcactgtgtattatcagcctggaaccttatccaagctttaatagccagagtttttactggagtttcattacatacgcatcattgaatccttggccatgtgattgaactcagtctctggtcccctccaatcccaatcaatatcagactgataccacatggcataaagccccaaccctataatcatgtggttgacttttctagcatggcctggcctcatcctgaaatatctagggaccctgtagaggtcatctttgtagcataaatgatcagggctcaccaggaataataaagacactcctgtcacttgggaaattccaagaatatagaggttgtctcccaggaaccaggaacagaggccagtcaaatcctggcctttgttggcactggtgtacaacaccaactctaaatggaaactagacagagaaaggaattccgggaaccatagttccacctcagctaagtagacacagtacaaagccactacaacagtatttattatatctgtctcccctacactccaccaagaaaataccttcagcaaactctattagtccattctcatgctgctatgaagagatacgtgagacctaagactgggtaatttataaaggaaagaggtttaattgattcacagtttagcatagctggggaggcctcaggaaacttacaatcatggtagaaggggaagcaaatacattcttcttcacaaggcagcaggagagagaagaatgagagctgagcaaagggagaagcttataaaaccatcagatcatgtgagaactcactatcacaagaacactagcatggggataaccacccccat

SEQ ID NO: 67293 - DNA, 2031 bp, Homo sapiens
aaagatatacatgaaaaaaatgtcatacagagataatcagctcttttccaaccaaccaaagtaagagttcttttttaactgcgcggttacaactaaccaaaactcaggaaataactcctggaagcaaacaaacttagcagtgaaaaacaagcgcgtccagtaacaccagaaaaacacgtggcgggggtggggcatctggtcgcaaccgcaggtgagactctaagtcccatcattcccttcggcagccaagccaggctgttgagggcgagccggcgcaccgtacgctgggacgtgtggtttcagctcgtgcgcctccccgtgggtttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggaggtgagtgaggtcggcggggggcttggggaggcgagtgaggtttcgctcgtggaaccgaggagtcgagcccgtcctgggagagcgttgggggtctgggtctcaggtgtggcaggtgagcgcggccggccacgggcggtgcagggcaagtccggaggcaggagtcctgcgggtgttgggcgccgtgctgcgctgtagggcttctttccacaagggaggagtcctccgtgtggcttcttctcctccctacccctccgcccagatgtggacttttcctaacgctctggcgtctctgggcttgggtcactggagtgggggcgggggcagcggctctgttcccagcttcccccaactaaatccttaaaggaccctaggttgttagggccagacgggactccggagatgactcagccttacccctcattccataagtgagaacattgaggcccacagaaaggattcaactcattcaaggtcgtgctgttagtgagagtctgagttgagaccagaacccagttcctatcccttcaggctttccatgcccgaaacaagggctcctcccaccgttgagcctcagtttatatgaagtgaggataataacagtagtttttccattagattgtgaaggtccagtggtgtaattaatgtgaaaactttgtaaactctgcagagacgtggtggtggtagttatccaactcttccaaaactgagtgatgtcagcactcagttttacttactttgcatctgtcccggagtagaatctcagtgcttgacaaatagcaggcccttggtaaatgtttgttgaataaacgaggactcgtgtttagtaccttcagtagttgcccgaggagcattctttctcttctgtttcggctatggattacaagctgactatgtttgagggaattcctgttaaataaacttgggtaaaagaggccagaatgatggctttgtgtgtgttatatatttatttttaattgcagatgacaggattggacattgagaaggaccagattattgagatggcctgtctgataactgactctgatctcaacattttggctgaagtacgtgatgccatgtaatacagtcatactttttaaagggcactggaaatataaccatcattttttccagcttctttatttaaaaaataagaaagttgaggtctatatgggttaaggtaatgtgctaggtcatggtaggggtggtactagaaccaaagtaatccatctcacagcctagtgaaaattaaaaattaaacattattttttaattaaccatgccagaaatttacagaaacataaattctgtcgtttactgagcgcttactgtatgccagctacagtttctgtgtgctttatatgtctttgttcttagttctcacagcaactataagttagttattgttataatgctcatttgatggatgaggacacttgagcatagagatgttgggtaatttgtctgaggtcccagtggctgtt

SEQ ID NO: 67294 - DNA, 1074 bp, Homo sapiens
gctttccctctgaaagtaaggttattcctgttgtttcttggtgactgatggcgtttcccatccacagggtcctaacctgattataaaacaaccagatgagttgctggacagcatgtcagattggtgtaaggagcatcacgggaaggtaacattaccaaataacaggattgctgctttggggatcagtagcaagctttttgctcccacacctgaatccgataccattgttggatggtattttaaaaaggcttagagaagattgcatggcaagcctgggaaactgcttgcttgtttacttttcatctttgggacctctcgagatcatcttctcctgaatgtcctcttttttttctctcctacattcagtctgtcgcgaacgcattgtggattgtcaagtattactcaagtcagtcttttggataaggttagacatcaactttcagagaagggggattgctgctctcctgttaatagttgtttcttcccagaggttaatatccttggactttgaacaccgtcttttttgactgtggacatgctattaacagtcaggatcataactaagttggcttggattcttgaagaaaaaaaaatggtgcaaagatggcagttgcaatttgaacttgagctctaaaaatggtctatttgtggttatatttgcccattttaaaagtgaaatttcatttctggatgcctttgaaaactgactttacatgtgtttttggtggggggctggggattctctcttgcagtctggccttaccaaggcagtgaaggagagtacaattacattgcagcaggcagagtatgaatttctgtcctttgtacgacagcagactcctccagggctctgtccacttgcaggtaaaatccaatcctgtgtatatcttatagtcttccatatgtagtggttcaagagactgcagttccagaaagactagccgagcccatccatgtcttccacttaaccctgctttgggttacacatcttaacttttctgttcaagtttctctgtgtagtttatagcatgagtattgggaaaatgccctgaaacctgacatgagatctgggaa

SEQ ID NO: 67295 - DNA, 1446 bp, Homo sapiens
cctattatttttcccctgtgtcattgactttctaaagagaccaggcctgttctaccaggatttttaaaagggtgacattgccagagggaagttaatgtttctctgaaggtatatgtacgtttgtatatgtaagtcgatgtggtagctaatactgttcttaaacatttataaaaataagttttggcattaagtactagagcatatattgtgtaaatgtttccgccagccaatgtggctgatatctgttttaaaggtctcatttaaaatttagtgtttttagtataagttactttttggggacataaatatgcatatgatttgtttaaaaatttggattgtaaataaaggtttatctacctatgtgattcagttaaatttttagtgttagtggtgtgaattttgtgacactgggagaaagtttgcatatcaggtatgaccttagaaagtaacaaatagatttgtgcattacatcaagcatgtggaatgatagatttgtccttctgttcatgagaggtcatttacaaatttataaggagctaaactgactaagtacttggaaatctgtacttgtaagctaatcacatttacccaaacctgatttagaaatatagaggtgcttttaggaattgtttgaattttaaaaaatcatctccatttcaaatacaacttatgaattttgatatcctgttgtataatactagaaatatagagatgcagtatgcttcgtgtctttctaggaaattcagttcatgaagataagaagtttcttgacaaatacatgccccagttcatgaaacatcttcattatagaataattgatgtgagcactgttaaagaactgtgcaggtaagggctatatttaggatccattaaattacctcatttagcatgttttaattgagaatttgtggaaagtaattggatagagctgtagaactaaggctaccaagtgggttcatatcttcctcatcccattcttgcttgtataggaccttaacttaccctggactggtgagaattgggagcaacaacgtcagacatgttcccagtaaataagccaatgcctggcacaaaataagtgctcaatacattttctggattaactaatattatgtggaagtcttgtgactgggaacatatagatgaaaagctcttaagtactttagaaaatagtggatcgacatatgtgtaaaaaaacgcaccctgaaaatatactctatgatgactcctatagtgaaaatgtgcgtatggactagtgaggtcacaagggaagcagcatctaactgtgctggagcaagaggaatggggagtcagagaaacctttacatagcaaggaaatagctttgaaattgagatgtgaagaagagtggaagtcttgcaggcattttattgaggagagagcattcagagagagcagacagaagtataagaatgtgagggagcagg

SEQ ID NO: 67296 - DNA, 1035 bp, Homo sapiens
aatcttacacactgatgagcttgctcatagaaaatatatagaagaaagagaggagagggtagaagatagaggccccggcaaagaagcaacttgagaatcatgactcaaatgccattttcaatgttaatggattacttgaaggaggtaattgttcagtatatttgagacagcttcctttgagagttccatttctgctgtgtatagacgctggtatccagaagaatatgaatttgcaccaaagaaggctgcttctcataggtaagtttgagttctaccaagcgttttccagtctgacacacacttaactcccaaattcctgactgcttgaaataatgtcccttaactcttttttctcggggaaaagataaagttcaactagcataaacataacattcttttactgttaggaattctggtcaggattccagtgttccattctgagagggttatatagcctttattgctgtttcaaaactcttagatagcttggtttataggaatgatgaaacaatctgtaatctttctagtaatgaaccgtgttaactttcttcccacagaagatatggacttgcagccttttgaaattagaacactttttgtgtgcaattctataatacagttgcctactttgacacttgttatagtttttctgattgtttctcttatgtctgtagccttaggtacaagtagacaaggaatttaaagatcttgtatattcatgtgtcctgtactggttcttttctttttgattttgtagtctttcaggagaaacatgaaacctgatgggaggtttagcagctggcttctaagggtagcatttattaaaccatttactgaacccctatgatgtaccttgcacagttataggcaaatagagaaagaccaatccctaaagagtctggcattcttacattattttattgagtgtatgtagactgtagcacaggcatacaggcctagactaccttatctgacacaactggggtatgttttgatttcagaatttttcagattttagaaaggtgttactacatc

SEQ ID NO: 67297 - DNA, 1307 bp, Homo sapiens
aaactgtgttccatgaactgtttataagtattctacaaatgtggtcgattaagttttagaaatactaaaatttattaattttagaaaattaataaattagaaatataggacagcttccttttgggaattcataatacacattagtatattaaatgctttgcaactttttatttcagtaaaaagtttactctagtttttctaaacttatttgaccgtggaattattttttctccctgtggaacatgtcgccatcttttggaacaatttgggaaactttaatcttctatattttacaaatttttttgtcaaaagtttttaaaaaacaaagcatttaaagaaaattgcttttctgaaatgttctacttttgatgatgctagacagtgacacttacagtaacatccattgttcttaagtcgttttttaaaagttgtacttttaaaatgattttcatctcctggttttggacagttcattcattgtggtatgtttgcttatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaacctttttgtaccatctattctttagtagtttaattattgggaaaagatggctttttcttttttaagtgatatggctaatgtttaaactcttgtaatgcaattaggaatcggttaataagttcatgtcaaacaggaagtgaatatgttttgctttagaataaccgcagataagtttaaagaagcagatttgggctcgttgttagagttattgaattaacagcactggactaggctactctgctacattcaggaaattcaattcagacggattctgtaactaaggtttattgcaagtaataattagggcttatttatatgcacagcagtgactgcttggtttacagaatgtaaatagcttgctgccctagttctaat

SEQ ID NO: 67298 - DNA, 1125 bp, Homo sapiens
aactcttaattcaagttcaggcccctgacatactgagtgactttggcaagttgcttttctaagtctcagtttccatatctgtaaaatgaggttaataacgttacttaatgaattgttagaattaatttaaatgctattcatacagttctgagctcagcacagtgagcatcgtgtaatgatagctaatgaatattgataataaagggtactatgattagttatgaggctggaggcattatcttaaatcagcgttcacttaatgcctatgactgcctacattgtgctgaggactgtagtaaacttcactaatagtgtgaccttgacttggtttagtgtttccaactaaatttggcaaaagggtctttgcccttacttggctttcaggaatgttaaattctaatgtgatgatagataagaaaacactgggcttaagaagggttcgtaggaaccagatactgctattaatgaatgcctcaaggtttcttccacacaactggctggtttattcacctgtttaactgttcaagccagtttaaaaatttttaactcctggtgttactgctttaatgctgtcttctgtatcttaattgtgtagctaattctattgtcctttagtggagcttgtgttgaattttaataaaataactggtagcctgtgagttaagcaaaaccagtctagtgcaggtatatatgaagacatgctggttcagtgattagttcattatttttaagtatttttaagttaaatttaaatttgtagtgctggtatttaggatttcacaggggattcctgaagctatgaagtaatttctgtgaaatgaactgcagtgcaaattggtttaaatagaactacagcttgaaaaatgatcagtatatttgcttagtagagcttgccattctagtgctcttggggggcctctcatttgctggttcgttcggtgcagtaattgtcctgcaagctatgttcttaggatcgtccaggtgtatttccccctattaaactcaaggtgaatgaatcagtacagatgcattttgacttacagtggggttacatcccaacaaacccattgtaagttgaaactattaagtaaaaaatgcatttaataaatttagcctaccaaacat

SEQ ID NO: 67299 - DNA, 1026 bp, Homo sapiens
gttttgcaagttgttaaatgaaagcacttcagaaatattgaaaaaagccttgtagaatctagtttaataagatgatacagtctgttaatgatcagagcataaatgaagatgtcttgttcacgtgtttcacactactgctgactttatacagtctttataggaatgctgcagattctttggttatttgacctttggttttccacttttgatgttctgaagtggttaattgtgacctttagccatgaagcctgatgttcaaacattgcttttctgaggatggatggggagaagggacaggtatgagttttaaaattattttagagtttcagatattatctgaaaattttataaataattttatttgaattaaatcctaaatctagtttaggtttgaataatataggtatgtgtttcctgtggttaataccagtttttgagaaaagcatgacatatgcttttatacactgagttactgaaagacccttggaaatgggatgttatagacaattgatttttaaaaagttctaaagttatatgggagaatggtccatgctttggaaatttcttctttgaaaatatatagcttaaactacttaaataggatagcacacacccaaatttctgcagaattaaattagatattatttgatagaaaatttatgattaggaattcattgttttacttaattcatatttattgaggattttagttagtgttgagtattgttgtaaaacttagggatctagcaaggacttagacatatccctgccctcacagagtttatgttctaatgagcaagctagacaatacataagtaaataaagaattgtgatattaaacagaaagatgttgtggtaaagacaaatgatggcgggtgctgaggaggagaaaggctactttaaaatggatggttagtgcaggtgccttgattaggtgacagtgtagtccaggaacatgggaagaaggctgtaggaggcgcagagaacaatggccttgtggtagcaaataacttagtgtattcttgg

SEQ ID NO: 67300 - DNA, 1056 bp, Homo sapiens
gcactgtatgcattacctcattttactaggtagaaactcttttcatcttcagttgacagatgagaaaactgagggatggaatggttatgtaacttgttcaaagtcacccagataggaggtagagaagtcaggttttgaacccaggttgtctggttctagaatcatacccttaatcattttgctggttctagaagctggacaatttaatatcttacattatctttggttccatcaatagtttttggagcctactgggtacatactgaagtgtgaattctgcagagatagggatgtaataaacctttttctacactgctttccttccagttagatagctgtattgtttttttaaaggaaggataacaatgccttgtgaaaaattttggtgtgttgtgattgaagaatatgaaaaaaagaggaatttcccatattcccttctcccctttgaaatggaaaagaagtttctgaaaggggtaagaattatagcttagactgaggcatactgttgatactggctttgaagtattccatccactggcggatcgtggaatctcccattaggtatatgagttttcctctcaggcattccttcattttgactgtagccaaactacaggagacaggattccatgtgtttctccagacatgcccactggggattgtggatgtcattccaaacttgcatttctctttcattgcaactgtttcttctgccaaagaatcaatgagataggatcttccaaaacatcaaattacccgtcagtatgtattaagagccttctatcctctaagtatcctaagagggggtaaggtggtggtaatggtggaaaaagtattactgaagtattctcttaatggaacagctgtttttttaataaaaatttttctctgatgtgaatttcctaaataatgttcattaatgttcgttataagagtatatgtttcttcccagaaaaaaaatggctttctggaggaaaatttaagtattttccagcttttctatgaaactaaagtcatcaattcttgcataggaatggaagctcaattatcctatca

SEQ ID NO: 67301 - DNA, 1118 bp, Homo sapiens
atatacatatatatacacacacacacacacgtacatatatttgtcattttctcttgatgaattgatctctttattattacataatgaccttctttttctctttttacagtttttgacttaaatccaatttatctgatataagcatagtgactcctgctctcttttggtttccatttgcatggaatatctttttccattacttcactttcagtctatgtgtgtccttaaagctgaagtgaatctcttgcagaaggatagagttaggtcttgtttttttaaaatctactcaaccattctgtctttggggtagggagtaatgaaatataccattttattacagagtctcacaaaaataaaaatagtatctcaaaactcccccaattctgcaggtggaggatggcaggagactagactaccatcctccacctgcagaactgggggaagacagatggcaggcagtgtgagttttttggctcacttgaggccagtgagaaggtatgagaatggaaccaatctaaaaatggctgatgttacttaggagctgaaaagaacagggcaaccttgaagacccagacaccccttttagaaggtgcaataaaggcacctttccaaagctactaagcaggcacttggcatttcaggattttgtcttctgtttgcacaaaagtattcccttcacccagacctggcgccttttatgcttcagagttaagacctgcagagggataggtggcaaggcatttcctagaagagatcacccagcacagctgccctgggctcagggtcttaatttctgtctagtccctggaactatttatatttaataaattttatatgaatacctggagaaatagaagacataaaatctgagggtttgggagagaaagattggggactaggcaggaagccagagcaggggaggttccctcaggccagcttgacctgctccttgacctctttggctcctggcttctcctccttcatttttctcctcttctgtgacatttcttcatctctgagtctctctttttcatcctgttttaatcctcttggcttttttgaagatgggagagatcttgcagccacgctctccctcctcatcagagtcgaagaactct

SEQ ID NO: 67302 - DNA, 1109 bp, Homo sapiens
ttaatatctgcccagataataaagtaggaatcactggtttagatggattaaacctctcttctccaaatgcctttccccccttattttgatatatttaagatatcctggggaagttaatgggtcaggattctggaaagctgttcctctcctaatggcagggaatctagagatccagagaaagtcattcaccctccatacgcaatccatcaaatctatctaacatctatctatctatctgtctgtctgtctatctatctatctatcatctatctatctatctatctatctatctatctatctatctatctatgcttattttaattttaccttctaaatggctctctaccacaaactaccctctccacatttccacctgtagtaattcaggccctcatcaaccctttccaaggctagtgtttctcaaacttgagcgtgcatcagaattacctgcagtactttattacaactccaattgctgagcctcacacccagaatttctgattcaacagttatggggtaaattctcaagaatttggatttctataataacaagctcttgggctaacccaaagccaatggtctacggacattactttgagaaccctgtcctaagttattataatactatctttctgcccttttggtttatcccacctaaatacaaaccctatgctacctgttttattcccctatgtaaaactttcccatgactttctgtcctcaacctacagaaaaagctccctaactggtataaaaatctcctatgagtgtctacattgccagcttcatcttcatctactcttcaccttcttgagttcccaggagtctatttttcatagtctgttatctccctcagataggaatcaagtcaatattattcagtataatatttcgagtgccagcacagtgagcttcgtctcaaggtatcagtcccaatgactatggtgactatgtccagccaaattgaattcactctatcggaatgaaatccatctgggggaaggtaggccctttcagagccagagccacagaaaccttcaaaagggatagagaaagccctttctaagattgagaagaattgcctgaatctcaggaaatgagtttttggg

SEQ ID NO: 67303 - DNA, 1057 bp, Homo sapiens
ctgtaggccagaagtctagaggtcaaaatgtcagcagggctattgccttgtcttttccatattctagaggctgcccatatttcttggctccaggccccattctccatcttcaaagccatcatcatggcatcttcaaatctctttctttctccgctttcatcatcacgttgccttctctgactctaacccccctgccattttgtaaagaccctcatgattacatagggcctgcctggataatttaggatgatctccccacctcatgatcaagtgaccaagatttggtcactgattcaaagtcccttttgccaagtaaggtcacatatttgcaggttccagggattaggatatggacattttggggggtcattattcagcttgccacaatgactgttgtagcaggctttcccgactgaaatatttaagcttttaaatctcatccctccaccagaaagccctaacctccttttctgctttaattttccctaatggcacttagcagctaaaaatttgtctgtccagcccattaaaaatgagggtaggtaggttttgtcacttttgtttactgatatatcactgaactaatatatctgtgtatagatatattcagtgtctaaaggaatactaggacacattaggaactcactaaatgtctgttgaattagtgtaaaatacatctcataaataataacatggtggaatgagactcaccactggaatcaaccaacgaatggtgtattgtagaagtagtacaaccgtttgccaatattttgttctctcctttttggcacatagaagctgcacgttctgctcctttgcagttggctgggaccacatagctaattctggccattgaaatgtgaccataagtaatgtatatcaagtttgatatgaggcaataaaaagcccatgcatgcttcttcggtctctatcccctgctgaagcaactagggagtggtcatttcagatagtatagatacagaatggcaggacctttgacagcctgagtccctgagtgactatgcaaaacaggaccttcactccacaccccccaccc

SEQ ID NO: 67304 - DNA, 1060 bp, Homo sapiens
acccagactcatcagttggtaacattttgccacatttgctttatctttctttatgtaatgtatgtagaggcgcacacacagaagcctctctttccttttttttttttttaaagaaaactatttgaaagtaagtaacagacatcatgtcaattcactctgagaatttcagcatgtatctttaagaacaaagactctttcctttagaactgtaatactactatcatgcccaaataatttaatattaacacaataactttatcttgcatacagttctatattaaaatattcccaactgtccttaaatttacatctagctatccccaaacccccatttatgatctcagcaaggatcacatgatgcatttgatacatatatgtaaagaaggaaagcagtaaggtagggtgggaagagttcgagtagcctgattctaatgagctatatttgcaccatgaggaaacaggagttactaggtataaagtgacctacttgcttggagagcagggacctttccctgagattactggtaaatatgacatggtggtgatgatgacgttgatgatgaaaagcaagatgaatggtgcatagcatcaaacgaaaaaatgacacttttcagatgttaatggactgataaagaaaaattagaaatatgatttggcaatgtaaaaagtaatgctaattagactcttcataccctaccaaaaatgtttaattaccatgcattaaataatcaatcattaaatcaatgtgaaattaatttgttctaagttctctacacatacatgctcaatttgcaagtagcatggtcaactcctcccaactttaattaattagagctggcactggtgatggaatatttatttatggaccaggtgcaattaaagaggaatgggctaggttcactctagaaatgctaaggggaatttaagatatgaatgcttgagacacctagaatctcagagccagatgtgacttttgtgatcatttatttcagttgatccctttatatcatggggatctgaaagttataatgtgaggtcatgtgctattctcagtatttca

SEQ ID NO: 67305 - DNA, 1035 bp, Homo sapiens
ccccccaaatcaggtatacacagatgaaagtaggaatgaatatcaagagtgagggaatgatcaatagtgccatactgcagagatcaaggataatggagtggagagctaaaatggttgtaggtatacctcagagatattgtggattttgttccagaccatcccaataaaacaaaaaaatcacaataaagcaacttacacttttttttggtttcccagtatatacaaaagttatgtttataccatactgtagtctattaaatgtgcaacagcattatatctaagaaatgtatgtatcttagttgaaaaatacttcattgctgaaaaatatcaacacagaaacttggagtgagcacgtgctgttggaaaaatggcacctgtagacttgctacacacagtattgacacaaatttttattttgtaaaaaacacaatatctgcaaagtgcaatgaagtgaagtgccataaaaaaagtatgtctgtatttgttggaaacaaatgtcagcttgtatgaaaaatgagattgggatgtcagaggtggagacattagcaaaggccatcagcttaaagagttcaccaggaaacaggaagagaggaaattaggagttataataggatcaaagataggactttctgagatacagagattggaacacatggagagaaggaggctgaagttgtaaaagatggaggaatgaggtacaccttgtggaagaaaaatcccagaaggagcaggggtccagagttcacgtgaagcagttatctttaaatgagagaaaagaaacctctttctttgaaaataatggaaaaaagtccactcagacacaaagcttttatgaggtgagaacgaggtacattagatgttcacaaagatggctttaaactcccactgatctgaaatggccacgtagcatgagtgagatagaaacttttgatggtttaagttactgatattttcagattgttattgcatcataacttagcccatcctgactgaatacaaggagaaagttgcctcctgaggttagtatagaaggga

SEQ ID NO: 67306 - DNA, 1036 bp, Homo sapiens
gtttgagttcatatttttatacatgtgctttatatatctttttaatggacaaataaaaagttatatatagttatggtataaacatggtatttcaatatacgtataccaagggagtactaaatggaatggctaaaccaagctaattaacatatgcattacctcacatagctattttttgtggtaagaaaacttaaaatctactctcttagcaatcttcaagtatacaatgtattgttgttaaccatagtcaccatgatgtacaatagatcttttgaacttatttttcctgtctgtcaagttaatattttgttcattgacccagagttgattcatggcttaattgatttagcatagaagaaagcatttcttattggcaaagactgagggaaaatgagaggccttgctctgtctatttggcatgattttgaacaccacctacttgctaggcactttacaaggaaccagtggtgtaaaaatagaaggtccctgccctcaaggagatgacaatcgaaggaagtgacaggcaagaaaagttctaatttaatatgatgattcgtgatgcagaaatccacacaatgtactatggaaacacaagaaggggtgataaagagctcaccctaaagaaggtcaggcaaagcttcacagacaatggacctgaaccagagcctgcagaggcatctttcccaaagccaggcattccaggcaaagggaagaacaaagtcagagggacacgagaggcagcacatggcagtttccggggaccagtgggccagtgtctccaaaacaaatatgaaattgggaatgcaagtatcctcatccatatctttaggaagaaacccatgcctctaactggagagatactggtggtccttcttgctgggaatatgaacaggattttctctgggggccgtctccccagagatgatgttcggctgctcctttgggccacaggcgtgtgcccttcctccagcagtgtctgcaatggtcccaggcccatgtccagcctgaggctccacttggctcctctgaccatggc

SEQ ID NO: 67307 - DNA, 1058 bp, Homo sapiens
caaccccaatgatttaattcctcatagaggatgatgaatgaaaagcttcgagacctggcacaaagctgggcttggtgcaggaccaagattgctaaaatgtctgcctgacttgtccccatggttgaggagcagggaggactcctgggtgcacttctggccctgactgctgctcaggccaccagagactatggacagacatgtcaaattccagacattctgggaaattggggatagcgaaaatctgggttttgtgctgataaaacctcgtgattgggagtatgagttttagaatcagaggcacctggaattgtagcttgtaatcttcagcaaggtgtgtaacttctccttctataaaatggggatgaaatacctatcttagagtgctaagtaaatgatagctgttattatgagtatagtgtgcgtcttcccaaatgtacctttggcttcttacagaaggacaactgtagggtctgacattagggtttatttaggaactatgctaaccagagagagaaacaggaaatggaaagagaatgtgtctattgacccttgtttggaattgtaatcctttctggggtcttgtcctccttattgcttagctgagccctattaggccctatactcctgagtcaagatgagctttaatgccagagggggctcttcagagacagcgaggggcaagatatcttgacacagggagcagcagggcttattgtaagtgcgtaagtcccctggtggggaagttgaggagcttgtgcatatctgactcagagaagtccttgagttcattgtagggaattccctgcatggccttctctgaattcgtccatcagcaaacatttgagtacagcagcatgcctgccaggtggctccgggcagaggaatacaaagatgaacaagatgcaacccctgcttttgagggcttgacccagaggggagtaatgaaacagatgagtaaattaatagcaaggatgtcatgtgaggagagtaataatggagataagtggagcgagtgtgtcatgggaaaaaggagagggatgcctggctttaccaaggcc

SEQ ID NO: 67308 - DNA, 1056 bp, Homo sapiens
cctcccgggttcatgacattctcctgcctcagcctcccgagtagctgtgactacaggcgcccaccaccatgcccggctaattttttgtattttgtttagtagagacagggtttcaccgtgttagccagatggtctcgatctcctgacctcgtgatccgcccgcctcggcctcccaaagtgctgggattacaggcgtgagccaccgcgcctgacatctttacttcttcatcccaggctgctggcaccaagtgtgaatttcttctcccactgctgtttctccagttcacccttggtggcaactcatctgctgttcccatctttgcttcaattttactttcaccctaccttatccattctttcattcatactagctttggtaacgtgcttcctctccccagggtctgatcttgactcaatctctgcttttgtttctccactgccatatcagcactgatatcttgaaagggcatgacctgctattctgcctgaattacaactaccagtccagaggcacagagatctctgtacgcaccctgtgactaggtaaggggccaggagacaactgtggtggaataccacttctactggctttccataactcctgggtggcccggcttcctcatggcagcttccccagaggggtcttatttcaactaaaagaatagtttgggcatatacagaacatggacctttatcttccacaaccaccaacagcaaagcattttaaagagtctgtaagaacacatgggaaccctgttaatagcccaaggttcaattccacccttctctcaccctttttttttttttcaaacggaatcattctgttgtcaactttggtgagagttagctgtgtttgactgaagcagtaatttgacaagaggtgtcttcgctgtcactcaaattgtggaatagagctcttagcatatgcagggtttgttctctctgccacctccatctcctctttgtgaaactctctctgccttccccttggagatacgcctccttaaagattaagaggaaaaaaaaaaacacccaatcctagaggtcaggagggca

SEQ ID NO: 67309 - DNA, 1025 bp, Homo sapiens
ataagagggttttcagctcaacataaagaggtgctttttaaaatcacagctgtgcaaaggtgaagcaggatatgctaagaggttgtaagttcctttttaccgcagacattcaagcagaagctttagaaccaatagtaagtggtgtcaatgcagggtagtggttagagcatagactttgttttctaagctataaaatgagaataataatatctacctcacagaactgatgtcaggactaaatgagataacatacgtaaagtgtttagcagaatcaattaatggcagctcttgttattttgaaataattgatataagaggatttgcacaccaaatgggggaagcatcaagttagatgtttttgaagcctctcccaaatccaactgtctataattgtaagataatgagtacttactggtgaacttggatttatagaaatggtatatcatctgtggatggctggtatcacatggcttctacttcccttgaggattacagtgatcattttggccccagagcagcagtaagagaagaatcaccagaaagacactagatctagaagagctgatttgtagctgggagcagagagttattaaaagataaatacaggcaggaaattagaaattaagtttaccaagtcaaaaatgtaaagtcaggaatagatggggggtcagagtccagactagtaagacacagattaaagggcatatagaaataagagtttgcaggaggccaaatgtaaaacccaaggagacagctctgatggagtcatcagcaatcattatgataaaaattttaatacggggcaagaactgcttcaccaagggctgaatgacacattccctggtggaacggggctctgagtacccctttttaaatctgccaaaggcacccctatggggagggggcccatggaactttacaaagccattatatcccaatcctgtacctgcatatggagctgctcagcacgtatcttagttatttctttttttcttttttttgagacggagtctcactcagtcgcc

SEQ ID NO: 67310 - DNA, 2001 bp, Homo sapiens
atgcaaaaagcttttatgttatttttatttgcttcctacaataaactggggctcagaaagcttgagaatctgcccagcaaacagattggacagaacaaggcatcaaagatggtgtatcttttaaatccaagtcctatgtcctttctcctacaacaccacagtttcccatggctgataggggaattctaggtactgaataggagtgtgagagagctgttttgggatagggtggatctacctggtaccaggcaaatcataccatataagcaacttcctcctctacccacggtgaacctatccctggggagaagttatggccttagccccttttgaaaattcattagtgaattccagggtttggtcctaggctggctgagcagacttaggtgctatcattgcagtctttcaccctaagttgaatgtaagacatgcacaggtgcatggtggccagagatagatagaacaatttgccagcaagggcaccatcctaactggaaaagagtggtttccctcaggggttgtgttgaatgccaactgatgagtggacatgaactcatgtcctggcagggtggagtctctccaggatgtgaatgctattatcagaataccaaagcaaggatgggcaacagggactaaacagacggggagagatgaataaagagttaatccaaagttggaaactgggtatcatgcattcaaggaccaaatgaagttgtataggcaggatcctattgtgttaggattattttggaaagttgaaaccccataaccctgaaagagatctgttttgagccaagccttggagagctgactgggaaaccagttgaggaatagggaagctgaatgcaggagggtagccaatccctactgaaaaatgaatcccatctctgaaattcctagagtctttccctgtgctcatctgcaaagtctagatccagccttccttcacatcccttctccaaccacttgcaaactgggaaggctttctcttgcttccttcacctcccaggattgtcaatatacagaggcgtgctatttatctctgtcactcagccttctcctaccttagggcaaaaactaccattgattacagacctacccaattaaagcttcagaacacttaagttagcaattattattagccacaaaatgctggaaattgttttttaggcatcatcttgttgtttactctgacaggttcccattgagctttctctgaactattctgtgagttggaaggatagttccaaagcagttaatttgcctcctgagctttcatggttcacagctgagaatgagttactcctcaggatggggttggggggggcgggggtgcaattcatccatccccttgcctgaaggaagactatgattatgtaaactaagaaggcagaagacttgggaagaatagaacacaaagatcccctaatttaaagattccccatgagtgggaatttcctattctatgataggaacatttggaggtcaaattcctccctgcagtagtagctgcatacagaacagacagattgcacctacagcacagcctttactgtggtccctgcagccaaacttctatgtttcatctgatacctgtttatttttcaagcctggttctccagcttggattctgcaagtctgatagctttgcaataaagataagatagtctagttggtttctattgcttcttgcctggtgtggtaggtacacattcacacccagtatactgagcactcaggacatgccacaagatgatctggaagtgaaggggcacctaattcatcatgattgggccaactaaatgtccccagaggccacactaagctgaatcttgaaaaatattattgcaatatgaacaagcagggggaagggtgcttcatctagaatgagagccaagaagtgaaagagaatatggtctgatgaagcaactgaaaagtttttggtaactgctgagcatagagttcacaggagaagtggctggaaatgaggctggggaagtg

SEQ ID NO: 67311 - DNA, 1048 bp, Homo sapiens
tgggtttctctcatttgcaaataaaggagatcgcaagagctacaaaatagtttcttataatttcacatactaatcagtaattgtcatagtttagaacttaatagattataaagttgtgttgaatgctgtaacagtagcaacaacagcagcaacaatgatacttgtttattgagcatttactacattctagacacaagatttttgcattagtcagatttaatccccacagaaatcctgtgaggtgggtatctttatcttcttttaaacagtgttataaacagaccaagagagattacacaatttgtccaagattacacagtaagtaaaattggtgggctttgaacttgaacttgggagttctgattccaatgtcagtatttattcatgacatcacactatctctggaaagtaaatataatgctagaatatgaaagataaatatttaacaaattcaacactctacttcttactaggtacgaggtttgcagatatcttgctagatagaaacttcactgctaacaacaacagcataaaatacgactcaaaaggcactttacaggaaaagcaaaaaaaatcagtttaacaaacagtttgaataatcaaagaatgtcaagagtctaaccttcgctactaccttacattttattgtagcgtagctttagaagaaacaaaaatatctgctcaagcatctcacagtgatgttgagacattataaaggcattttgagtaagaaaaattatatcatgtgcatgtgaggtttaattatttttagattggttaaccccttattcccagagacaaatgtcagctcatccaagaagcttgcaattttgggggtaaagatgctgtttgttctgtactgctgtgaactaataagaattgttcccataagtaggaccaatgaaaataattttaaacctacgaacatttggaagaatgttggaaagaaatagaaggatctaggcacaattgcattggatccaaatagccggaagtcacagaccaagaagcttgtgttatatttccttagaaacactacctagaaaga

SEQ ID NO: 67312 - DNA, 1048 bp, Homo sapiens
ggagaacccagagtggcaaagaaagacggcagcactccaatggcactgtagaccctgagtgttgttgtccctgaggtcagacccactcttgccaaatctgggttgtttattgggctaatgaattgccttttattccaggatcgtcctcttctaaatgacgtttaaatcttggcatccccaaggttcagtcccaagccattttcttgtctttatctattcactctcttggtgatctcatctagtctcatggttttaaataccacttatgttgatggcttgtaaatttataagtgtagcccttacctctacacccatagatctggctgcctgatcaacaatgcctctccgctgtctggtagtcattttgatctgacttgtccaacacaacactcatccctctcctctcctctctgcccctaccccctaacctgggctttcccatctcagtaaatagtaccaccaattgcatatttcatggttcagtccagaaacctgactcgtccctattttgcacctccaacatccaatctatcaccaaatcctgctggtttttcctctaaaataaatctcccatctgcctactccttttcttctccttttcttcacatcctggtctatcacaacagcttcctaactggtctccttgcttttactcttgacaacctataacatattctccaactccacgcagcacatagggcactcttttaagaatctgaatgagttaatgccattcccatgcttaactttctacaattgcttttacaataattaataaaatccaggcttcttatcatggtctacaagactctatgatctgtcccctgtccatctctccaactcatcttcttccttcattaagtcttctttccttgaaactgtcaaatttgctgtctgccttaaggccttgcatttgctcatctctgcccagaatgtttgcacaactggtttcttttcatcattccaatgcctcagagaagacttctctctcccctaaatctaagttatctctgattctttagtaacaatctatatactaggttaagta

SEQ ID NO: 67313 - DNA, 1049 bp, Homo sapiens
ctgcccaaaattagttaggagtaccaaaaaactcaccaaattttggacaaacgataagggagaagggaagtgaacttacattaataggtacatacatgcctagcctacagtaacggtgttttgtagacaagtaaatgaaggctaagtgatttgcctaaggttaattgctgctaataatggatgggcctggatgggcatgcatatttttctgctctaaagcccatgcactttgcaatataccctccggtagagggatcactcatatgaaggggacctaagctagacccatcccacaacatttccacccccttcatcaaaccattgaaaccattgaaatgctcataaggtcaaggagcttggggcataattttgttcttgctgaaccccacttgatcttacctgggtggctttcaatgtttacaagaatcagaaaaactgaagttagagatgacctagggatctaaaatgggcagagaggctcagggaaggaacatgtcaacaagttctgactgatatgtcttatgtgcctggtcctgtgcagtaggctgcacatggagagaggtacagtcaaagatagagtgagactcaggaacagcgtaaggttctctttgcacattttgttaattgtgcaagctgcaagtttaatctttatattaaatttctgaaatatgcacagcataaaaacagccctatcgtaatggcttcatgtggatttttgcttagtaaagcaatggttcccaatgtttttcttctttctaatgctaaaaataccttgaaatctcccacatcaaagtagtttttctctaagtatcgattcatcaagaaaccatgtaatgacaaaaagccatactttaaaatgtgttttattcattgcaacatttgtagcatttgacagataattgcacatagtatgtatgagatacattatcagtggaggccggagactgtgcaaggtgcacctgaagatgaactcccccagacatgccccatcccacatgcatgcatgcacataaatgaacatgcacagatgagaaagccactgagctggt

SEQ ID NO: 67314 - DNA, 1608 bp, Homo sapiens
tcctttttacctgctttgctaccttgtgcaatctacttgacctctctgtgccttttcctcaactctgaaatgtggaaaatactactacttatctgttaagtttgttgtgaagattagatgaggtaacatatgtgaagtatttaggcaatacttggcacatggtcttggcacatggtaagtactcagtggtagttatgatgacacatccacaagaccaaaccacagaaattactgtgctaggctctcagggcacagatacgaaagctgagaaatccagtttcaaatcctaacctttgcctacaagttctgtaactgcaagacaggttcttagcttccctgagcatcaatgcctccggttttacatccgtaaaatgaaggttgaatttgtgattcctgaaggcttttctcaaactctattttaataagtctgtggatatttaggagaccaggcacaagaagcaaatgttagctatgctcaaatgctgcctttgtgtgcccttttcccactgtctatatcttattccttatctctatttccccttctcctcttcactcttccttatataatgtctaatctgtgatctctctctctctctatgtgtcacacacatgcacacactgaggcactcacatgcacacacacggcttcttttcttcttatcacctcgttaaatttctttcctttcaggctctgcctctgatgcacctctcagtttttcaggaaagctcagggttaaggggcctgggcagggtggaggcagaaagggctgtgcccctgctccatcggttacctgcaaagctgaggaagctgcagaggcttaggttttattagatctatatatgccctggctttccgtgggctgagcttccctgatgcagtgaaaactatgtgggcttcacaagtagtcagggcactggagaaaaaatgaaaaaggattttttttacctttttaataaatgacaaagaaggaagagaatattaataaacttcagacccctccccttctcatttctcgcccggtacagaacctgtgcacccacatggaggggccaccccacacatgtggcctccccctgtggtctaaccagcaacctgacccatagaagaagctttgagatgctgcctaggaactgtttgagggttgttccttctgcagaagatctcttgctgtctctttttcttgtgctgctgtttctctccagcttgttctctgtttctgactctttctctctccctcgccctctctccaccacccctctctcattgctttcccaaccttcacggagaggctccaattaaagcagaaatggcagtttggctcctgagctgatatctctgttgctgcagaagctttctcaattgacagaaatctttggctttcttacctctttatgtgctatgttttgggggtgggggaatcccgcagccccactaaacccttcctgttctccccctctccctctccttccccagcccctgttcatgcaggacagcaggatgcttagacaggagggcatttgcaatccccctcagctcctccacagcatcctgctcctgcctcggtggaagtgccttctgcattgcatttcaattaggttctgaaggaa

SEQ ID NO: 67315 - DNA, 1048 bp, Homo sapiens
gtggatcacgaggtcaggagattgagaccatcctggctatcacggtgaaaccccgtctctactaaaaatacaaaaaaaaaatagccgggcgtggtggcgggcgcctgcagtcccagctactcgggaggctgaggcaggagaatggcgtgaaccctggaggtggagcttgcagtgagccgggattgcgccactgcactccagcctgggggacagagcgagacactctctcaaaaagaaaaaagaaagaaagaaaagaaaccagcaaagtaaccaactgctgcccagggtgttacaggaacaccctactgggctttgtcatgccccacctcaatccagctccaggctctgctgagtctgtgctcctcacggacccccaaactttggaggcaggtagggcaaatggaggctcctagtgtcacaacagagagtgaggttttgtaacccttgccaggccaaggttggggtggggaggtacaacgcgctgccaccgcaggcagaagagttgtgcttttccctgggagctgggctgtgggcccagccaggtgctgccgagcgggagggctgctcacactccaagagccaggccggcaattccagaaggcaaaacttcagtgtattccaattttccaaaatagaaggaataaaacaaatcagagcagatgttccaacatgtaattatcaactaatcagtttggactttttttaaaaaagggaaatttcaaaatagctcccagatttcatcaactgcagccctggtggagactggccgggttggaaaggagttactgaagagagctgcaggtgcccaggtggtgggggaggggagatgggggtggggtgacggggcacaggtgcttctagtgctgggactgctgctgctgctgctgctgctgctgctgctgctgctgggttcagcaaggagggagcagctctaggctgcaggtgccaggttgaggcagctgggcctcaagacaagcagcttccctcctagaaacactgtgagctgggatgagtcatctcccggcctcattctgccccagatcttgtc

SEQ ID NO: 67316 - DNA, 1694 bp, Homo sapiens
caatgggaactgagagatggaagggtggctttgagagagttttcaatgtagaatgtggtttctgggaatagagaacagtttaaagaaatctgagattttatagtttagttactgagtaagttttaacagtgataactactaggagattaaagaaagagcttgaggtgcctgtgagtcattcaggtcgaaatgtcttgtaattaattaaatgcacctgtgagtgtagaattgcggcgagaagggagacctggagttgtcagagtgttgatgacagtggcccccagggaaagtgagacatgtaagaagagggcttggggtgggctctcagggttcatcacttcatgcctcaaaggaaacactaaaatctgtgttggaaagccctggacttggattctgatctagcatctgcttctaacagactcatctaggctaagtcattaaccccagtgtcctcatctgtaaaagctgaaggagaggatctgcatgctttcttctagcattgacatccaggagcctgtgatttcatctgcataagcagagtattgcaaaattgcaaagtctagcccatctcccagtgggtgagatctcccagctggtgtgaaggaggccctagtggccccatgaagccacgctgcttggggctcttctctcatggcttttctcacacctacatgtggcgcactgctcaggaaaggctttcctgtggctccccagcctctacttctctgctccattctgccctccaccccaggttttattactcagtgagtgatgtgtgcctggaaacactttctttatgatttattaataaaaagcaagaagggagaaatggaagaaacacaaggtaagagaccaggattgtatctaagtaaaacacttttcaaagtgtcaaaaggtctttggggaaataggaaaaataaatgagtcaaagtgtgaagtgagtgaaaggcaggaaactttggcttcaggaaataagtccccagcaacagcaatttgaacaaacaaaacaaagcaaaatctgacaaaatgaaaactaacaataatcatcatcatattcctcattgttgtcactctcaccataacagctgatatattattctgaggatagattgatctgaaaatgaccaagtcataagaataatgggacaaggtcaatgaaggaggtccaggcagagtagatggtcagggctggctacgcttgtccctgggccccagcaaatggtggccctgagtcccatggggctgggggacatctccatggatggaggcaatatcccagatcaggctttcttacagaatccaaggtcttcaggatctccaaacctttcctagaattgtctgctttttattgagaaggaggaggtagccaccaagattgcaaatctatatgccctgtgggtgaaattggggacagatggggcagagaaggctgcacactttgcaaatctttgaggttcattgtgagatatgaaaagcagaggcaacctcctagaggccttccaaagatcactgcacgttagtgatggctcttagggctgaaccttcagagaaggttttagtgagaagaaaacaatgctgctctcttattctgtgccccccctttctgaaggtcctctatttcaggaagtttcccattttgtcccaccaccccattgccctggcgtttaggacattggccagcctggagggtattt

SEQ ID NO: 67317 - DNA, 1075 bp, Homo sapiens
attcatcttcactccattaacttgaaatgttatctttatcatacaccaaattattatatgtatttgagtctatttctaggttttcttgtttgttttattagtgggtcaatttagtacaaagggtgggctattgattcattttgctatattgctctttagaaaggtgctatcagtttatactcacattaacagtgtatgagtatattgcccctccacacccttgacaacacttaacctcatcacatcttaaatcttttatcattttggaaaatgaaaagtataatttaattgatttttgtttgcatctttattactatcaaggctgaagttttgtgtgtgtgtatgtgtgtgtgtgtgtgtgtttggtttattgaacacttatgtctctttttttgtaaattagatgtttgtatctttggcccgtatatctaaggagacatttaactttttcttgatgctaagagttttctttaatctttcccagaggttctgttgatgtcaagaactatattagaaaagcaggctggatggaggagatcattctaaaatgtattttcaatagtgtgtctaaaagtggagagccttttaaataatgaggggaaggagataggttataacaatactaactatgaactgaatgtctgtgtctccccagaattcatatgttgctgcctaatccccagtgtggtagtattgggaggtggggccttttggaagtgattattatgagggattagtgtcctgtaagaacagatactagagagcttgcttcctctctttgatctcccccacatgaaaacacatcaagaagaatgtcacctgcaaaccaggaaagcagtccctcaccagaatctgaccatgctggcaccctgatctaggacttcccagcctccagaactatgagaaataaatgtctgttgcttaagcaacccagtcaatggtattctgttatagctgccagaactaagacaatgtctaattttgggaaccacttatatgccagtacttttcaagtttctgttcattgtttcatcagaatcaccttacaaggtagggattatcattatcactgttt

SEQ ID NO: 67318 - DNA, 1025 bp, Homo sapiens
tgggtactctgaatggaaaaatatgttggtttgtgattgcaacatccttatgggcagtctaatccataattcaatgaaaaactagctatggagtatctttaatctgtaaaagctttcatttactcagcatttattaagcatctaccatgtgcactgcaatgtggtagatactagagaaaagtgataagaaataaatcagacatggtctctgacagacactaaagtaatttacagtatggtggatacacacaaacaatatacagaagtggaaacagatgggaatgttaatataaagatgatcaatttcaagttttcaaaaggaattataatttctgtagtatacaggggcttcctctattttaaaacaacatttttttccttaaaaacaaataaaatatatgtttatctgtcaaaatgtggaaaaatagaaaattccccctaatctcatcagccacaaataatcactattgatggtgatacttggatatctcatatgaatcttaagcattacaagcttataactgaattttatttctacatatacataaacacttaacataagtgtgcacacacacacaaacaaccctgaatcaaacccacaccatctgctctatcctcatatcatggcagcctctcaatggcaccatcattcaaatggttgtttaacacaaaaactgggagttattgtgaatgactccatctccttatctaacatccaattatccacaagtcctttctattctaatctacaaaatataactaaacctacctattttgctccctcttcactgccacaacccagctcaaaccaacctgctcgcctagattactcaatactctttcattaagcctaccgatttcactcttgcctcctccactccattctccatatcataatttttaaaaagtaaattggataaaatcattcttctgtgtaataccttcagtggtttccagctgtacttaaaatcaacttctttttctgatgataaggcaggctacattgtttggatgatcctcatgtt

SEQ ID NO: 67319 - DNA, 1008 bp, Homo sapiens
tgaaatcccgtctctaccaaaaatacaaaaattagcctggcacggtgacgtgcacctgtaatcccagctaatctggaggctgaggcacaagaattgcttgatcccaggaggtggaggttgcagtgagccgagatcatgccactgcactcctgcctgggtgacaaagtgagattccatctcaaaaagaaaagaaaagaaaacaaaacaaaaaacaattcaccctctttcgtccctccttcctcgccctaccccactgcctacacacctaagagagactacatgtctctgaacatcatgcagttctattctgaaaggtcagtcccactgagggtatcctaacatcaaattatctcaagagatgataacagagatcagcaaactttttctgtgaaaggccacatgtaaatttttgggcttgggacagccatacaggctatgcaggtgtaggtgtgaaaacagctatagacaatatgtaaacctataggccaaaaatccccctttatttaccaaaacaaggggtgggcagaacttagcccactggctgtcagtttgcccaccctggtttatagacttacagagaagagaactgaacacaaattataacatcaacccttgcccctcctttgaagttacaccttctagtaaggcaataagaatgcttttcctttcttcctcttccttctttcctttcttcctttttctctctcttccttcttttttttccttttaacttccagtctttcttcctccttttgttattttcctttttcttcttcttcttttcttttttacttctagtctttcttgctttctacatctctttcttccatcctcccagcaaatatttactgagcacctacttcacagcctctgccctgagctctgctgactcctccccactgtaagctctaagcactttgtttctagcggtgctccggggagcgaagagggaagggatgggtttggggggaggtgaaaaagggagtacaatccacaaaaaaggggggt

SEQ ID NO: 67320 - DNA, 2790 bp, Homo sapiens
gataagaaacctgcttaaattcacttcagtgataactaccaggaggccccgagtcaagatctgtgtgactggaagtctgatagagacatgtgcgtgattactgattaatacatatttatattgttatttttctgaagtcatgtttatattaacatcataattgggtggaatatatgaattaatctcaagattctcagttatctctgcttgacaaggaacttattcttttgagcatttgttatccattcacctcatggtaactacgttggactggaagcatactgtctcagagggatcgaccctactacagtatgggaaggagtctaaatctggcaaaatgaaagtattttcaaaacatctatgtttacacacagcatatgtaaattaccttggtacccaatcaaaagggaattgccattaataagggggtgattcctcacacgattattattactgtcattaattttttaatcataatttttaagacattgattatcagccagggggattttgtcccccaggggacacttggcaatgtctggagacattagttgttgcaactgggagggaggatgctattgcatctagtggggtaaatgtcggggatgctactaaacattctacaatgcacagcacagtccccccaacaatgcagaattattgggccctacatctcaagggtgctgaggttgaaaaatgctattttaacagtttgtggtaaaagaaggtgctccttaggggtctcactgctaaatataaggtttcactgcttttctccaggcctctgacacttagtaaaatttttcatgatctccaaactagtgactactctctcagtactgatgataattgataatgatggttaatagtttttgagttcttacctcgtgctaggcattgttctaagcgcttttcatatattgactcaatcctcactgttagtaatgtgccattattattcacattgtacaaatgactcttttagtaatgtgccattattattctcattgtacaaatgaggaaactaaggcacagacagtttgagaaacatacccaaggctacaaaactagtgtggggcagaggcaggatgctaccgtgctttcattcctttctccttcctccagcagtggaccagtctgattacctgggtacatatcctgaggaacaatgcaatgggtgggagtcatactcccattgaacagatggggaattggaggcattaatcggaggaggaaacagggacattgcccatgggtatcaggcaaaaccactttcatggagtgctcagccatggttgtttccaattcacatgttgaacatggatttttttcccaataagtcttgtctgagagaatgatgtacctagtagagtttgaataactctagtagtgccacatgaatactgctggctggataaaaggatgcatgcacgcatggatggatggatagatggctgaatactgagccactggaagggttcaaggaatggtgcattggtgcattatggcagaggggctttattcctaatactacaaccatgatcaacaattccatgttcttaaaggtgacagcaaagctgggagcctgcagagctggaaaaagccagagaccagagatagaaacaaaacctacagtttgcccgaagccaagtatcatagaacatgtgggcccttatttgtcacagcctggaagtaactcgcctttaacgtgtttgtattttcgttgtccttctaaaccagggtttctcaacctcagcactactgggatttatgatctgataattctgtgtttgggggctttcctgtgtattctaggatgtttggctgtctccctggcttctgcccactgaattctgatagcacccaccctaccccaagccatagcaatcaaaaatgtctccagaccctttaaaatgtctcctagagggccaaaattacccacaattgagaaaaattttgtatacctagttcctacaggacagagtttgggtttcctcaccttattgtctattgtagagcttggcgcagttatttaaacttcataaatgtctgtggaccaatagattgcttatctcctttggcagggaaaaagtcaaattccagggagaaaatgcagaaaacaataatgaagggaaagagaaaggaaggaaagaagagagggagggagggaagcagggagaaggaaggctacttgtaaataacagcgatgctccacccatgaccccttcatgtgctggtggctcagcagcagatatgaagaaactctccaactcagcaaggagcttcaggtgacttcacctcatgaaccagaaaactcacactgtttttgtattcacgttgtttaaaggggaccagggttgtctttttgcgtgcatggatgtgtgtgtgtgtgcgaaagtataattacccatcactgattaatcttcagactgagtcaagcattcattgcaaatccttgaaacaaacaagtctatttatattttaattatttttttggatttcaagttgatttgtctttcttctgcatatttatgaagctgttgatccatggtaaccttacccttacctcctgtggaacaggaggaagagaaagaaaaagacagagaaagaaacacaaagagctggctttaccccttttcttcccttcccttccccagaagccatagcattcccacagctctagaggacagtgaggacaatacaagaacaaaggcagtttttttcaattaaggtgtaattaattaattaggaccccctgcccatggctgtcattcttatttaaggtgacct

SEQ ID NO: 67321 - DNA, 1404 bp, Homo sapiens
accaggatcagtggataggatgacaggcagattttatatcagcgtaaagactttcctaacactagaaatgactaagataaaatggacagttgtaagaagtgaatttcccatcactggagattttaaagcaatgactgaatgtctacttgataagaatgttgtagagaaaaatcgtgcattgaacaggaagaagcagagggtggagagtggcaggaagacatggatctttctggtccctcccaagcccaggagtctatgaatgctttatgttactttaggtccagtgggaaaatggcagcatctatttatagagctattgatgtcaacagtgatttctgccagaggtgtgagtctttgtaaatggtgcaagctttggggtgaataaatggacaattcagtggagaggacccatggatcagaatgaagatgagcagaaggtaattaaatgagacatgtatcagtaggagggttgccaagtgtaactaagttaaactttgattgtgattggaaggtgaggagaacatgacttctatgctttcctctggggttgttcgaaataaggaaatatggtggaatggggaggataggacaagagtctgtgagtcaacaaaactctgctcaggaaggaatatcagagcttgcttggagtgactgtgttcttaagttcattaacagaacaaaaaaatcaaaagtgatgctggcgctgattgaaataagcagatggttaaaaccacctgtgggagaacctacttttgccaagtcaagaaacagcagcacccactcaagcagagcctgagaaacagagtaggctggtgtatttgtttcccagggctattgcaacaaagtccacaaactgcatggcttacagtaacagaaatttattatctcacagtttgggaggccagaagtctgagatcaaggtgttggcagggccatgctccctatgcaggctccagaaaaagaacccttccttctctctttggtggccaccagcaatccttgctgtcctttggcttgtagctgcaacactccagctcttcacatgccctccctcttcacatggccctctcccacatgtctgttgcttcacatgactccaaagaaggaaccagtcactagatgcagtgcccaccctcatgcagtatgacctcattttaactaattacatctgcaaaaactctatttctgaggaaggtcacattctgaggttctgtgtggacatgcatgttggggagacactattcaacccagtacaattaggagccccaaattttgtgaaatagcacctgaaaccagttgaaaatagaaaagggcaccaatctgtgtccacgttattcttattttaaaaattttgacttaccatttttctcattttagcaacaactatagctaatacttactatt

SEQ ID NO: 67322 - DNA, 1014 bp, Homo sapiens
tcattcttggcttctgtatctctgacggctgatcgtgggacttctttgccttacggaatgtaaaccagatcatccaagccctcatctgctagcctggttcttgaaaagatctcgtggatgacagatacctctgatacaatccttagaagaagtgagctgcaacacagctcaggatgtatttttgtagttgtttcaagaggacaggtgtgttggtgtatattcagagtgtgaaagtgtgattcctggaaggctcaggtcaaggatttagtctccccattagtttgctgtattccattcttctgaatgcagcccctgtaccagccacacatttcataaaggcctcttgtatgtcagaaaagggactggacaagagaaacagcacgattcacttagcagatgcctccctactcctaacaactgagtttatttgtgtgtttaacagatatttattttgtacatagactgtgaagaaaacaacgacaacaacaaaatagtccctgtcttcccaggaactctgaaccttacttaactacagaaagatcaacacaaacacgcaaggaacagttaagtaagaaaagaaggcagaatgtgataaaaacgtcaaagtgagggagacagatggcaagcatgataggaggagtttgcagaagaaggaaatgaatgtgaggtagatgtgcacagaacagtttgggaaaggctttagggaaaacggaattggaactagtcttgaaaaatcagtcaaagcattcagattgggagagtggaaatggaatgcattcattatggaaggaaaagaatgatcaaagcttggaattttaattatgaataaaatctagaaaacaaacgaatagcaccattgggaagttaggttactaaatcgtacattcaaggtacaaaatattgcagagagataatcgtacctacaacagtcttcctttgggtttaaggccattgatcatcggtcaaataaatatgagctgaaaaatagtgatagatgacaatgtatggtaattg

SEQ ID NO: 67323 - DNA, 1059 bp, Homo sapiens
gcttcatttgttttaaggaaagagggatctatgatcctttgctgtcaattcatcagttgacatttttagacacttgctatatatcactgaggaatttctccttcaatcactcaactcaattcaaaatgtagagacatgatgaacacctactatccatcaataaaataggtattcacttcctactatgtgctaggttctgaggagtacaaaagatatgtcagtcatataactgacattggaaaatgaacataaatgaaagacatataactatttctttccctccccttcctgagggagaattattcttttcttcctccattgaagtcagactttgccttgtgactttggccaatgaaaggtaagggaaagtgatgtgtgtcacttccaggcagaaactctaggagcccgtacttgcttcaccatagcctcttttccctttactgtgatgactggcaatgttacagtaacagctcctttgtcagcctagtttctgcagtacagcaacgtgaagttgactcctaactgtgctaggaaagacgtgtcgtgaaagtgagaaagaaccctgtgcttttgtaagatgtaatgtctgagcttacttgttaccatagcataacttagcctaatctgacttctacacgatggctctagaaagctagcatttattgagtatatcctgagcattgaatatatcctgagcattgtgctgtgggctttatatgcattatttcattgaactctcgtaaaaacaccatgaggtatatattatatgatttctattttataggtgttgaactgaatcccagagctaagttcagactgttatttagtgttgaagttgaatttcagaatctggtttgcttggatccagagctcataagcttaactactatgccatactgccttatatagtagaatgaatataattgaagatcatttttggaatagactgtaagttctctgggcagtttagaagaggagtgatcaataaccattaaaacttcttgggaagagctttatggaaaaagtaagagttgaaaaatgtgtaggttatagatagga

SEQ ID NO: 67324 - DNA, 1089 bp, Homo sapiens
gacttgtaatggaaagtaagttataagtacatttaaatagtgagatattttgctacaggcttgcattggaaagaggcatgtagctttcaaaagcagacagtctgtatcaaaagcagcttgtaaaagagctagttgctaaagggattcaattcaaattttggcttacacataattcagtgaaaatattgataagaatgaaagaagaacgctaagaagaaaggaaggaaagagtgagttcgtaaataggttggcatccttttacttcaggaagctctttgatgtgcctcctgcccaccccctaccccatctccaaaccagtagcattaagtgacttgagcactttcattcccatttgggattctgccctatggaaaacggagaaggtaaattatgagtaggggacttgaaaggagatagctttttcccgctggaaatttctttctagtgctgagacaggaaaaacttggtagttaggttgtgtgagatgtctgagcactgctgactgaaggaaaactcttgagaagcaaaagattctccgaatagaggcttaatctgctgttggcataagaaagactccagggacattaatatctggtgcagtcacagagtcacagaagcactggagccataaatatgccccaggaaggaattttgactctaagtttcaggattgagagtgatttgaaagaaatgtactcaaggttagggagaaaaccagggagacataatcgataataatgaataattagagactcaaaatttcctgggggattaggtttcattttctttaaagacttgtgtctttggactatcaacacctcctttgacatttatttaaggaatcatattttcaggagcaagaagctgtatctactgggtgcccagatgcccagtccacatgtttatccctgaaatatctagaaggcattgtgccctaattgctggccagcacccagaggaaataaagagtttcatttgtgctggatttgtggatctaaatggaaagatggtggaaacatcatacattttgtagaaaatcaagtaaaaaattactgtaaaagaaaatattaaggcaaatacggacttgga

SEQ ID NO: 67325 - DNA, 1051 bp, Homo sapiens
gttagcatttgcaagtgaccatgcaagacctcacttttccccaagctttattccttccctggggtatctacctggaagggaaaaaaagatatgatctgttgtccctaaataaggcctgtctgggaagtctctgggggtgccttttgtgttgagaccagaggtctttcctatggtccagccagtacctctgagcagagagaagtaggggagctagatctcatcaccccaggctacaaggcagaagcttctgaggaagacagtgtccacgtctggtaagatgatgagatggggcctgtttgcagtcctaggcaggctctttccacagcctgaaactctgcagttgattttgcctatgttggcatctgtttgtagctttcaccagtgagatgcgccctgtttgcagtcctaggcaggctctttccacagcctgaagctctgcgttgattttgcctatgttggcatctgtttgtagctttcaccagtaatgtctgtcaatggactcattatcatcaaggataagagattaagaaattatgaatgtgtagacacttttgtttgcatctaatggtttctgtatttaatggtttattttattgatgacaactgtcctcatgtgcactttataaagtacaaattggacttgtagttactcttatttgaagtttctcacctctattatctttgacttttaaccacccctaatgaggataatagtcattgttcagataaatagatgatagatatagatagatagatagatagatagatagatagatagatagatagatagagatagataaaaagaaagaaataataaggtctccaaggtagcaagggctttggaaattatgtctattaaaggagctcatgatgtgtagcctggaaaagagagtttaagtgggacatgatagctgtcaagattagaattacattcttttatttttttcttctcacttttgtcaagtctctactgttttataaaatctttcattttaggctcagggataatgtgcgggtttgttttataggtaaacttgtgtcatgggggttt

SEQ ID NO: 67326 - DNA, 3615 bp, Homo sapiens
cggtggttcaaataaatgagctgaggtgacaacagaagcatcatcagggccctaattcatttattggctaattgctcttccttgctttggtctttaacaatgtacgtgcacatatctggtcattggtcattggtgtttactgtttatacgttagtcagcccctctccagctttctgcatttttagctcccactcacgtcttcttctgctgacatcctctggtcataatcactgctctaatgtctcatttgctgaattatatcgcagcggttcagttggagtggtgcctttggaacccccggatccccctttgtctcacccaccccgctctcttcttccaattgttttttcccctctgctgcctgcacaccacttcggctgatgatggccataaagcaagttgccatctctgtaccactttacacagaggccatcagacagtcacggtgctttaccccttcatctttcaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaagaaaaacaaaaacaaaaacaaaaaaaaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgttgcgattggtgttttccgtctcaggtagattgcaaagtgtaggccccacacattggaaaaaataataataaaacaaagcaaaaacaggaaattatggattttagttgtatattggtttatgtattttttcttaagtatacagtgcactgtttgaaatgtattgttgagtattactttgtacaggttgatcactttttttagagtgaagaaagaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttacaaaaaaaaaaagaaaaaaaagaagtactataaaatatctgtcttcttaataaaaaaaaattaatgttacaaagtgatcctttaatctctttatggacttcttatggacgcctccgagtgagagaagagatgggcctctggtcccagcttcctccttaggaccatgtacggggccaggaacgctggcagtagatgctaggacatgctgccggctgggttgctgggggccgcgctctctctccttctccgctcatc

SEQ ID NO: 67327 - DNA, 1055 bp, Homo sapiens
gcatcttgcacggctgcttcatgtcatgagtgaggcacagcccgcaggtgcaggcagctcaccccggccctgctgccttgagccaatccatggcattataaacactcccccaccctccccacacgtggaaataaaagaacggactgagatgactccagaaacagctctgcttttcatagggaaggccaagacagaggcactcagtgaacaggcacaactctattaacacctcccacgtaaacccaggaggtgggagtgggggtgggaagaggcggtgaggcgctcgtaaccggcagtgttccctgtaaattaaacatcagttaccttctgtgtccatctgcagtaattgaaggcaggagaaatgtcttggtgattaactggtggtagtaaactttctgatcaaagtgggtatcagaagatagctggagagattacccttataaataagtatctgtaaaatatgtatgtccttgagggtggggaagataactagaacatctaaggttctagtttaatttgggcaaagtgcagggaaaaatagcaacactgagcatatttagctcaaagttcatggagggcaaaggtcaagtaaggagtttcggctcaagaaattaatctcacagatacatatacctcgtgagatctttttgtttgagggaggtttttgtttttctttgtcacagagcctctctctgtctctcccctcccccctcccccctcaggcttccagaatattcctgtgtctaggcatggagaggaggcggtcttttattaagagtggacaagatagtgtcttcccctagatgggttagaactgtcctggacagcttctcgaagcttctctctgttctcagtcttcctggaacctctcttcacctcttgcctcttgtgcctaactttcccctgtcctcaatgtctagtctcacttgttttcctcccccaattttaaaacatacagagttcatcgaaagacacataaattttaataggtctgaagctcatggccattggagatgagttaattctcattcccccaagattccctattttgacag

SEQ ID NO: 67328 - DNA, 1059 bp, Homo sapiens
atcactcttgggagtttctttgagatttctctgtcccgcaatttctaagatgctaaagcgagcccagggttgttgaagctgtgacccaagcagtagtggccaacttaacattctgcaagcagctggtaaactctcacctggagccaagttgtttcagctttttgccaaaagaaaagctaactcacgaatactaaacacctcatgatttatctgtcacacttagagccatggaagtggctgcgggatgggacacgacaggcagggagggttgtaccacaactgtgagctgtcaggaacacctccctgcaactgctgcctgcccgccctgaagccctcgactacagagtccaaggtcagtctttttgccaaaaggacaccaagctttctacctctgaggaggagtgaagggtgacacagcgatacacaataacctttacagggttcatctgcaagtcagaatcattcaaggactaggcctaattcacctgaggtcacatgtgaaataatttggatgagattcttaactccagttgaactgtgttatgcaatcatgcttggttcactgaggctggaataacctttatgctggaaccattcaccaagcaaaaacatggctttacttttcaggatgatggggcagggcttagtcccagaaaagaaacactcttacacttgttactagtaagaggaacacttgtagcctcttagggaacaagaaaacatggctttctaaaccgaagtgatgtccatatgcctgagcatcaggcatgtttaaaagtgctttccactcccacatttatttttcaattgacaagctaggggcagctgtagaatctgcctctggtttcgttgcctgcccgattcagaaaatgagccgggaatctgaagagaatgtccccaggaaagccagcacttcatgggacctgaagaaggggtctgcaccctgcaggaccaggatctgtggctcatggggaaacccatagctttcccacttagaagtcatttctcatggaattggttagagtccttgccttgggaatggaaggaaaggtcaagcag

SEQ ID NO: 67329 - DNA, 1050 bp, Homo sapiens
gaatttgagaggggaaaaaatcaacaagaaaaaacccaaaacacttgttttcatatttagctacaatagtatttaatatcctgatactcaaatggtacacccgaatcgaaacctgaatcagacggccttcacctgccaggcccacagccttgaccttcataaaggacagctaagccattagttacacagtttgtcaattctgtataaatgaaaagaacttggtgacttcaactcagtaagtgtttattgggcatcttaccatgtgtgggcaatgctgagtatgcagtaccacgcttacccctaacgaactggtaattatttgccttgggtcggtgataagaactggaaaagccctccttaggctctaatacaggagatttgaatttggcaaacaccaggtccctatgatactccaagccctgagccaaataggcactttcatttggctcaggaaatgaaaacagtggcctctcaaagtgaccctgtgaagtacgtaattgtactcagtggctcagagtgcctcattgacctgcctgaagtcacagagaaaagtaatgaagctcaagttctgtcccagaaatgacagcaagtccagtgctctttccaatggaccatgcaggagatgagctcctagctcgtcccctgttcaggcctgtttctggaaagcaatgtagccagtgatagtctaagagagccctgagtcctgatcatttgagtagtgacaaggtacagccaaaatctgtgtgcagtacttctaatttaaatgaacacatactgagctctgggtggcaccatgaggatgatcactgcagttttcctttaagtagcttaacatagctcctttgaaacgttagtatagatgcagttacattgctagaattgaatgcagctgacgtgtagtagtagatgcctgggatgctatatgggagtcttcatgattttcttgctttacgtttattccttctcgtccactttctaagaagacagaaaagaaaggttatgctgcataaaggctagtgtgctccaatatatattaacatcttaatggga

SEQ ID NO: 67330 - DNA, 1027 bp, Homo sapiens
tagagtaataacaacaataatgataataaaacattaaaaaccagatgagctgtatagatatatttaagttatagcccataaatctaaagtgtggcatgatatggcttgtatctgtatcatactttgtaacttagaaagctctttcacacatattacttcgtttgatctttattcattcaacaaaattatttgagatccttgtgctgggctctgggctgggcaccagggatgctgcagtgaacaagaccaacaggagctggagctgccatggcgtccaggagccagggcccctgctctcctaccgcgacaccctactgagggagacagacccaaaacacgagttaatcttggacagtgacaaatgctgtgaaacaataaaaccggataaagtggaagtgagggctggggctggaagaaggtggaggtcagtttagaaaagtttaccagggaaggccattgggacaggaagacccagatagatgagaatgagccagataatagaagattttcatgaaaatctcctgagattgttaaggaagggctcttggtctccatttataaatgaggaaactgggacccaaacggctaaacggtttgcttaggagacagtgagaagcgaagcatgggtcttcctggctctagaggaaatagaggactttggtttgcaggggccacctttccccctatgaaatccacagcttcctgtgtgctggagcctttggtaatcctcttgacccttttcaattcactgtgcgcacccggggaatgagggaaaagtcaggctctctgcagcccatcaggcatagagcaatgtgctgactaacctgggaagattttttttcccagcatcaaatcaagctctttctcctcaaagaagacctaaactctgcttcagtagtttagtactgttgtcccactgattcccctaaattatgggatcagtttcccctgggaggtgaccctaagtgccatgggaaagtgatggctggaaaaggttaaaccacatcaattcccttttaaaactgag

SEQ ID NO: 67331 - DNA, 1050 bp, Homo sapiens
aaagggacaaatctgactagagaagtatgagcaaactgctgtgcaacttaaaagacctaagcagttagtcacactggactttgagcagaacagcaaagaacaagtaaagccacattgaatgtctaacattttgtgttattaaataaacttcattaaaggatcagctcacaaataaagcaaaaggaaatggaaaccatctcctatctgagcctcccattgtttatctacttccctcttcaccccttttaattcaaatcagagctagctgagaagcatctcagctggccagcattggaattgactcggatataggcatttcaagccccgatttgattacctcctgacctaactgctttttcagctttgagggttttatttttcaggaataccattgatttatgaaattctcttttttaaaaaaatcattttgcgaatcagattttctgatgaaggcataacctgcaatctgcagttagcagatgctgtaccattttgaaatatgtgatccaagatcatcataaattgataatgaactgtgtttgtcagtattggcagcggatttcaatttacagtaaaatgcgaaataaaatgtacatacatcagtatgtaacatctaaatacatttttatttaagagatatcagagcatcgacagctaacaatcaggctttattgattttctttttgcatgctgttacgaatgagtgattttaagcattcaccttcatgtttcatgtcctttgaacagtggagactgaggaatctttctgcctcgattgcgtattaagaacaaaattacataattgaagaaatgtacttatggattaatacattcatgctatcaaaaacatagatagcaagagatttggctcatgtttttaaagaaattcatcctcagttcttaagtgttttgtttatgtccctcgaggaatgaaaagaaaaacgatttgtttttacttgtaaggccttactcagttgcccaattccgcagaagaactggacagtgaggacctctcaggtaagggctagtcattaggtaaggcactgcagt

SEQ ID NO: 67332 - DNA, 1061 bp, Homo sapiens
acatctctctgtatgagcacataacaatggcattcaaaggctgtcattcagtcacgggactctgcagacattgtacgttctacacaagagcaaagctcaagaggtttacgaatggctgcaggacctgaagattgtgtttcagccttgatatgcagtttggaaacaatgtgctactgtctaacggcgtgaaccaaatttctgctaatgggaagaagggaaaactctccacaaaagctgacaaagcaggaagaacaggatgactgagtttttagattaaaactcccgggggcgtctgaactcatggctggtggtggaagtaagagtttccataatatggccaagtgatcagatgtatgctgcttaggtaagagagagaccatcgcctactttgtttttcataatgggaatggtactagggccggtgggctaagtttttgttttctggaggttttattcgatcattctatttcaaaattttctggaaaaaaaaaatgataccctgaaaaactgagcccataagcatttaaatcgtatttgaccttgaattgatttaatatctctagaatttcttactgtttctaattttttgaggtttttcttaccctggttttaaatggccacattgtatcacttttagaagccagcaattactgttgaaaaggaagaatcacaacggcaaaagcattacctgagcgggcttagggtatgttatagcacattgtagcaccatgaaaaagttaaatactcatctctgcagaagagatggctatcatgcatatattaaattaccatgtttgcatctttaggactttattaattgctcaaaaataatcccatatggacaaaaagtaaactttcatttgtttaacaaagtttaaagacatatgttgaatacattttaattagcagtgactagaaagaggccttaatggatgatatgaaagtttcaagagaatacacaagaagtaatttcccacttattgttagagtgaagtctccttttgaagaatgttctctgcttcataaaatacgtctttgtctttttctttgagaaaatgaaa

SEQ ID NO: 67333 - DNA, 1050 bp, Homo sapiens
tgtcggggaaaaacttccaggtcagttgtcaggatagaaaaggtaatagaacgtggtggaaattacaaagcaacatctgagatttccaaagagatgatgatacagaactgattttattctaatgaattgtagctgaaaacccaacttcttcattacagcaaccatttgacttagattcatttgagaataatctcgagatgtttgttgtggtgatctgggcctagaaatgttgaaaggtttgataacttagcaacttaaatgacaagacattaagtcaatcagctatgggcatcttatttggtcttaaaagttttcatactggatttccttctatatttctgtgtttttataaaaaggaaaagaaaaaataaaaatttttaaagctttccctttgaagactcattaaaatattttattcaagcttgttttgctagagtatgtatgaagtttataccagttgtttatgtatgttgaccatttgttcttaccaatatctgattggaataagcatgtattggaaggttagaagtgcatgggcatgattcaaaatcaagtggattttctccaaaaagaaagccaaacaacaatcagccacaatgtgcttttaaggatttaactgatagtaaagataaatgtgagtgttaagaatgggatttttagactaggctgacacaagggatcttctttgaataaggatcttgagcatttgtgtttttggagctcatccttaaggcctggacaggaagaatcctgtgttatgtgtgcatgttgagcaatgcaaaaaacactctgccaaatcctgataccacatggtctgagaaatgcatgagtgatttaacgcacggatggtgtagtcattatgttcttgatgtgtgggtgcgtgtgatggttttcgtttgttcatatgtgggcgcttctgtgtcttgtgccttgttccttctgccctgtgtgtcccctctccccttccccaccctcctccccaatgtgaggggtcgggtgacagcatgcccatggtctggaatagtgcttgtgcttttgctgcactgcagt

SEQ ID NO: 67334 - DNA, 1041 bp, Homo sapiens
cctgtctattcatctacaggcatctgagcataagcagtaaaaggatcctaaaagtgtgattgagtcagtgatgcctaattggcagtcaagaagcccaagtgcccgggtgggttgggttaaaacaaaggcaatgtttgaatgttatgaatccattgtttaaccagcctttcgactgagcttttctgtcgcagtcctgagccttgatgctttaagagccatctaccagccactgagtttgcactggtgtttctcatcactttgcatgtccacctgactattgactagcaaatatatgtgtcctggcaagacccccagaaccaaagaatttactgttttcctcactggctcgcagctttgagctcaaggcatgtcttaaaacagtgcaactcacttcaaatgctttttgcttttcatttattattgcttgtcacgcgatgttctttgaaagcttgctcatatattatctgttccattttttttccattttccctttttttgcatgccgttcctcctgtttcttcccttcctccaatcctctgttcccgtctgtagacacaacggcgacgacagaaccagcagttcacggttggtatcacattactgtttatctactttctcagcactgctgagaggcaaggcaagcctgggaaaaagagaaatgtagtcttcaagggaaatcatgtttcaagtagactgacctcataaatatactataattttttaaggtttgaaaagatgtcgagtcttgtcatttctgttgtgagttcagtacccaatggatgcaagctgagatgagaccttctccccactgggtggctggaattgtaggagtttcagtggcacagagtcctccttacaaaactccaccaaaccttgaaatacatggggcttcaaacaaacgagtattcgcaggaaaattgtaacatctgaattaaaggcccagttgctttgtttatatataggccatagtcccaggtaaatcttgaagaggagtcatttgtgtcacttagtaaagttgagatggaagggtagaccagggaa

SEQ ID NO: 67335 - DNA, 1436 bp, Homo sapiens
cattcagcatttatggaatattcatcaagtgttattgatatgccagtatacctagtgacaagaatattttgggggcactagtaaatactcatgagccaccttttacataataagccaccttttcaagtttttactccaaaaagtatgtgtccatttttcttcatactgtcttaagtgtctacatttttttttcctgataattgtaaacctgttacaaataacaacatagctaaccagcttttgacctatattgatttaggagggaatgagaaaagacttgaatactacagtgatggaggccacctgaccccatattttttaaaaaatgaatgagaaatgtgatgctagtggaaaagtttttaatgcctctatcataatttcaataactttatgctctttattttaaaaataatcttggagataaagatatgacatgttttcatactaaagacctaatcaacaatgcaaacaaataatactgtgaatacaggtttcccagaattaaaaagtgatgtttacagctatcttggtagtgaaaaataaaagacttgactggaaggacccagccctcccatatctaacacaaaatttgccaagacttaaaaatgtgctacaacttacagagagcctctttcctgtctccatcactaccctcgtggcaacatcctcttcttttccttccctcccctctgccttcctcttttctgtacccccttccactgagcattcacacacaacatgatataggaattgtttttcttgttaaatgaaaccactatacagattcctattattttgcagaacatctggtttgcaaatgaaaagatctcaggggcacaacagcactagtgaacaattctgaagaagcttttaacaaaacttgaaattgcttatccaaaaaaaaaaatcatcccccgttgctgctgttctgtagcacacaatctcttcactcacaggggaggtgactttaacaaggaagagagctttatcctgtctctcctattttggccttttagttttcattctgttcctatccacttctcccatccctaagacaggggagtttgattaaaacataacatagatggaaagaaaattagccaggaaaccaggagaaaataaattccagagtttaattttccagcagttatttttgttttcgatcgagttcaaataacatgaaagagaagaaaaaaaaaaaacccaccatatatttaatatatattggccagcacagcacaactatgaaaataaaattgtcaggggaattccttgcctgccctagtgtctagatttaaagcacctccataacacaaactgaaggggaattcaattaagaaaacccattggcttcttattgactttagttaagaaaataaactgggagaaagtgtattaaaatatgtctaactgcttagtatgctttcatttaggct

SEQ ID NO: 67336 - DNA, 1096 bp, Homo sapiens
agcactcgctgaactcctccccctcacaatcaatctcagcaactcagcagagtcgcttcagttcacagctcttaatccttcactccagactaaagctaatcttatgtcctcaaacagctacaactcactgttatcacagttccgactgcagagactccatttaagaggaaatttaaaaaataaacaatgctctatttctgtccacatcaaaggtacctctaacagaaacttgtctttgcttctgtctctctgctactggactctcagctcaaggtaatgtaagatgatctcatagatgcactttagcctcttgatgttagcagttgagtcctccctgcgcacaaaatacatttgtggtaatgaatgcccagaatctcactggcacacccaagagtagttaaactaaaattgctactaacacaacattgtagaattcgttgccttaatggatgtgatcttctaggcttactgtgtcttaacaagcagtcttatatatatttatcttgcccagaaagtacacttgtagaatttaacatttgctcctttctccaaacagattaaaggttatgcagctgaatgattctgtgtcccattttaaaggtccaggctatcccctagatttagattagttcctaaaaaatcttccagtctgaatcctgacaaatggatagctaaattaatttccactcctcttctctcttgcactgtttggtacattacagccaccattagccttaaaagctgcagcagccaaattcggtgacagtaacataaagcctgagcttaaaaaaaaaaaaaaaaaaaaaaaaaaaaaaagaagtccacagtcatctatttcttttctgccagtcaaatgcaataactgaaacccattccctaggtcagggtttcattacaagaaaaatgtacacatgcaatagaaaaatatttttaaactcgagaagtcatagttgatttctgatttctctgaaaggaagtgttccagtgttatcttttatcttccgtaaccaggataatcaaattgttccccttgttaggaaggcagactgacattctgttctgagtcgcctgacttccttgaaacatgttaaagctt

SEQ ID NO: 67337 - DNA, 1037 bp, Homo sapiens
aagctgaaacgaaatgacaaccattgtaccctcttggtactgagttgatttaacctcacctttgaaatctggtagggaagaggggtgtcgtatgttttgatttttcctcccctctcttcacatctcctcatccctaattcacttcattaatgaaaattctcttttcttcttttctcagctcttccaactaaggctttgggatataattacaagacataaatcttgcagggaaagaacttttggttttaaagggggaagccatcaaacaaacatctcaatgtcctcatgcctttgttttgtcattactggtcattgttgtgttcagcattgtgggtttgattttcctttttttttctatccagatccccccacaactatccctcctcccacaacaaccaccaccaccaccaccaccaccaccaccaccatccttaccatcatcacaggtatggtatcttcattaccattgaaaatgtcctgaatgtatattgtctttctggtatgtataaaaagaagccgaaaagttccctttaaatccttggaatttaatcgttcctttattttggaactccaacgacattagatactatgttcttaagttgaatcttaaggacctcagaaacatcccagcatttaacagtacgtcagatattttgcagcttatgcataaaagaattcttttttaagcatcactattgaaagcaaaatgctagggaaaatggcagctggctactagagaacacgcctatagcttctgcttagacatgtttgatgaaatggtaagtactgtggctttcaatcttgtctctgtcttagtttcatctcagtccatgtaagggaaaatatacacacctaacttcaatgtgcctatttgggccatgctactaaatgcatagtcatccttcctgctccagagagtacccgctgacaagtgatactacctgtttgtgttgcctaggtagtcacaagagatcagagggagtcactgtcttttccatgctgagcactcatgtgcccctccctgccctcggtcacat

SEQ ID NO: 67338 - DNA, 1834 bp, Homo sapiens
tgtgttttagaaccaaaatactttggctctaaagtccacaacaaagtatgtctttctttgtatattctcttattctcactgctttccagtagaacaatccccttcaatatgagatgatccttttagaattaactgtctgggccagagtgcattatctgaaaaccaagaaatatagggatccacctgttaaaggcagacacagctacatacacatgtctccctaatccaagatggtacacctatccttgtctagggatttgctagatctgtaatatactacctatctcccctaatcagtcctagtaacaatacttgggatgacagattagaatattagcctaaggtattactagtctactaacaaaatactctagcagtttgggaaggtgttgagtagattttctttccaaagctgatttgttgtattactaccataattttggaagtattttatgaactaaaagttagcaagcccccataaagtttaactctctagaagcaacttctacacatgaagaatctagctggttagtgcctgagccccaactgattttattcttttagcctctacatgtcaagcacagctcattaactccaactctgtactttcttaagtggtggcctcacattgctcttattgctagaaatgatctaagcactgaagttattttacctgttaaaggaatctaattctttcaggtcactttagccagatgtgaaggacaacagttgccccagtcgtgataaagataattgaaagtgtgtgatttgcacaaaatgggagggactgatgacctttctctgaagtctgtgtcttcattagtctggtccaccccttggttcataatcatattttcaaatcaccttcagatctactcttattgtattgtggacatcacacactttatgtcaacacttttagaataggtgcagaaataggattataggctgggcgtggtggctcacgcctgtaatctcagcactttgggaggccgaggtgggtggatcacaaggtcaggagtttgagaccagcctggccaatatggtgaaaccccgtctctactaaaaaaaaaaaaaaaatacaaaaattagctgggtgtggtggcgcatgcctgtagtcccagctactcgggaggctgaggcagaagaattgcttgaacccgggaagcggagattgcagtgagctgagatcatgccactgcactccagcctgggcgacaaagcaagactccgtctaaaaaaaaaaaaaaaaaaaaaaagaaataggattatagtatatcaggggaaatctcccaggaacaaatgttccttttcagtagtagatatagtaattgaagcaaaacagaaaaatcacattaactgaccctgtgctgggcagcaggcacctctctggatatagtttagttgtgtagtggagggagcgggacgtctttagtgctgggctcaggggtcagtgcacttggttcatttatatctatgctgacacctgcagcaggtgtgtaggtgcatccaaatgagtttccaggtcacaaaatgcttccctacctgtggcctccataaaaagtgtgaaggagcaagactgaacacatggcctgaatcaccgtatttctcattctgcctttcttttaaaaaggtagtttaaaatcactaacttaaccatttttacctcttggaggagaatgagattttttttaaacgacatccttttttggactcacgtgaggctgctttaaatgaaagtgtaaactgcttgtatccccatcttaaaggaacggagcctcccattgaacagaacagttgattcttctctgttaatttcatccaagtgtgtttg

SEQ ID NO: 67339 - DNA, 1072 bp, Homo sapiens
gtataccaaacagatttttggagacttcacagttgtaattctgtgaacttaaaatatctccagtaggtcctcattaattgtgtcaccctgcatgtgggtgagcagtttgatgcaatggggaatgataatgtgacttgtcttcctccccttccccctgcaggcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacggtacgtgagaagataaaatgctcttctactagagtcagtcacatggagctgctacttgtgatttactctcaaagcttttggtcaagttgaaaatcaaaaaccagttggtttccttctagaacttaaagaagcctggcctgaggtggaccctagtgtctccacctgggatagtgacttttcttctctccctctaatggtgggtgtttctactagatcacagtctttggtcatgctgagaaggaaagctgtgtcctcaggcacaagccatggagattacgttagaagtaatgactgaaacattcagccttaccaattagcagcttttcagctcagaaagtttattcccagtggtattttactatgatacctgggctagctttctcctgctttgatgagcagaactattctattttcagcatgaagctattaattccaaaagatgttgtaagccagtaaatactcagaacaaatacaaggtcccttgtagctacatgaaccacctgtagctactgcttcagaacaaaagcttttttaaaaaatgtgtctgtttttttaatatcattttacaggattattaaaacatcatgaattttattctctagtcaacagatatttattgagcatctactacatttcaggcatcttaaacttacttcctgtttataacttactgttgattttgcacatggtgaatattttctatttagttgagatgtgcacctcctctctagttttataa

SEQ ID NO: 67340 - DNA, 1024 bp, Homo sapiens
aaaagtgtcattcatacttgactcccagaaatatttttgttagtaaggaaaagctcaggaacttttcttaaggaggatatatatgccacttcataagagaaaaagaagaaacaactaagactcttattttattgaaagtataaaggagccacttgagttgccctgtgaaatgatccaaagtgaatttgaggaactacatatatcatcactaatacaagaaaaaaagccacacagtggtaccattttaactattattcagtttacttactgggcaggggacacttctttagtgtttctagtaaagattgtttttaactgttccttagtgggggaaagaaaaaaacaagttgaggattcatgaaatggaataataggtcaatgttgggattaaggacgctcaaactttagtggtacccaacaaaaaacagcattgagctccctttgctgtccccgtagtatgattttgttttttccctcaaagagttttgctagccagcgtcatcacagttttcatataaagaattcagagcatcttaacaaagcttccccagaaatctctggaaagaagcctccctactttaactaaggaatgatctatgacaagagaccagaaagccaaagggggctctgcctgctgttggttctctcttctcatttcaaccctccctatctttgcacttacctctccatgtgctggaatttccttccctctgtgctaaccatgtggagttttaaatgacctttaggagctggaaagtggtcttggttctgtttcactttccctctggtgtttccaagttatttggttttgaatgcttcgagcttcagcagagtgatctttttctcgtttgagcactgccaaagattcagatctttctttttgtaaacagtttgaattattccctaattagcagctttcttccagaataatccaatggagtaagaaaaaaaaattctcagaggcctcttgccgcttgcaatacccgtgctcggccacattaaccacagttacagtctatggctt

SEQ ID NO: 67341 - DNA, 1117 bp, Homo sapiens
gcattagccgctcttgtttgtgacatttccctgttgggtgctcgtttgcaagctcattaataaggttttctcataggaacgttgccgggaatgaagaacatacagtaggtctcttagttttctagctttcattctgagactcagcaagggtacagcagcagcacacagttaaatgtttaaaacagaaaataattatgctcccaagctggaagagctcaaagctctctttccttagatgttatgcagagaacagttttgctttttaatgttccgagctgtatgaccctaaaatctttcagtgcatttttttcttgcgaatgtctgtacaggtggtggtgcccaaatttacaacatggttgattatagcagagtgtgatacaattgtagcacggttagtagagcttcagatctgagggaatgtactcttgtcaaataaaagcctgtttaaatgggaacagttcactgtctgagcgttaagagaaaactgtctaaatagcatcaaggtggcaacacatagcgacataagctgggaattcaaagaaaagctgtgaccctcagtatggaattcagattgctttgcacaagggaggaaagccttcctctggactggggtgaatatgaagctcttgaattactgctgtgtggcttctgctttcacccatcatagccttgctctttaaaatgtttggcaaaaatcctcattttttgagggttttgtgtttgtgcatattttaaaaaaagaaagaaaactcagagatgagttttgaaaagaagaatgaaaacaaagactctagaaatgggtgcttgaatgccatgcctgctctgattatcatctgacagttaattgtatacgtgggcatcattttcaaaatgagttttattgactgaatgtagctaggtattttataaatccatagccctgttcatccaaggtccagagaagggtagatttttttttttctttcattccctcaactggaggaaaattgggcattgaggagatgatcaaaacctgttctttatctgtgccaaaataaatgtttctctggtatcgatagtgccctgcattgaaggagagaggaaaacctggaaatcagaaaatctttcctatttggag

SEQ ID NO: 67342 - DNA, 1147 bp, Homo sapiens
cctagaataatttattcagtagccactctgcatggaggttgaattattttggatgcctgtgaggagtaacattgcacctgtattttaatgttgactcatgccgttgaagtcagcagttcttaaccttttggggatcattggcccctttaaaaaccctttgatagctatagacctggaaaagatgaatacaatcacatattcaccatattctacttacaatctaaggagtccatttacccctcagggttttcctaaattcagttatttgaggaccactttcacaaatttgccatgttcatgcatcatctgtatttttacctgatttagaatttttctttaagtcactttattgctttatcctaaccagggcctatgtaaaaatatctattaaattacacatttcatttgttatatatagtgtctaataagctttaaaataaatgtacaactaatatttttcaatgtcctttcctttgtcacctaaaaagatttcttatgttctcggtgagaaacaataggttatcactaggaaatactgatcccattcatggacctcagagtctactccgagtaaataaggctaccttgggggcaaatctaatctgatactattggtattaaatatgctcacttgtttaagcctggctgattttacaccatgaaggtttatggaaacctctctttatccccatctaagatgaatggatgttaaccaggacatgaatagggttaaatgacagatcatggatttgaattctacatcaagtaatttttaaaaaatactattaaaaaggaaatgaaataatgaaaacctgcgttatatgtcattaaatatcttactttaagtaagacagggaaaaaagagaggaaggataaaaagaaaggaagtgttgcacctctgtccttaaaatggagtgctaccatatggcatagaagacaaggcttgagctgcaacttggaattgcttttgtcttgtggatttaagtcctaattaattgaaccaggattttgcagtgtttgtttgttaggacccttatttgtgataccaggagaaattgttgtgcccaattatgtgaaaaatcagccagatgtgtatgctgtcatacttttaataatccttaagtttttggtgagtacagatattaat

SEQ ID NO: 67343 - DNA, 1660 bp, Homo sapiens
atagaagtattaacttaaatatacttgaaagtagcactttcaagtataaaaagtagtagatattctttctgtagatattattcattcacttaatattctttccatttaatttactctaggattccttgacagagtaaaattgttgtcatcagtgtttgagtccttcattttccaaaatctgacaatttccactgatactcgtatattccaacgtttctcgtaaggtttagagttttcagatattacaatgaatgaagaatgacagtagcatcttcgttgctatcttcagttctctgaaaaggactccatgcgtacttacacagctgtcaaacttcttgataggttgaagatgctcattttagtgcatgtgtctattagttatttgatacattcagtaaaaacttcagcataattataagatatggaggcgggtacttgttaatgttgtctatgctattctatagttactattatgctcatgatcttatccatgtaaaatctgaagactctcctatgatattttgtatgcatttgttgcctttaaggatattcattcattccttccacttgtgacgattttgtttctttctccagaacataccgtaggactctctttatactactattcataagaggagatgaatgagacagagaatacacttctttaagattaatatagttactggtaatagtagctaatattatcacagtcctgtccttctaagattagtgttcgttcttaagattccaggaacaggagaacctaattattttaaagggtcttagagtgagatttcacatactggatcagctttaagactcctcttttgttgtaattaatgtgactcatcttgatattgctgatttttgttaaatgttgtaggcgtaatgtttataattagcactcttatagatttgaggttagctgagaagaaccttgacatttcattactgttttctagtatttccctctatgtgattttcattcaggttttcatctatatgcacctccttagaaatatctttggttattttcattaatggctgcaggcagtttttactaaatgtgcctgtttagtggaccatgcataagtatattctctggttagcagcagttttaattcatttttcttataaatggatttttatactttactaaccttttgtattagagtagacattgtgaagctaaaggaaaaacaggatagaattaatagaccaaataagttttaagattttcttgtccaaccctttttttttcagaaaagcagatttaaatcacctcatttatatttttgaaagctttcttgctcttaaaaaaaaaaaactgagcaaagtcagctttgtaacatatcaataaactattatgattcacaatatcagattttattttataaaccaaacaactcccagtatacatgcctgtttcttcttctaaccttagctaagatcagaaatactggtcacaatcttgagaaaactatttatgggcttggaaaaaaaaatcattcagtgatttcacaggatggtgatctcaacaatgaataagcccttcatttttctacactgggcaaattttttttttttttttttttttttttttggagacggagtctccctgtgtcgcccaggctggagtgcaatggcgtgatcttgactc

SEQ ID NO: 67344 - DNA, 2570 bp, Homo sapiens
aaacctaaggaacatttaaaaggttgaggaaagataaaaggaaataagccagcttcttttcttaaagttaatttttgtcatatactaagttagtctttgccaaaattaagaaaggattttgaaagagaacatttgaactaaataagaggcccacatgtatcagttttgcagtgattttgatttcctgcttaatgcttaatcagtttcatactgtgaagccaaatgtacttaggaaaccacaggaccagtttaaggcctccgtaggctcgaggtcatccacttttggcagctccacctcaaatcacgtcaaatatgttaaggtgcatccaagttgattaggtttattttgctattagattataagtttttaaaataatttttcatgttgcttttgtaattaatatgaaggcttttttagttctgtttcataatttgaaacccttgttttttgaaggccttacttacaatttttgaggcattttaaaaggctgtaggccctagtccctgaacttccagtgcccaaaggctagggggccctggcactccctgcttcaggggactcatgacctgctttttccctttgttttctttttgtctatctctagtataaaacctgaaaacatgtatgagtaagtgctgaaaactgacagcatttggaattgtgccaagttagaagggtgcgtagctgggtgtgtgtgcatatatatatatgtgtgcatatatatatatatgcacacgcacacatacacacacactcacacatacactgatatgtgtaagtttcctttggacaaggttatttgtctacatgaagttactgcaaacacccaaaatagtaagtcaagaagtatcagatacagcaagatgtaataaataattaaggaaaatagactgtccgtccaccttctcacaatcactaactctctgttttgtttcacagctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctgggtaagaaacgcatgtggggcttacccggggaaatggaatagagatggcccttttacagcagcaaggaaaaggttaatggtgaattctcctgttcaaacttgtttcaggaagaatcaccgcccatcttgctgaattttaaaaatagcctattttaccaaatgctgtaaggaatggcaatcagcagtctttatagattccacctgctcttgggtttcaaccctcaagcttcagaagcaaagatcaagagaatttagagccctcaaatgaatcactcaccacatgaaatgttattacttctaactaccgggatttttttcttccttgtgtgcaggagaaggggagatgggctaccaaatctataccccatggcagagctcagttatgaaatccacgtaatgatttttccttctgagttacatcctcgttttaatattgttgatctccttttcattggcttgacttacggccttgtttattgcttatactctagattatgctgtaaaaaaatcatactccatgaacatatactttgccacaaattgcagtcattggacataaaagagttaagagcactttaactggtaataagcaaagaactgttgacgggctgctaggtacacctccagtgagctgagtgtcttcatttatgatcaccagattgtgagtttcagcaaaatcctagtagccaggtttccatgttcaattttaatatagtcagcagatatttctatgttgaaggtggtctgaattagtcacctttagacaagcttactctactgcataacaccagctgatttggattcttgaaactgaattttcaaggacatacactatagcatgaggcaagatctctgatttacaccttcgggaagatgatgaatcaaagtctatttgaggcggcagactgcagcttttcagtgtaatgataggaagattaaagaggaaagataaatatgaaggacatttttgcttggtatgtgtgcacatatatgtatttatggatgtacatattgagctgctgcctcattactttacttcaacacagctgtagaagggaaattttttttattcattaagctaaaacataaccctaatgctcacatatatgtttttgacaagaggagtatcaattttagaaagatgtgtttaaaaccagtccatacaatttctaatctggtctgtgtttaatgatagatggctttcacgtattcatatttgtcactattgtggttttactccagattagacctgtagaaatagtaagcatgggaggttttagtgggatgactattttggtattttgcagatgtaccaaattcgcaagcataaatttgaagttttctgtctgtctgcttgtatcagagtatttgaaaatgctctttgcttattggagtaagtcattagcagcatagacttcaaattgactatccactcatccaccctttgactcatcatcgtttatggcatttccacaaaa

SEQ ID NO: 67345 - DNA, 1195 bp, Homo sapiens
gcctatacattgggactgtcaacatcaactaacaagacgagattatttattgaaccctcctacctacttctattaagtggctccttgagtttctgtgaggctgaccaaatagcttagctcaagggcaggtaagctaaagttggctgtgtctatcttccctactccatttgtgagagattcagcattcacaaaagctggtactctgacctttccaatacctcctcaatatactactcaactagtacaaagtactagaggctgaaaccttttgtaccacagcttttgagagtatgatgattccaggcttagttgtattttgtcccttgatctgtcttcgattaacagactcgttttgtagactacaaagaaaggtattagagccatgctaaatgttgctacttgtgttcattttctaatatgcctagttcccactttaatagatcccactgatcacattttaattgatggaaattttcctctgaccttttcttccctttttttaaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcgtaagtttccatctctatagttgtagatggcaacttttttacctacatgttgtcttgataaagagattgctaaggccaccttttttaaatttaatgttagatgcttaaagtttagtcagttctttagagggaagaagagacaggcaatcataatctttctacttaatagaaaccttgaatggccccttttaaaagtaaggcagtcttactttgcaatagaaattgattgtagtaattcaaggtgaattgcaatcgagtcccaaatacttagctgacacaaacaactcaacagggtaaggcaaggaaaatacagcattctgaaaggtaatccctttggtttgaagattgaagtttccaaggcaataaatgcctataagcataaaaccaagtcttctctcatcatagcctttggcatatagaagtgtccacatgctgaaatctttccaaatgtaatatcacaaaaaacaaaattgcaatggacttgtatagaatagaaatggttcatatcagtgtcagggcttagtaagagcaagaatcaaatctt

SEQ ID NO: 67346 - DNA, 1026 bp, Homo sapiens
ccttcagatgttaataaaacaagtcaagactgacaaaggaagttccgtttgtattttaaactcccaattcatcagggtctcctcctttagatcttctgtgagagtgtccttggtcttaatgtagctggaagataaaatgcagataaaagagccattgtctcagaagagcattaataaaaaatgaatgttgatcctaattgagtagtatttaaacatacggggtggaggcagcagtctgcagggagcatctgagtctgttagaatttgactctcgatctcatcttcctcctcttattacagggacctcaccacccagctgccttctgtgaatgtaaactgtcacactggaatcagaaaagatatatatagacatagtactatagcagattctcagctcttttgctatcgttgttcttattttgaaacaacgtactactattcctctatcttttcctaaaaatcttgtcataaaatgttcaattaactcattttctgttcttcccttttcattgtttgcctgtttctgtttacagtggttcttgataacttagttttaagttctccttaattcttaattctgttatgctggatataacagaaagaactcgcaatggtcaaaggtgaaagaatttgaacaaaaatattagtaataatagtattggattataaaccaaagaacaaaataaatatccatgagtccatactgatataattaaattactgaataaataaatgggaggaaagacaaatgtcttccttacagaagaatttcaatttaaggagtgaaagaaataaaaatgttaccacttgaacactgaagtaatttctgcagacaagatccactagtggatgctaaaattaacaagtgaaagtttaaggagaaacatgatagtttcacagcctccaagtattttcccccaaatatttattaattcctctggtggttttaacatacacatatatctacaaattctttaatactgctccctcttaggagatgaggataaattcccctcattgtgagga

SEQ ID NO: 67347 - DNA, 1018 bp, Homo sapiens
aggtgtattcaatggtggagacagggaaacttttccatgattttatgagggatgaacactggagcacgtaaaaatatgagaaatacataccaaaagcgttttctgtgtggatagaggcagggctaaatagctgagtaatgaaaagctagaatataaaggaaatacaacagcaagaatgcactgcccaaggttcccagatttggcatagcctgtatcttatagaccagaagccagaggcccaggaagactaagggccagatactggtctaggcactggagaaaccaccatgaacacaacacccaggttccttctctcttagaggttaaagtcacttctttcctttcctcatgagaaaaggggaaatttcagtattggtattgaattcctaaaaatagggagatgttatgattccttggttttaaaaacaggcaggcagaaaactgttttcctgatgtaagtgtgtatattcaagaaggggaggggcatgtggtaggtgggaggcagtccagtaaacaatatttcgagagcaaacatagcctagtgaatgccttatatttttcttaatgctaacagacttttcattcctaatataatggtttgagtgtgtgcgtgtgtcccaccaaagagatggagaaatactgtggtgttgttcacttaccttcatggcacccttgtttagtaaatggggtcaggcagtagactctccttccccattcccacccgattccagcttgttctcttgtgtaggtgtggaaagaaggatagtaagagaaatcatcatgattgtcatatgatagctgctgtttattgaatccttataatgtcaaacagcacgttcattgtctcgtttcatcctcgcatcagttacaatggttcttaatatttccatttttatagatgacaaaatggaggcttaggttaaataacttactcaaggtcacaaagcttatacaagttgaaacaggatttgagtctagctccatctggttccaccaccagagctctcatcatcagcac

SEQ ID NO: 67348 - DNA, 1122 bp, Homo sapiens
cttgaggtagatcccaaaagtgatttattaaccatgttgtaaaccaagtggactggattttagagaaagtgggaatgttctcttgaattcaagggccaaagtaagaaggatattttaaataaacgagcttaataaccttagatattattccataccaacgtttttattgggagtgggggtgagagttgggaatatgtacagggagataagaatgcccatttatcatttaacagaagaggtatcaacatttgtctgtaaagctttctttttaataaacattgaattggagctttgctgggccatcagctatccagtcagtgatgggcttcaaagaggccactctttccttccttttaaggttttcaccaataaagcaaatcctgtagttgcaacaagaataagaaggaaatgttctggaagaaaaggggagggggtgcccagaagttatggggaatagattgatatttatagacatcagcaatggtctgttaccaacatttataactccaacagtagcagattgagggctgaatcaacatttttccccctctgtaaaataataaatatggtaaagtagctctcagaactgcctttatcatagggataaatcaggacagtttgtgttgcaggagagacttaaaacttataaatatgttgccctttaggctactattcatcaaagtgtctgatatgaaatctagactaaaggcttttgttattgtgtgtctgcgtattctcttttagaagtctaaattggaaagagcgctgtcattttggtcatactggcctgctgtgctacttaaatgcatgtcccttttgggatgtatttgaagagaaggaaatagtgggagttgacgcctgcacacttttacacaaatcctcttcgtcgcctaaaccttccttgcagagggcataatttccagcaggaaaaattcagtaaataaccgcttgacaaatgacctattttggtgcagtcaactttcttcctaagacaccggagtagagaggttgttcttaaaagcctcatcaaatccagagggacgtagctttccttcttggtgctccaattcaaatgtatacaaataggcatggctaaagattctttcagtttgcagagggaaa

SEQ ID NO: 67349 - DNA, 1044 bp, Homo sapiens
gttaaagaagaaagcataccctactctttagcatgcatttcagggagctgtgagccctgtgtattttgtcaagccatggctttcatcgagtctccgtaacaacattagagcttggtggttgatgtgagctttcagggtatcaatgctgcataataatactaataggcaaaacaaaacagaaacttgtaggagcaaaagatgttgctatggcttactttgtggtggggcattgtgttgctggtcagcaatatgttcccgtctactcaagctggcttttggctaccaactgtgagatgtttcgttgctgacaagccttccccattctgtattttgccctcgggctcgcaatttactggatgcaatcttgttgagaaaatgtggtctttattagtgttcggcacagatcgacttttctttttccgcttctgcagagctagtgggatgcttggtgcagggaagaaacaggggacagatgacagtatgagggcaggaaaataagggttttcgggtgctgagaaccagaatgctggcttagtgtagagatgattggagcagcatctagggtagaaacagcttatttgtacccacggggcttttggcagcattctaatcaacaactaattgtcagagaaagatatttgtcaataaaaatacttgtaagttagtttttaggtacatgacaaataaggaaacttaattgtataagacagttcttgccctccagagttttatgatgtaatgagaacacaaaaataacattgatgctccccaaatcaccatgaatatgtatggctttacatacaatattttatttttcactgtgaggatctgtgcgtgtattcttgtgtatatttttctatctgtctccacgccgctttgtctgttgacttggctctgtttcattcatctaatgtattctacaaagagatttgtgagtggcatgctgcagctacctcttttccttctcccatatgctgtctctttaacaaatgcccacacatgtgactttccccctcctaatcctgatggtgcctattgttttaa

SEQ ID NO: 67350 - DNA, 1018 bp, Homo sapiens
cagcctccatggagagctgccttggtcatctgtctcctctaacaacaccctaggagaaccattggtcctcccatcacagctccccagagagcaaattgccaacactttcctagaaatgaatgagggaacaaagctgtgggcattctgggctatgtttttatagtgttgtgataagaatgcactggtgattgtgaacccaagttgctaactatagtgtcgtcagaacttaagatgcctcttatattgtgttcatatttaaataatgaggtctgacctttacatttactcataatcatgtatctaggtcatcacgtcacattttcaaaagtacaagataatatcctggaagctaaaggttccagccatagggtagatgcagctgggtttgaatcctggcttgggtaccagtttggctgtgcttccttaagcatgttacataaccactcattttcttcatctgcaaaataagattactcactgaacctatcccataggattactgtgacgatagcaaaaagataatccatataagacatcaccatagtacttggttcatggtaatcagcattacttattcagtaattcttctttttattaagagtctaccaaaaaaaataataaagcaaggaactggaaggatcttattaaatctagacaaacattttcaataaaactctaagatggatggcttgtgtgtctttgatacatgttttactttgtagagctagtttaaattgtgttgtaaacagaaggacacctaacaaaaaatgaaccagttatttatttaacctcatgattaaatgtcagtgacatggtgttcttttttttttcagttagccattaaatatagtattatgattttaaacttaccttttgcacatcagttgtttagctgaaaagtacattctttttatttattaggaactaagctttttttcattgaaaactgctgtagttatagacagctcatgtatttccacttaaggtgtaccttgtactgcatatttgccctggatct

SEQ ID NO: 67351 - DNA, 2515 bp, Homo sapiens
tttattgagggtaaatgaactaatgtatctaaagtacttagaacaatttgtagcacagagtaggtacacaacgaagtttacatattatgagctatattagtttttctcctttagattataaattgtgttcacaattgttttcagtgtgaatgtgtctattaaaacgttttagtaagttctaagtgttcgatctgattttaagcctgaaaggtaaagtcatactctcctgagtccttcgactgtataaatcagggggttggcaatttggtttctgattccttggcattgactgatcaacatttggttcattggtgagcatttaagaaccaccagtgagagcataagaaattagcaatccttcatactgtcaggcagcattgagattgagctgtcagaggctgagggtgaatgcttcgttggattgactcactgaaccagctgtatttctttgtcttccatggcattcttggatagagtccatttaactaggaagtaaagactttggtcagttcatttaataagaacgaacttagaaaatcctgcattaaccacttagacgtattgaaaataggagaacattagttatttaactaaactcctttaaaaatcaaaaatattagggcatgaaataatacataatacctttgactttaatgcacaccctacattgtaactttaaagcattagaaaatgtttgtattctttcttttttaaaaaaaattaatcagagtgactggggtggttgtagtggtgaagaaaaaatagaaaaggaggaactagacatttggaattgtgcttggttacagtatgtaaactttcatgaatgtgctttattcctttttgaaaactatcttcctcttacgtttttcctttctgttttttttttttagacaaaccttgtctgactgactataacctttaaataattggtaaagtagagcagtgaaactgacatgaaaatctattgaaaagaaatggaagccgggagcattattctagtaaaggactggctagcctattgttcccttctcttgtgctgtgtgtgggaattatttctgctggcaacagacaacatcgacagtagtagtattaaaataattcacatctatttttgttagtaataatgtaatactggatcatctctaggccacaaaataattgacccatttctaggagcagaaagtcttcaaactacaagtgcttctcttgtctgcccacgtctgctttctctgcctcctcaccatacacacacacacacacacacacacacacacacacacacacagagagagagagagagagagagagagagtgtctgggcttgtagatcttcaccctggttctcacaggcccccctgcctggaacgccactttcagcctcaataattttaccatttttcaggagcaagtctaggacccgatcccttaaagcttttcttcacttgtccattgcattcagtcctattcaagagacatttgagcactggagataccacgctgaacaaggtgggcaagcctctgtactgagacctcacagtgtagtggggacttgtaagcaaggccaggcctttacagcagcatggtagacactacgacaggtggcacagggccctgtgggagccttgcccagaccttgcctagtcttctgcaccgatcccactttgccctgaatgtctggcgtggctttagtagcttccagggaagttggcatttaattttttgctgccttgcattgttttctttctgtctgttatctccctggctggatggtaactactttgaggataatggacttcattttatttttatgctgcctttttaaaccctatagggtcttaaacagcactcagtggatggtaaatactcagtaaacactcactgatttgcttagaccctcttcccttccctccacctctgtggctttacacagggatgacttcccctcactgcgttccttccaataccttctataatttgaaaatggctggcctctgaaccttgtttgcttaggggcagtgaactccagctgattatagtcattgtcttctggccctgggttcttgggcagcaacatgacttccttctaccaacctatcctttcttcctcagctcccatcgatttaattatacttcaggctctccaggcacagatctaccatcacctctttttgcgtagcctctaaaatgctttcctctttcagggactgttttcctaatgagggcagaatataatttagaggcttaattttagaaaactatatgaagcagcagacccataaaatgttatgattcacaaccacttgttttgttctcataatgcaacctaaactaaaaagccattcatcaaagctataaaagctgttcatggctgtctttagtatatcgtgtggagcataattcagcccacagagaggctaaagatggattcatggggccatttgccttggtgtacgttaaaggccagtaatttctatgctctgtagaatactgtattttactataaaccctggatttt

SEQ ID NO: 67352 - DNA, 1383 bp, Homo sapiens
cttatggctattgaatttaacttaagcaaaattcaatacaattaaaaattcagggccgggcgcggtggttcacgcctgtaatcccagcactttgggaggccgaggcgggcggatcacgaggtcaggagatcaagaccatcctggctaatgcagtgaaaacccctctctactaaaaatacaaaaaattagctgggcgtgatggtgggtgcctatagtcccagctactcgggaagctgaggcaggagaatggcgtgaaccctggagacagagcttgcagtgagcggagatcgcgccactgcactccagcctgggcgacagagcgagactctgtctcaaaaaaaaaaaaaaaaaaaagaaaaaaaaagaaaattcagttccttagtcgctgtagccacacttcaagtgctcccatatgttgagtgactaccatattggacagtgcagatacagaacattttcattgtaccagaaaggtatactaaacagtgtcagtgtagatcgtccaccattcttaaaggtagacaattattacagaggaaaatctgtaaataaataacttgatttatttatttttttattttttgagatggaatctcactctgtcgcccaggctggagtgcagtggtgcaatctctgctcactgcaacctccaccctgcgggttcaaacaattctcctgcctcagcctccctagtagctgggattacaggcgcccaccaccacacccggctaatttttgtatttttagtagagacaggttttcaccatgttggccaggctggtttcaaactcctgaccttaagtgatctgcccgcctcggcctctcagagtgctgggattataggcgtgagccaccgagcctggcaataactcttatttttcatctccagaaacgtttaagcttttctggcttcttcagttcttcctgagaacagtcagctaagcaaaatcaacatgttccttatcctaacctgggggtagtgtgaggtttacaggaacaggagggaggagggcagctgaaattgaggctccctctgagctacctgagtcatctgcctccagtggagaaggtcaagatgggaaggttaaagaggaaggtcaaggtgggaaagctgagtaccaatccactttttcattcattgtttccagaaactttttttaggcattgagaggcaattgcagtgaagtaaatacaatatttttatctgtagtggaaggaaacaagggtcaaacagtgacagggcagcatgataagtgccatgatataggaatgcctgagagactgtgggaacttggaagacattgtacctgactgccctgtgaagtggggacaagggagagaaataggaagaggtacatcagagaaggaccacaagttgtgtgg

SEQ ID NO: 67353 - DNA, 2027 bp, Homo sapiens
ctgatgtctgttctgcctgatacacatatcccttggaggattgaatgtgataatgacttggtatatcataacatgccatacaagtgtagattattattatttcaggagaaactttgtcatctctgaatttttaattattactaatttgaaatgttctgagcacccgatttgttctggcttccacatagaatttaaattggcctcagataaggatgtgccgtgcttcccctctttcatattagggaagttgaggcatgtagatgtgaaattgactgctttttgttttccattgaaatcatttctccttgcatactattaatgagcttactatacttggtatcaattaaattcacattgcctgaaattactgcatgaagctacaaaaaataatttcttctgacaatgaaatgatacagtcttacaggtacttttagttttaatgtaaacatgactgcctctgatccatttaatactcccatcttggtgtgcttgtatgtatttggaatcccttgactttagacttgaacaaggttgtcagcgactgtgcggaagtaagtgtttttgccatcacaccaggtggatgacccctccagctgttgtttcagtgggtggtaagaaacagaagacaagcccctagtcttcattattcttaggtgtgaaaaattctcccaattgtgttttccataggttcccaatataccaattacttcctaatgtcatgcagacacctatattctcagaaatgccaaagaaaggctgctctgcaatctctcagaattattttcccagctgaatttgtcagtccaaatttaaaagagcaacaggcaattaaatattcatttttaatttttttgtcactcactgctgcaggtcacaggttttataagatttctctgactgtgtagtactgtatactaaaccctgttttgatagtattaattaatattctcttgcaggcccaagtgagggtgagagagagatttggctgggcattttggtacagcaatgctaatttataggcctgggcagtggaatattatggaagtgtgtaatgataatatcaaaactgcatttaattcttgaagaggaaggaaggctagcacatgagagacagaatctgctgttctctttgtaagtgaaaggtcatgctactgagcgctgcggggtggattggtgagaaatgagctcccgtttgctaggaattagaatgagtctatctgattttccttcacttgtgacctttaaagatgcagcttttagattgataagcaggtggatgcttttagtaacccaatgcagaatttgtttcatataaaaagactatctttcagacactgaagatattgcttccacaaagggtttttttctacaaagcctctggagaaagaaattcagtgattatatcttatctgtcacacaaagagaaaattcagaattactgtatgttcaattagaacatttttttttccctcaaagcattaatcatttcctggaacacacatcctccagttaagaatctctaggaaggcttgacagtgggcactcctcgttgctctcgcctctggatttcctgcgccactccacagagcctcctccatgcccataaaagagcttcctatgttgctatagtaatcctttcatgttgggcactacgctatcttgaaggcaatcagatgggaacaaggagtggggagcagtatagagttaatgtcaggcagctgaaggtgatctgcgctattctatttggagatgttttggtatgctgaagacgggatgccagtcaatgcaagcccttagcccactgtgggcccaatttgatgtttagatatttaaatatagagttttttatgacacttgtgaactctaaacaagcctttggatttaaacaagttgaaatagcttactttccatagccaacaagctcaaatttctcttcctctccacttgttttctgttcgtaattacatcatccatcttatttgttctaatttcctccttttattttccttatctccccagccatcaac

SEQ ID NO: 67354 - DNA, 2348 bp, Homo sapiens
aatagaaaatgtctttatgggccaggcacagtcgttcatgcctataatcccagcattttgggagtctgagatgggaggattgcttgagcccaggagtttaagaccagcctgggcaacgtagtaagaccctgtcttactaaggccaaaaaatattagctgggcatgggtgcactcacctgtagtcccagctactcgggaggctgaggcaggaggatcacttgtacctaggagttccaggttatagtgaactatggttgcaccactgcactccagcttgggtgacagagtgagaccctgtttcttaaaaaatatataagaaaagaaagaaaatgcctttatgaaaggcggagcccttaagttaagcattgacaaatgaggaagatttgtagcatttaagaatatagtattaatagttgaaggtattctaaatagaaggaccagcattagataaagcatagaaacaggaaaccccaagtcatggtgagagaacagtatgttgtaggctagtttgatcaaaaacctggagagagtaattctatgagaaatcatgctgaaaaagcagattgtagtagatcctttagagatttgaatattatgttaggaacttcggattttcttcagtagaaagcaggaagtagaagtaattgaagccttttaagaagggaaattgcagaatttatatatgtgtgtatattatatatgtgcatatacatatatattatatatatatatatatatatatatatatatatatatatatataaaatatcttgatcaaagcatatagtatggattgcagacggcagagagtggagcctgggagatcctaatagtccaacaaggagtactgagtactttaaccagggcagaagcagtgggagagagacatgaagactgacctcaaggatgtggaatgtacaaaggcagggcaagtgatcacaaatgagggagtgaaagtaacttagagagaggccagaaggaagagcaggtggacgtactgatgtgatggattttgccgtgaacttgttgaatgctcactgatgcaagtgaaagtgcccaggactctattgtcaacatggagttgggagtggatgaaatgcgtcagagtgtagaaacaattcatggttgaattgatagcatctgataaaacatctctaagcaaactagattaactaataagcattgctgtgtcattgagctgatataattctttttgttgttgttgttgttgagactgagtttcactcttgttgcccaggctggagtgcagtggcgtgatctcggctcactgcaacctccacctcccaggttcaagcaattctcctgcctcagcctcctggagtagctgggattacaggtgcatgccaccatgcccggctaatttttgtattttttttagtagagacggagtttcaccatgttggccaggctggtcttgaactcctaacatcagatgatccacccacctcctcctcccaaggtgctgggattacaggcgtgagcactgcgcccagctgagctgacataattctgtgtatgagtgaggaggcttatcacaagtaaaatttttatttaggctttttgagatctttttgaaaattttataatcacctgaggcttccctctctattttattaccttataagaaccctcagaagaatagccacatttaatgggcaggaagcaaaggaggaattggaggtgggtgtggtacaaaaaaatgaaaaaagccagaggaagaggaaggcccttcccaaagttaaagggagagtgctgaggtgggagtgggtcagcacagtattaaatactagaagagatggcggtagatgagaacgggctattgagtgtaatgtttaagaagaaattgtttcaagagagtagtttcagtagttcagttgcattaaaatggtaagagctgaaggaaggagggtttggtgaggaagtggaggctgtaggtgtacacacaccaccactggagaacaggctgtgtttctcagtggtgctagcagaggcctcctctggcaaatgcatgacttgagaaggcagcccaggttccttgtgaagagtctagaggggtgtggtaggggtcaccagaggctacgtctggagaggcaggctcatcctgatcatgtttcctggccagtagccatctgagcattgtcctggttattacctgcactgctgagatacttcaccccacctaatactccaaactgaacagtggtgggtatcaggaagccatcatgaatctcaatatctgattcttgcttgtgaaataacttaagatatgttgttttaatttccttatttacctctctaaatcacagaatctgaaccctgtgagttca

SEQ ID NO: 67355 - DNA, 1043 bp, Homo sapiens
tttctctataagacacctgctggagatgagagccggcacaaacaccgagtaggtatccagggcttcattacagcagtatctctaatgatcaaagaagccttttttatacaatcttgttcctgatcatgcagctgaacatctgtctacctgtctgtccaccttttaattgcatcatccaggtctctctgatcctagacggtctgtcagtgcagctctgctttccaccatttctgatcatagttaacacaaaatttcccacaaagcaaaacagtaaaactgagagctttctaataaacttgaactgaaccattttatgagaagctaattttctattgcatatccagtgaaacccttgtgctaatttattcttcaaagccaaatactgtatagcaaggaggggaatgtactataggaatacttgaagcattatatttactggatacaaaagaagcttgttctacatagatgctgcaatctgctaaacactgatttgttttaaaaaattggcagtagaaagtcaggaatttaattcactgatttatttatgtattcccttgtcaaatacttattaagacaaacccattatgtataggactgtgtgtgattcaagagtgagatactgtccacactctaaagatgagattcatgtagattaattataagagaaacattatacattgatttctataagaaaatactcaaaaagcggcatggtacttgtctcattctgttttgtcttgctaaaacagagtacccaaagtgagataatttataaagaaaagggatttatgtagttcatggttctgcaggctaggaagtttaagggcatgtccctgacttctggtgagggctttcatgctgtgtcataacatggtagagaagatcaaaggagatgcagacacgtgcaaagaggaggaaacctgaagagtgtcctggctttataacaacccactctctagggaactaatccatttccacaagagctaatccagtctcaccagagtgagaactcactactgcaaaagcagcaagaaccagcacca

SEQ ID NO: 67356 - DNA, 1040 bp, Homo sapiens
tagcagtgaacttcacgggcagtcaggcccagtctttcatgtttccttccagttctaaattgaaaatatttttttgaaaagaactatgacaaaagcaatttgagttagtgatatcttgaaagagaacccaatttaagattacctttatggttggtcattgttacctacagtaggcagatgtcatggtgatcttcttgatattagtattccgagagagtctgacctggcagtgttcaggtaacatcagagagtgggctataatattgagatttcaagtggtggtgcaaagggctgctcacggaaagctagtgcagagagaaccactgtaaccgagaaggagggcagccagccattctcctcatccttctatatttagtaaataccacgtgacagtgagtggctaattaaagtgtgttgggagtgagctttgtaactgtaaactgtagagaaggaaataggaaaacaatggtgtcttcgctgattttccaacctgtaacttaaaatgttgcatctttccaactctttctcaaaaactcaccacgctggtaaaatgtcatcatatctttcagatttgtgtcattacaattgtaacaggatcaatgattcatgaacatacggagctaaagtctcttacaagatgaagtggtgactaggaggagaagttattgttaaagaggaccatctgtctttgaaagtgtgatttactgaggcattcacctctgccccaagccatgaaaataggatctagtgactgggtctcatcgtctttctcttcctgcctccttccctttcttcttctcctcattctatccttagagccagaatcagtcaagagattcagtaagaaatgatgctactgtgaatcacatagcttcttagagcatcttatttacgttcctaaaatccctaccagacaaataacaagtgttaaaattgtttctgtgtttcagatgaggaagccaagacaaggagataaattggcatgcccaatacagaagggtgtcagtagcattgctgagacttgtgtctaagtctctact

SEQ ID NO: 67357 - DNA, 1711 bp, Homo sapiens
caccgtggtaatgtgtttgtatgtgtgtgtgtgtctgcgtttactgaatgctttacctgatatcatttttacatgtacatatatattttcatttcattttcaaaattatacagtaacattttattttgtgtatgtatagttctgaagttttaagaaatatatatgttctcaagacacagaacaattctgtcacaacaaaaaacttcctcatgatctgtgataagcattttgagtgcattgctatttaattcttataatgttatggggtgtgtactgttatctcttttttactgttttatttttaatttctgttgaggaaggtgagacttagagaaattgaataagccaaagtcacacaccaaatgaacagcgaagtctggattggaacttggagctaagttctgtctaagcctagaattccagcttttatgcactgtatcatattactgctcacagaacatggcttgggggctatatgatcagtaaagtacaaaggtctacatgtcagttttatatgatataaatgtgatgttgcaccttgtagatgatcacaagatatttttatgtgatgcactctcaaaagactctgaaagactagggttattttttatttgtttgttttgttttgttttgacttcaagtaagactagtaagaggactgaattgaacatctcaactggaaaccattagtgctctgctcttcaaactaaacttcccaacacccaagtctcattactgtcatgcctatttccctcccgggctgtgtcatacacatagaaagtgaagctgggctttttcatttgccatggccaactcacactatcctatccctcttttgaaaaaaaatagaacccttttcagtagctgtgggctcttctgtgagggtgagtcagctttaggaataataaccacaatctttcatccatgccttcagtctaatgtgctgatgctgaaatcatcctaaatatcaatacagaattttgctttagactagggattctcctgccctcactcagtgtaaatcccctgaagtacaagagaaactgtgagcaataaaggaggtgctaaagttctatttgagtggtgggggggcggtggaggcaaaatgctttgctcagggaaaggctagtgcttcatagatggttagagaaactcccttctcctcggaacttttgcaatttggagcccaaccttaaattgagctttactaggacaaatgtagttttatgaccagagcctacatgcatatctcacagttttaaataatgtattcacctcttccggatgatcataatcagtgatgatcatggtgaaactatgaggaagcagccctccatgtgctcgttttcttgttgtctttccatttcatagttttgcttcttaattataatgatgctagacataggctgttaaggtacattgtaaatagggatacgagcattccctttgtataggttgagaaatattactccagcaaattttgtttcaagagttcttcaggacagaatttcgatagtatgtgctttctgtgatatatatgcttaagaagtaagattcactgtatattggtataaaataaaggaagccagatattaacataaaattgtattttggattctttgatgccttaattttatctttctcaaggcagcatcttagaccttcactcctgtgagtaaacacactcctgtctaaagacagatgatgggat

SEQ ID NO: 67358 - DNA, 1031 bp, Homo sapiens
tcaagttcctaaattgagatgtgacgtttacctgtacactatgacaaagtgccagtttttcttgctttatcttttacagaatgctgttagtttgcactaatgacctatgagacccatgcaaattacacaatcttgcaaattagtgagtatgtgaacaaacactataaaactatcagatacagaatcaaataaatgtagtttattgcaggaagaaaaatagacttgcatatggagaaggaatgcattttcacaaccagataagtgctttcctgttgtctgcttgcccaccggggagcgtcaacacattatatgatctgtggcagccaatgacttactggctcttgggcaaaaacatcattttttcaaatgcaggcatagaaaatctcagtgattacatgcatactggaatctggtattgaattgtttcccttatactttgcctccttaaaagtattcccctttccagcttcatatgctgaacgtttacactagaaaggaggacaggatttaaggttattaagaagagaatgtatacttggctggcttttttgtaccacacccatctgaacctgggagattatttgttgccccccttttgggggatgaggtagaatccagcccacacacccagcagcatacactctgctcatcaaagcacttttctcagttggtttgttttcatgtctagcagcagaaatagctgctctttttctttccttttttcttctggcatcttgtaattgcaactggtaatgtgtcttcttcctaacctggaagcagcacagagatggcaacattgctccactcatacacagccttactcctggctataatccaatgctgccaccgttgggtcaccaatggtgacccagtgcatcaccctttgtctatcactccatctcccttcattgagaacctttcctgggccaaccagttgcctcctttatttttgtcaccctggttacctatattctatcaggtttgctaatgacaataaccccagtagcaaaaactatatcaataatgaacat

SEQ ID NO: 67359 - DNA, 2459 bp, Homo sapiens
gttctgtaccaatgactatgaaaaattttagaagaattctgttatatctatgtctttaatatagaactgctagaagtgagtagatgaccattaatcttagtaggtgatgtagtcatgcattgcttaacaacagggatacattctaagaaatgtgttgttaggcaattttgtcattgtgtgaacatcactgagtctatttacataaacatagatggtgtagtctactacactcctaggctttatagtatggcctattgctcctacgctacaaacctgtacgcatgttactgcactgaatactgtaatcaattgtaacacaatggtgtttgtgtatctaaacatatctaaacatagaaaaggtacactaaaaatacagtattataatcttatgggaccactatcctgtatgcagtccatcattgaccaaaacattgttatatggcacatgacggtatgtgtgtgtgtgtgtgtgtgtgtgtgtgtgtggtatatatcctctgcaaatatcccttaattaaaattttgaagtttagtaatgcttattgctgaaagtggtttgatatataggaaaatgtgtaggaattctatataatcaaaattatatattatagtgcctgaaagtttacatggcatattctttttttttttttttttttttgagatggagtctcgctctgtagcccaggctggcatattctttttacactgtagcagaatttgatcagaactaaatatcctgaaacgaatgactggctggtctgtttctagctctaacatgagtcactaataaagtattttggtgcttcacctttttgaatgccttagaattctaaggctgttgcccatcctaaaaaaatctcaagtcaagatactagttccctattagctgcagaaaacacagaggggaggagggagctagtgctggtagaagaaactggattttaacagaactttaaagaatgcctctttcattgtggccagccaatgctctatttatcccttatctcattgtgctgtggctctccaagctagagaggagagaaaagattgagaatcaaggtgcagagaataagcagtagagaccaaaaggacaaaaaagcaaaaactgactagaggaagcagaggactgaaaacacagaaaaggagaggaatttcaaagacagaattggatagatacatattaaaaccagtgagagaggaaagtgctttctgataatgcgaactgggttgaggtctgtgtatataatcagatacttgtctgagctggaaggcgcccgtaggcaggagtccagataatcttgtggccttctgggtgttgcatggcaggtgaggctagaatctaatttttttctatctcaacatcatctcatattaagcacttgtcaagctttgatttgagggctccgggtgatttggatttcggtgttatctctcagaagttggtttccccacttagttgagtgagttctcatttcaccatctgtgagcttctatgtctcctgtctaggtgtctatttcgtgcatggttgagacagtctgtgcagtcttgaattgtacttgtgactaagaggagtagtcataatttaccattcatttctgtcagagatggacagttgataggtttttgccattgtttacataatgattccatacagccataagcaaaaaggcagtgacctcatattacctggtaatttaactactccaaaatcaaggacaaaaactgtctgacaataggcacttaataaaagtgaagcttgtcatttgtttcctttttttaatttgagttgtgaatttaacatttgttatgttattaatatttataagcgtatgtaacagggttttatcttacacaattttaattctttgtatacctgtttgtggtatgatatccaatcagattattgctttgataattctaagatgaaatgcatagggagtaaatgtgtcatttttagcacaatatctctatttaagttttctttgaagccaggaagtttggacataagctgtttattatgccatagttatatctcttcctaaagaaaaccaccattgaattaacttttgcatggtgtttttctatcaaagcatttgatccttgtttctgcaagataatcctaagaactttttattttgagaatagaagaccatgatggatttaattcataacggggagctgctgcaaggaatgtaaatgtaagcgcttgataaggtaggatttcctagttgctatggcaacctttgggtcatgagcctgagaaaatataaagtaagtcctgaagctgtgaagatgattataaaatttaactgtcattcttcatttagagttgatggcaaacattatttacttaagtttatctcaaggcaggcaaagatccattttttaaaatctgagactcagatcacaaatgaatccatgttgcacatgtctaacattataaagcacatgcagcatt

SEQ ID NO: 67360 - DNA, 1082 bp, Homo sapiens
gtatatttattgagtaaaaagacagataaagaattaacagtggttacaatttctgtatatatgaagcatctaccactgcctttgacttaaccctttttatgtctgagcttcaatcatgaggttttcaaaaattatttctagaaagcaagttgggtttcttcaatagacagtggagtgttttgctccagagtactgaaatattctgttgtgatgttggaaactttcaccaattaaggacaaaaaccttctcataggtgtgtatatatatatatatatacacacctatgagtgatatacacacacacacacacacacacacacacacacacagagagagagtttgtgtcttttacaggaatcattttaggagttcatgtagacttattttattgaggctgttgagcaaaaattttttttctacttctccttgtgaattttatttgggtattatttgaatagtctcagaagtagcagatctttattttttaggataatttatttggaatcagcccaaagttatttggaatcatgctgttaaggtggacactgaagttgtggattttaaaaaagaaagcccagttgtagctatcaaacactagggtataggtgtgacacattgattgtcatagaaggaaaggatataaggagtagttgaaaatatgcaggaccaatgacagtaatgttggaataaacatatgacccttcaaggcaactattgtgaaaggtaatcctctcttaaaattttaaatctataaattccagtgatttttcttcaaagttttaaagtctcaccttacatagactcaaagactgatgtgcaacagcaggacaagaagaacctgaatacttaggatctagttaatcctaaagacctgaagcaacataaagatcactgtcaaccttggcattagcctattttagtaattgggtctcagcatatatatatatatatattttttttttcctggcttaaatagttgaaaattcatttaaaaatgttcttctgatttttaaattttgtatttatattttttgtcttcttgtctcataggaaacagggtaactgcatttttggtgttctt

SEQ ID NO: 67361 - DNA, 1126 bp, Homo sapiens
aaacattgtctgattttctgctcacattgtttagagaaattatactcccagccatctcttggctgctttagggtgaaatatatcaaaatctttggacattttaacctgtggttagactggctttagtctcttctgctacgttcccacaaacaaagggttgtcagagttcttgctatgcaatatattctatttttaaggtaggatttagattattagtcatctgatgttttaggtgttagcacaactagacacttaattttggttttgtgccaatacaaatcacctggagttttatttttggtaaggtggggacaagaaatcaatcaagtgtgttctaagctctttgttttatgtagaatgtaattttattttaaatatactcttccttgatatatcttgttgctctaatattgatacggcatgaagtagaagtaggtgtttttcctgagtatgatttactataagtcctgtgatttcagctatattgaggctactactaatggattagtacattccagcagtgtatttatttagcatcctaccctccggtaatcaaaacatgagatgcttcagtgtagaattgcttgctagaggtgatggagagaaaacacacctctctagtggtgatattagtctgttttaactgtcttgtgaatgtgcttaatgtctagggcatgttaaattgagttatccaaaaatagagtccctgaaatttaaataaagcggcattggagcaagaaactaatcattctttttctggtagttaaccaattgccacctttcccggctcacttattatagcagctcctatggctgtcactacactgtcacattgttctgtaatactctgtttacatttctctcttctgtaccagactgtgagcttcttgtaggacgggaatgtgttgtattcatgttcatggaactcctagtcactaaatagttgatgaacaaattaaaagatgaagaaacatattaaatacattgagtaggaaaatcttatccttgtgccgataggtgaaaactaatctgatgacattcctttaaagtttggacaaataagttggtattggtgatttctggatatagggaatctttttgttgcccatcactgctcatctgatta

SEQ ID NO: 67362 - DNA, 2826 bp, Homo sapiens
attaaaccaacaccgggaagcaagaggagagaagcatgcagaaaacaccctcccagttgaatgaaaattgcactgtattatgacttattccctttttagcaaaagtatgggctttgtggtaggtcaagataactaaaatgggaaagaaagaaacaattgtgtttttaattcgtgttgctccaggtagtgggactgagaaacttttcctctttttcaggagagttgtgacacgctatagtatttagatactcagtttgtgttcccatttttgttttgtttggtggtgttttgattattccattttttttttttttggctaaacatatgtgatgtgtgtttaattgaatttccaaggcaacgatacaggcacctgtcaaaaagtatatttaaagatacactgcaggttttctggagaggtggccatgtgaatttaacaatctgcaatgagaggggaaaaaaaagtttctgagtttgtataagtagttgagattcccaagtaaaacagaatctgttctcatgcagttttctgggctagtttggacaggagctggaatctcatttttatacattaacaactcttgttggatttctctcatttcttcaggacaagtcaaaaactttgtagttctccacaatgaaaatgtgtcgtgtcccatcctgtccttttgccatcttttctatcaaagaaacactaattataaaaattgaacataaatttgtactgtttaataggtttgggtttaattttgcctcagtgggaagacgtttccattaaaagagtccttttttttctcttcctccctcctttttcttttggtagaacagttagtaaaggcgtaggaaattgattttagtgtcacaaaggacatttctgacagggatgtactttgaaatgattcaaagcatctgtttctcttgcatatgcctagcactgctgagagctgtacctagattaaactgtttaacgtgtcaactccaaatccgatcacaatttacatcccagttgcttggttggaatttttaacatttcatgaactttctcccctaatttatgaaacaagcttctgctgaaagtgaccatttgttctagatgccaatatgtcacagtcaaaattgacttagcttgagaagttatttgtttttgtatggtcattttgcctatgaaacaaaatcatctttgcagtttttattcctgctggcagggtttgtgaatgaacgcttggtgggtgtttttgttaccatttgccttccactggtgctatgtctgtcatacaagctggctcagagaattccagttttaagagtgtctgagcacagaaattatgggcactctgtttactaccatatccatgacatccagcatagtaccttggaaagccacctaaaataaatctttcatatacaaacgaggaatgagcactttctacatagtcatactgcatagtcttagtcatagactcttgattctgagggctcacttatctactctgcttatgtttctcagaaattagtaaggctcacttgtattacttatagtgaagcatgtcctttgaagttgaagggcaggggcaattattttatgcgtgtgaactttttatattcatagaagaaataatttactggggatgagaagaaaaggcaaccatgttgatgcataatagggacccgagctcattaacttaattgtttagtggctcctgactgttcttctctcccccagtgtccccccatgtgccctttcacagtatttccccatgagctttgagtgaagaatcctgagaagggcttctactcttgcctttccctctgctaatacgagcatagtggtggcgtttgtacaggttttcctggggtactagttccccagtggactcacttgttgaccttgaagatgcatggtcactcatgactagtcagttgagaacattatccataatattgttatcaatatcttgcatctctatcagcagttctctgggattgtgttagtgaggatagagagcttcacatttacaatagcttgaatgtttggaaattttcttaccttcactcactagtctagggtgggtggtccagatctatggatgggttggcttcatctagttgttcagtgacctaagttaatggcagctctgccaccttttgcatgtcactctggaggcactctggtgttactgtttcagcttcccagaaggaggaaggagaaagtacaggaggagcaacctcaggcactaggctggaaatggcacacatcaattctgcccacatggaaaagaacttagtcgcctggctgaccccgcttcagggaagaccaggaaatgcagaggagcaggccagccttgtgccaggctgcatggaagaagaggaaaatggatttagtggacagttagcagtctcttggaccttaggtttttcccagtcagttagctgtccagcagctttatattgtaaagctagttgatcttagactttaaataatatctagtactatctatgataatttcccccctttaggtttctttgggtccaagctatttataaattgtactaactggcagagcattcagcttaccttcttctggttaatgtcaaggactcagtagtttgcacagacatatttttaccctttgaagtgataaattaacatttgaatggttgcttcatttccttccacttttttatgtctgggacacatggtagaatagggacatttttgtagatttgtgatttcttcttcatttgggaagatattgtatgtactactggtatgctagtcattcactgtataggaaaacccagaaggcataatcactgttgtctgcaaat

SEQ ID NO: 67363 - DNA, 1677 bp, Homo sapiens
tagggaattagtgacacagctgtcatggttacaggatggatgtaaatatcctttgcagttgatgatgaagaacagtcattagcctcctgccccttgggaactggtcagaggaacaaaaataaacttaacacgtgatggtaaaagccattccttatgtctccttttcttcagtatgaacaattaacgttctaatagaagctgcagagagcatgtggatgaaccctctccactttacaggcgtgttagtgtgataaatgttccttcgtgtagggcattggttgttcacagtttataaccactcttattagcttataggccagttaaaaactgctctttagagacccacaggccctatttaaatttttcgtgttcatctccaggtgttgtgtattcagtttgaccctttaaagactgtccacggttggatttttgcatgctgtctgcaaggctgcaggggcaattgaagatcaattttctgtatctgggcttacttgcttgtgtaaaatatatattgttatgaagaagacctagatgcttatctgatcctcctttatagtttttaaaagtcattgaaggttgaggagccgttttttccgccttcttaaaataaatgtcctaggtgtttaagtgtgcttcgtatttatattcattccacttccttggtgttttgatgttgtttttcattgtaaatttgcttaagcaatcttttgtggagtaatttcataacatgcacacactgtggttttacattgagttgctcgtgatctgcaattcattaacttttgctgactaggaagtcagtatagcacgttgcattttctctcactttatcttgctatatagtcagttttattccttgtaaaagatgttagtagaacacttccttaagatggcttctcttgctgtctcatatgctaaatcttttcctctggtccaagtcttctcagggccttaaggagagatttttggcatttgtatcattgcattagaggtgaccagatagcgtcactaaaggaacataacagttttctgggttttagctcaaaatgactattcacggtaacactatacattttaaggatgaatttattgctgcttgtgtctggataagattctttgcatttgctgctacttttgtgcccatgtctcctcttggctttagcaagaggaggtgccaaatggaaggatcggaattccgcctcggaactatcacacactgtagcccaaacctctgcctcttccttttctattctttggccattgtggaaagaatgaaaactatcaacaagctgaacaaggtgaacagagccttgttcagatgtttaaatgcctcctttgcaactgagttactcactctcccaagatgaacttttctcattagacatagctaactcactgtggagatgtttctagctgacttgattgtgatcagacattataggatgcaaggtaattgctgaccctaaatagtaggggtgagtcccccaaagccaaataacttgaaaaaccttacatactgagcattttaaaaaatgtgtgtatcttagtccagtaaatgacaaaatcctttggaaaatgggcattattctcaggcatgttcatggctggccaaattatttgggttttggtgggatatgactctctggagactcttcgcaggatgcctgtctacaggag

SEQ ID NO: 67364 - DNA, 1607 bp, Homo sapiens
tgcttcaccatcctcagttggtgacttttttactgatggtcatctcatggtccaagatggagtttttgccagtgctgctgcctgttaggcagcaggaaagacaaagaagagctgcttttggcacaaccagtttcttttccaacccacgcaacacttcctcttaaagctcatgacctagatgtgagggaggtaggaaatgttatctttaccaggcacagcttaaaaagaggggttctgttaccaaggacagaaagaagaatggatgtttgtgaggcaactagcattctctgccatagtgaccttggatcctttcatctcattgagcctcagcattcttgtctataaaaaatggttgtaaaaacaggatctaattcaagatcctattgttttgagtatcaagtgagttaatgcatataatgcattaagcacagtgtctggcatataagtaagcaataaatgttaattattattcttgctacttccttaatatctctaggttaatgtcctatagatacttaaaatgcttatgtgtattacagatccttactgcattacctagctcaccacctacctattccaacaggctggaaacctcagagcaatctttgagtatgtctttattgctgtctgtacctaaaagtcatcaagtataattctgcctgcaaaattcttcatggatttctcaaacttgtccctccatttccattcccgtatctgaattcaagccgtcatctttccttgccttctacccgtcttcactatctacaagatcacatccaaactccttagaatagtattcatgtcttcatgtagtctgattgaagtattaaaagcttaatcttgattccgccacatctccctagtctccagatcacacacttcttgtactctaacttcactgaaaattcactattccccaaataggacattatgactctagtttcatcttcagggtaaatttttacgaattttcaagttgaaacttgaggaaactaagcatagatgtgtttcagcctataattttgaacattaggatgtgatttctggaaactcctttgtgattttatttatgaggccaacagatggacaggtattccagtatttcttatcatagctgagtatctaaatgtatgaatatgaaagaacgaagggcttttaagtaaaaggaatggatggaagggaattgatgcatttctaatggatgggttagtttgttcagcagttctgaaagtataggtttagatatagagactcattatttttactttgctagacagtagcattagtttaggtacttaatgtgaatgttatgtacgcattttgctttcaaattaaaaaaaataagtagggaaggttagctttacttttattgtgtgtgtgtgtgtgtgtgtgtgtgtgtgtgtagtgtgtaataggatgtataatgtaatttcaaagccctctgatgcaatattttgaaactaagttggtagtacaattaaaacatatctttggtcatagattacttggccttatgccattttcataggcaatgtcctacttatatagcctggattggctgagaaaaataattgctgctatgaaataattttgcaattaccactgta

SEQ ID NO: 67365 - DNA, 3193 bp, Homo sapiens
tgttgacaaggatatggagaaactggagctcttatatgttgctagtggtaatgtaaaatggtgcagccaatttggaaacagcttgacagttcctcaaagtgtcaagcatagagttaccaatatgacacaacagttacactcctagttatatacccaggagaattaaaacgtgtctgtgcaaaacatgtacatgaatattatattattatttataatgtaatgcattatattattaagcagggatgattcataatcaaaaaaatggaaacaatatccaatatccatttattgatgaacaaacaatatgtggtatagccaaataacagaatattacgcaaccattaaacagaatgaagtactgatacattctatgacatggatgagccttgaaaacattatgctaagtggaagaagcccaaaggccacatattttatgatttcatttatgtgaaatctccagaaaagtcaaaagctatagagacaaaaagtagattagtggttgccacgggttgggataagaggcgaaccagaagtgactatcagtggatataaagtttctttttgggatgaagagaatgttctgaaattagatagtagtgatagttgcacaactctatgaatatattcaaagtcattgaactgtacactataaacaggtgagttctgtgatatatgaattatatctccataaaagtgttatatatacttgacataagactatatctaatgaagtcattggcagctgtatatgcttaacagcctgcgtcagattcatttttgtgtcttccaaaatgctaaacacaatgccttgcatatgtaagcctttgataaatggttgaagaatgaatgagtggatgattgaacaaacaaattcacgagtggtcttgttacagtgtgtggaaggattgtttttggcaagtgctacaggagagaggtaaagaacaatggccacgaattgaagcttctgtcctcctgttcacttaggctgacagttcagctgtcctgtcattgatctgatgtcagtctgatagaatcattctgtgctttgacgccagctagatggtatatttcttttttcttttgagtgataggttggcaaaatgtactttagcgactgtatgttatgtggatgatgcatgatgccagtgctctgttgtgacctttatttttatgagctgtgagaattaagaacctaccagttttagtttaattaagcagtaagacacagcagatggtgcatttgtgggtgatgattgcattccactggtttcctcaagcagcactctaaccctatggaatgctttgcctggagtatcacgccactgttgcaaaattaccaggaagacaaacacattgtaataatgtagtcagaaaatcttggaggacagtttagaaaaggacctgaactccacaggagttttagtagttagcagctactggaactaggatattaaggagaggaatccatgacataacggctgtagccatttactacccatctttactttccaatatttgcaaataaagtatatgaagatttttattaccctagtattctttcgtgtaatctgggtcaaacattaaaaatgcattggaatatgatttgcatgtattaaagtgctcagagaagtttcagtaaatggagaaatactgaattgatgtcaggttgttttattatgtttgcttttagtcactacagagggcctagagtgtcctacaaaatgcatttttccccaagtactgtgcacttaccactagcatatttactccataggatgttgaaaacatacctaagcagagataatatagagttaatccagtacttcttaccaatcttgcaactctttaggaagaaaaccaaattggtaagtagaattactttcattgttaagggatagactgcctaggtcagattcttttccctttactatctttgaaaaactgaattacttgaaggctggcataaaacttacaattgcacaatattttagaacctaagataatatgcctcaatttttctcattaatgcaatatatgaaatcatcaaaatgaaatacattcacttactggctgtaatgttgttaaaagtatgaactatgtggattttacaaaatatagcaatggttgctttagatagaataattatttatctcatgtctttgctacaaaggaagactagatttggaattctagtaaaataatgaaattcaaaaataatattttaacaggagaatataaattctctttggaaaaacccacattttatattgatttttcccctatattacataaggaatctctttccttctatttttaggggtattttcatcacaaaaacatgtgactacatcatccttctgcttggagacctgacttatatttaattaaatgaaactttttttttttctggattcccaccaacttcaggatactcaagcattgaagataaaactgtaggtctaaacactaattctgcaattcttcttgtaggaataaaacattattaaccttttagttaatactggtttataatacagtatagggaaatactataaacacctatctgcataggaaattcaaaataataactgattttatcctataaattattcaagattctgacacaagaaattgcaaattttatttatatggaaacatgctttactgcaaaatcattggtatttcatttctttatagaactagattttcatctaattaaaatttagaaaagtgctcatcatggtagctcacatctgtaatcccagcactttgggatgccaagacgggaggattgcttgagcccaggagttccagaccagcctggacaacatagagagacctcgtctctataaaaaataattttaaggaaattagtcagccatggtggcatgtactcccagctgctcgggagcctgaggtgagaggatcgcctgaggccaggattttaggctgcagtgagctatgatcgcactactgcactccggcctgggtgacagagcgagatactgtctctaaaaaatacatgaatgaatgaataaataaataaagtttagaaaagatggaactagattgtttcccgtttactcagcatataggtaacttgccgatttttttgtagctctgtttaataaaaatacactacagaatctccaaataaggccccaacaggaagataaaattatgtttgataatt

SEQ ID NO: 67366 - DNA, 1027 bp, Homo sapiens
aaggtattgacttgtgcatagtatttaatttgtgtaaatatgtgtgtatgtaatgttttgcccctctgagttttattttaaatgtaacccttgaaactgggataatagaaattcttagcctaggcctgctagcaattgcaggtgccaacggtttaaactgctgtagaaatacaattatgagcagccaagagcaaatcttgttttaaggtccatgtgtaatgaatgcctgttagtatcatagaatacaattaaaaagaggtttacctctcctaagctgtgattggttctttctgatggaagtgtagagtcccatgagtggactgtgtattcagctcttggtgatttagactccagtgagcctggcattctgcaggcttggataaattcagggcagttatagtcaggcagagatgagaaaagactgaaagattaatgagggagcttaaaacaaagcttcaaaaatgagagcaacacactgcttggtcttatgtaattgtgccgagtagaagtcagtcttggctgctgttgtttaaaaattttaagaggttggcagaaaatatttgttataaaaattgtatcttgagaataatagtgaaaacctaggacataagatctaattcttggttgcttgtgtatgccctccaagacacacccttctcttcatcctgcttttattgcagtttgaccaagcaccctgctttcctgctgccccccaccacttctttttggcaaggacccttattgatgactgatgtccaagccctggctgcctccaggagatgcacgtctgggacgtgctcctagagttcacgttgatgctctctcactacaaggcctgaaagatcgggagcatatagaggtgtgagagccctctggggagataatctaagggattgttggtgacctatggccatttctggttgatggttttaaatagcagttggttaacatttcttctatagaacttaagggatgctaatggctttaaaatgctattttgcctttgaaaatcctcttaatagatgct

SEQ ID NO: 67367 - DNA, 1005 bp, Homo sapiens
aggtagcctgcacatatgcaaattagatagtatgcatgtaaagatggcaagtagataagataacatgtatataaaaatagtatgtatgtttttatatgtaaaatgtttagctcagtgcctgacacataatgaatatttgattaatagtagctggcattattattatttattatccagatacaatcttcaagtaagtactttagaaagtatagcccggtggtaagttttaaaaaagattctaattttatacagtcctctcagataacatatttgatagtaaaatttcaccctctgtgtacccttttcacaatttgggagtttaccgaatgctttggtgttttaaaggcagtcgtttgttcactgaaaatgcagcttatgacaaattcaatggttgccaagctctaatatgttagcaggcagaagcatgcttttaatattcatcatctttaagtgctaccaactgacatttagtactaaatgtgcagatatgggtgctgagcaaaacagagctaggaagaggacttgctaatttgtattctagatggaaatcttaaattagtttctgagatttttaaatggatttttaaatgctgggcacataggaaattgagttcatattaatatttataaggtttgagaagatatttagtgaaatatttgtataatttaattttggtcataatcaagtagtaaaccataacaagaaggacattgtactttagtctggtggctgttttgtgacttaggaatatccttctggaaaagccctgaatgacacacatacacatacatacatgcttcaaaagttcttctttattagaacccagaaaccagaggttatttatatataaataccttgggttggattgttttgtgttaattttaagttaattaatttagaaatcagtgttgataatgatttctttaaaagcatttattgacagttctgcagaactctataatctagctgcttttatattctttattatacagaacagctccgtt

SEQ ID NO: 67368 - DNA, 1077 bp, Homo sapiens
agcacataaggtattgccttgtctttttgcaaaaagtatgtgattcacctgtcatggtgcatggtaggcactaaagaaatacttgttgaaggaatgaagacatgtataacttaactagctatacacttggaaaatgtaatttcatctacaaacaataactttataaataattgcactgtttctcgcccattaaatttactgtgaaatctggacaaaacatctgtcattatgtaagccatggaagaaatgttgagattagcatgcagtaatgaacatggtagtaaatgctggggaaggcagaaatcagaagagacgtaaataagtcctaagttttaggccctcaaaaggttaatttggattttcgttctgggtgtcttcatatcagagagacttggccaatctgatataaaaaaaaaatcggaggtcaacagaagtgattaagcagctaggaaaattaactcagaaagaagatcttagtatataatttggaaaaaggatttgaatctctcaaaacccagagaaacagaaggataatttagaatgctttgtagagcggtagagctgatggcataaaatgaagcagaaaaaaatactgagtgtaagacagttcttaatagacagacaaagaaccatatagcattccaaagaaggtagtaaagttgttttgatagaatctgacaccccaaagacagacaagcgctaacatttattgagtacttacaatgtatctggtactctgtatgcataatttcatttaatcttgcagtaatctgtgaagtaggtactaatacaatcttcactttacaaatgaggacactgaggcttggtcacatgaggctggtaggagatagtgccgtattttgaactcttgttctagagttcagtccacatcactatactctcctgccttctagtcatgaagttgggtctcagtaggtgtgttgtgtagaggtttgacagaataacccagctggttttccaaatgctgaataggtgattctaacaagccattttaattaagttaaaaaaaaaactcttatgtattccaatcaaaagtgtactttttgttcagtcttc

SEQ ID NO: 67369 - DNA, 1149 bp, Homo sapiens
gtctcaaaaaaaccaaatccccagaagtaactacaatgagtggcaggcactgagcccattctagtttctggaaggaatttttacattctttcctgtagttgaaatcagatggagttgccgtttcttcaccaggccccccaacctgcaacctgattcctcctcttcacttccctgtttcagccactagtcatggaatcctgctcaacatgtaccctgtacccttttgttcatgtccagtgctgctgagtgttagttgattctgtaacagctgctaacatgctccttcttgggtggaggtggttctcattgaactgactcctggctcccacccaggttctgggctggtctgtgaatttaggtgcttgaaagtcaagaaccaggatttgcacctgcttccaatcatcctttggctccactttgaacacaagggcatctgcaaagacgtctacatgcggtcactagtgtaggattttcttgtctcctccattagactgagctccatgagggtggggaaggaagagatgagggtgggagtatattccttctcactgaatccccaacactcagaatagtacttagcacatgttgggtactgaagacacgcatcaaactcattaatgtaactcaatcgttgggaaggacttaaaagcagtcctgaagcatggtaagcactaaaggccaaggtcaaaccaagcccaaggatgtaaaaaagaaatgaaatcacacattatagatgaataattaaaacaaaattctgcagctccaaagcaaagaaattgtagagatctgcagcaatatctttctgaaacaattttcctttatgagacagttataaaagctgtgctttgtaaactcagtaagatacctgaagagtttacatctagtaaatgagaactttaaaaagaataaaacgaagtgaaaattatagtagataaaataaatctccattgtaaataaaaagctgactgtacttagaaaattcatccagttgatatggacaggaggcagggaaatactgggtaaaagagggtggttccctggcaaaggccccactctcaagcccagaaacccatggctctaaatgagaacaggacttcctgttttcacacccaaatgttctcttttggcctgctgcacccctctatcctg

SEQ ID NO: 67370 - DNA, 1052 bp, Homo sapiens
aatgctatcaagatgataccgactcccattctatataccaacgtgaaaataataaaatacctaagtaaggttgttggtcaagattgtctttgaggaatcatggatgctctgaaattggatgccaaattttacatgtaggtggatgtgtgtttttgagaaaactccagagcttttatcagactctccaaagggattgtgatctcataaagactaagaaccactagataagctttatagttttgaaagtgcttctccatacatttttatttgatcctcccaatgattttcagggaggcatgttgggcattctctctctttctctctcgatctctcaacagaagagcatgactcagagcttaagtggttttgtgcttcatcctgtaggcactgggagcctttgagggttttaagtgaggaagtgatctgatcagatcgtcctttagagagattgccctggtggtagtgtagaggatgttttaggggagtaggaggctaattaggacaccattgggaaaatcaggtaagaaaagatggttggccttgagtttgttgcagtcagattggaaaagaggggaggaatttgctaaacagctttgattttgaagaactgatgggacatcagggagaaaagaccagtaagcaattggacgttctagtctgggactggtgaggtgaggaggacctcgcacagggtgtatagagtgagaagtgaagagttcctggggagaaaatgtcagctagtgtttggctggagtgatggtcttagggaagcgcagggagatccaggaacatcgcttttttccccccattctctgtattcctgggttgacaagtagggattaaatatattttttaaccctcttcatttactatcagattatttatatttttatttctcaaggactttaaatttatgaagtttacaaaaatcagtcataccactctaatctaccttctgctcagtggaggcgtcaagcaaaggatgggttaagggtactcccctataatcaatatgatcttctccattcttagatgtggaaattgacacgtta

SEQ ID NO: 67371 - DNA, 1009 bp, Homo sapiens
caaaacactgataaatgtttgtggtgatattctggtggcatatagttgtccccctttattctcaggggatgtattccaagatccccagtggatgtctgattctgaggatagtattgaaccctatacagactattttccctatacatacatacctatgataaagcttaacttataaattaggcacaataagagattaacaacaacaataaaacaattatatcaatatgctgtaataaaagttatgtgaatgtggtctctccatcacctgatggggtactcatcaattgatgagtactgtactcatcaatttttagacccccattggcccagggtaactgaaaccatagaaagtaaaactacagataagggggggactactgtatcatcacttgtgattgacttaaggtttagtcattggttgataccagaaacttggctgataatattcttctttctaaagggaaatgtgatcaattctttatgatgtggagtttaggtccacactctggtgaagagtttgaatttgctgcccttaaatactacatcactgtagttctgtgtgatgtgtcctgtacaaacatgcagagtaaacattgttccttgccttctgctttcttgagcactaaaatacacagtgtaaatatgcacaaacatgtagaaggacatatagacaaatacagccttagccaagtcatgagagatgcagctgcaagaaacaggctcatgcataatgaacatttatgctatggcatagcttgtgtttttgcatccatgagctgtatgaaaaggaaggaacctcacttcgttttcattcagttagaatgaaggcccactggtcagttttttgactcaattcagctgattgttttcaaaataacctgttcttttctaacagttgtgtgtagggacagctgcactctgatgaaatgactgtgagcctatacgctaactactgtactaattttctgcctatatttactatgtgcccagtgactctgctgatgaatat

SEQ ID NO: 67372 - DNA, 2377 bp, Homo sapiens
agtattttacaacccgagatacccacttagggccaaccagtatgctaccagctttgagcttaggttatttccaaccaatctcttaaaagccggagtcaaaattcaacctcagttcagtaatggtaattgtttttctctggtcatccctaaggtgatttattactagacgtatcagtatgaccctctcataacatttttatctattaaaagtttcctgagaaatggatttttaataaaccattatcacaacagcattattatcactactccatggtgtattaatttaaccacatctgtggccctctagtttatttatagtattgtgatagaagtcatggggaatacaaagagggcaaaaaagaaaaaaatatatgtataacttagttgggaagacataacaaatgcatatcaaacgttaaacagcattaagaaaaaacattagtaaagagccaagggaggttagagtaaggaaacagaatgcctgccctaagtcttggggcagaaatagaaatatagaaggcaggatctcaatacacagaaaggaggggtgcaggtcgaatggtggaggaagaatgtctgtggtgcattaagagaaaccatgagcaagttggtttctctggaaaagagaggtgctgttgagaactaataggatagcaagttggtaagtttggaagacagacaattatgtggaaagaaagaaattctgttacctgcaacacctaatgtctacaacctatcaaattagcacatgtattaagcactgataatgccagctaaatctcagtcagaagctaaggaactggagaacatcaaggacctagttgcagaagcatatcagagctgctggccctgaaaaaccctgaaagagccgggaattaagaatttcatctttggactcagccaagcttagacagacttggttttaaactcagtttagctacttactagttgtattagtggaaacattaattaattaattctctgtacctcaatttcctcatctgtaaaatggtgataaggttaatttgaagatggcatctttgaaatgtgtaaggattgaatgaaatgggtaatttatgtaaagttcttacaaattcaaatatatagtcagtacttacttaacggttactaataataacagcaacagagtatgtttcaaccagacagaataagttcaatttaattttttttcatcttgagatgccatgtaaaatgttaactaatgttccacttctttaagaaaaagttggaaaaacactcatacttatttttaaccttactactgtgaaatgacagtgcttctaattctggctgtgaaatctagtaatccttttaaaaggattaaattgtgaacaaacacatcaggaaagaacttaaatctagtgtttcctgacttattttggttctgattaattaaatttttttcagaaagggtagaaaccaagagtaggtataattgaagagttaatcagaaaattaaataagggtactcattaaccaagtgttttagtaatagaggttttactgtattaggagttcccacttgttctttttctgcaaatgtggcagtcggttttatttttaaatgctgacataaattgaaagtcttttataacctctgaagcatgtttcgcaaagtgcagtccatggatccttggaggctcccaaattccttttgagggatcgatgagatgaaaactgttctcataatactaagacgtaattgccttttttgggtgtgttgacatttgctctgatggtgcaaaagcaatggtggggaaagttgtgggagccttagcctgaatcgagttagtggcactaaactgtcctagaagtcattgtattcttcacctccacatacagtaaaaaagaatatccctgatgaagcagtaaaaattattaattttatgaaagcttgaccttgagttacatgtttttaaaaatagtttgtgtgaaggagaattacaaataaagcatttttgctacatacttgtctcaaggaagaagactggggagattgagttaaactatagttattcagacgcgtatttggcagacattttctggaaagcagtgagcctgtcattttaagagaaacaatggacattgttgtcagtgataaaattaaagatttcaagtggaaatgtgaattttttaaaacttgcatcttcctctgtgaacttgacagcttcctaatgaaccattgacttttcttatgatattggtggtgatactaatgaatgtgacttttttgatactgaataatgaaatgtgtcaccatttggaagagtgctgcataactcagtgaactaatattttccaaatgaccagtgcatgattttaaaacatcatgagtggctaaaagatccattcaaag

SEQ ID NO: 67373 - DNA, 1151 bp, Homo sapiens
attttgtatttccttaaaggaacaatagagcttgcatttgtgatcaaagatggaacagagataatcatagaagtgacccaaatgccataaaagcaaaaatacagccataaacctacacattattttatctttatttctatttaataaacattttgggtatgtacagatatgaatcttaggtagtcattatgctcaggtttttcagtcattgagggaacacatgattgcagtggactccagatgtcgtcagccagagttcaggattcacacgggaacgcgagctttatggcagctgggtaatttggaatctcatctttataacttggatgcctggtctggcatggtagagtggacctgatgagtaggctgatttgaaatctgatctgaggtactttagtgatcttattggaaacaaaagaataacttagaatacgtggagggatgaatacttttttttttctacctcttttatactaaaatactatgaatctcagttgggcatgagaggtagtgaattgaagagggtttgtgtccgagctctctggtcaaagcttggatttacttattctgtgctataaattaaaaggaaatacactctcttaattggtggtgaagagacttgctgaaagttgcccaatttgtaattaaactttggatctaatattctttttttcattttctatactttgatattagatagctgcttgtatgactatacatgatgaaataattggatacatgttaaaaatgaaaactaaactctgcataagtaaaattagtgaagaggcagaaggtaggggtggcctctatgaagcaggtatgagaaaagctccatgaagttatgattacatttgtttgatttttttaattacaccatgtttagatggttatttaaaagaaggtggacatgaactcatcattttttatggctgcatagtattccatggtgtatatgtgccacattttcttaatccagtctatcattgttggacatttgggttggtttcaagtctttgctattgtgaatagtgctgcaataaacatacgtgtgcatgtgtctttatagcagcatgatttatagtcctttgggtatatacccagtaatgggatggctgggtcaaatggtatttctagttctagatccctgagga

SEQ ID NO: 67374 - DNA, 1459 bp, Homo sapiens
ggtaaaatatgcaatgtgagatatatctttgaaaagggacaaagtactatggaaacacatcatttgaagagagaaatttcagcagagggaaatcaggaaagacttcatgcaagagatgaaaaaattagatatctatgatgcatagtgttttgatagatgaagatagtgaagcatatccttggcatagcaaggtttgtcatatggccatttctgtcactggggccttagggtttaagtgcatatactagcccttgactttggagacttagagaccggtaaggagcttatcttctctccactcactctgttcctccatgtagaatctctttatcttccttccatctccttcaggacacaggcaatgtttggatttcctagtttctctcagaaacatgatactacatcgtgtattacttaagacagattcaggccagagtacacatacaactcttgagttggtcaaattggaattcagtttctaggttctccatgattactttaatctgatttatctgaagaaaagttaatctgttggtatgatctgatggcaaggctttacaagtatatgtgttttaatgtagtcgcaatttttaaggtaagttaaagcctttccagttgttacttatttttcagtgacaggacaaatggctggcataatttatttttgtttgtagatggatataactggagatcttatatattgggtatgcattttttatgaatttatagaattttagcctaagacgttggattagatgttaaagcatttatgttgataagcaagaagtaaattgtattctgatccagtttgtataataatgtgcaaccaacccaattcactaagtttgtattggtaattttgcattgctatgggacttaagttacatatataagagttgacagttatttcagcatgtgttagacttgaactccagaaggttaaggggaagttctgctatttattttctgttcaaaaacagatgaaaaaaggatctttatattattctctgtcacacaccggtaaatacatggtcttcccaaatccaccacgaaccaatgctgtgagctgcttagtttgcttgtttccctaaagctttcatgtgacaaatttataattttgtatgttatttctaggtcaacagttagattaatgttttatctcctgagcaaaaacacagtgcttctttgtaaactttgttatcttactgaaactgaaaattgcaaaacaaagaattttctagttctcacattccttgatggagaacagtgtttatatagaggttatcttgtggtttattttatattctacttaactttaacatttctgcaggtagaataaatatcctatttaaagctttcaaatcttattaattaaaggtagttgtcattactaattgtttactgagttttatttatttttgcttcattgtagctcatgaggaggccacctaaattgatc

SEQ ID NO: 67375 - DNA, 3718 bp, Homo sapiens
cagaggttagccggtgaccctttggcttgatccgggcctctctctgacagctttcattcattttaaagaaacctgggaaaagttgatattcagaaagtgctggttagctgtctgttactcaccccaacaaaaaagaagtttcatgaaatgtctttcaacaatggaaaaaaataagaaaaaacaaaacaataagcaggccaggtgtgtgtggtggctcaagcctgtattcccagcactttgagaggctgaggtggggaggatagcttaaggccaggaattcaagatcagcccggggaacatagcaagaccccatctctatagaaacaacaaacaaaaaccaaaaacccacaatggcttcctgaagttatttagagttgattttgtaatgttttatgaaattttaccccagtaggttaatccaattctgttttgcttattctgactttgacattcacttgcagtccttaagcacgtatcttttgaatacaagccaagccatgcagtgggtggcaaggtaagtcaatttgggattaaaaggctgtcagggataatgctgaaccacatgtggatatttgagaggtggctgcaccccactttgctctctgtccagcttgcaaaccgaagtctctggaaaaaggaacttcttaaggtaatatgattcacgtgagcagaagagcccatcagaggctgtctggtttcagtagagatgatcaacagataatgtactgaattggtaggcataatgaggatacaaagaaaagacatcctggaaacctaatgaagacttcactttattatcttttcagataattgcttagatgcatgtacattttccttttaaatttagagttaaaaaaaatcaagttgaaacacaaacataattttgagtgaagaaatgcttgagcatctgggaggtagagcaagagggtccttggaagggtatggagcagcacagtgaggctgtgacaaatgtccccctagccactggcctctatcaacccaaagtgcttctcagaaaacaaataataaaacaaacaggatgtaaacatcagcaacttaagtacttgccagctcagttgttgggagtgggtaaagctaaagattaaagacagcttgacaaaatcctacacactatccagctgagttttacacattatgagatgtggtaggacagaatgagggtgtttaaaaaaattattgctattatgcagctggagggcaatgggctgagttgggaatatgccaggagaacttgtgctgcttgtgtagataaacttacaggacttcagctttcaaccccatccaattctttctgtcagattctcttaaccttgtcctgtcccttgctgagcactgacattttcagagcagaggaaaatcatgttaaatttatgtatgaggaggggtacatctgtgtgtattgctgtactctggttttaaatgtttgggctcttttgattagttctgcccttggtttattttgtagtctcagaagtgcttataaaccagtgctggttaagagtctaatttagcttctcctcatgttctttggtcagcgtggtggcagtcttttgtggtcgtgcagaagagcctcagcccctgctgtgggacaaaggggaccaaattgtttgctgtccctagacagcctaggcctgttgcagcccagatggtgctttttgtcagtttagtttattgggattctgccgaatactttgtttgatgagagagttttaacactgaagaatgcatgaaaacctgggatgctggagaattgtgagagatgggcttggaaaggaagattcaagccaaattgtagagtaccttgaaacctgacaaaggggaatatatttttattttatctgtagacacgtaatggggaaacattgaggatgactgagcaggagagagaccatgtgaaggatggactgaatggagacttgtatcaaagagtctgagtatcaaagacttgtattagagagggttgttgtagtaatctagtcagggtatgagaaatggtttgtattagagtgtcaggagtagtcgtggcaaaaatatatagatcaggatgagggatgggcctcatctcacaccctgactccagtcaatggcagtggctccctggagtacactactataggaaggattttgtaaagttttgtctggcctcagtggagggtgaggtaggggaggagttctatgaacagttagtggtgtctgccatggttgaaacaatggagaagggggacaccttttctgtgcagatgttgcttctggtagatataatccacaatgtaatgggagaagtactaagaatcagtaaattatggagggtgtaaaagactactgatatttaagcctggcggaccggacttagagaaatgatagttaaaggagaaatatccagcaaacaaagatatgacattgaagtttgggactgcgattagtaccagagattggattggaggtgatttgtatagaatggataggtgattttactcttgcaatttggattgagggtgggaaaccagagagggcgggggtaaattagtagaggtcaacttgaattctgtgtccatatcaatgctgaactgattgtgaacatttttacatcttgagtcacattgtaaggagaccagaagtgaattgagcatagtaagcatttggaagtaggtgagtgtttggggttctctgtctacaacttttaaattttaacaaagctccacgatactctatttaaactcttaaatattaccttgtttattaattaccaaattttagtactgacttgagcaagaggtctcttgtctgctattttgagattatatagaatattgacactaagaagaaactcaatcgtaactcctattagagaagaaaaataactcagaagcgttaaagttttgcccaatatcacagagataataggtagcatggttgggcctgagactcaggtcttgtgattttcattctaagtgctttttctgtattcgatgctatttttttttttttttttacaatctgtatgatacagatttgaacattatttatagaaataaaggataaatgatgtgtataatctgatagaataattttgagaaatgcagatattgatagtccccagctttttccctttttattgtgctgattcatttatatattcataaatgtatttaaaccagtctctgaatatttaggtcagtgctagtcatttgctcttataaatgggaagagactgtataagttaaccagactgtctaggtttaaatctgagctcttccatttcttacctatgagatctttgataaacttcttacctttgtgttccagttctcttatttgtaaaatgaggatgataatggtgcttaccccattgggttactgtgaaggttaaatgagggtggatatgtaaagtacttagaacagtctttggcacatggcaagctctatatatgtaagatcatagccttgagagttgaccttttggattcaaattctaactccatcttttactagttgtttgaccttggacaattaacttaatttttctaagcttagataacagtctgtaccttatagggctgctacgagaactcagtgagataatgcagataaagtacattctcaatgcttgacttcaaataaggacacaatacaagataatcattttcattattaccatcataatcttcataatgaagaataatatgataatgaacat

SEQ ID NO: 67376 - DNA, 1640 bp, Homo sapiens
tacatgcactgagtctagctcacggtttctcaaacttcagaggcccatgacccttcccgatgtagttaaattgcccagatgaccctcctgtcatatatttttaattgtaaagcacttgaaattaatcatgttttatttctttttaaataagcacctcaagagcagtggtgagcagttttgctcacggcacttatccactcttaaagaaaattaaagattggaaagggccttgcgtctcagtggcagcaaagccatctacatgggggaaaacatagcagacaagagctgcgtttgatactcctctacacagtctcttgcctgtgcacttagtgaaaattggcaccggtgaatataacaaagtaaaagcattttgaattattaccgcaagccttcaagtggtcataacccaagatttcaagtacctcagtgaagggtaaggttttctacaatttgtgtggtaactgagtgcctttaatttaaactacacggagctaatctttaggagaattggaatctgcctctgaactaattatgatttacagaaattgataatttgtcttctgcatgtgtctgcaggaagaaattactattaaatttgattaacaaatgacagatttcagcctagtaatttaccatctttattagcaaacttagaaaacttcttatagtaatcttttcaatcatgtcaactctattctggtagttaaggtttatgtagaagtaacccatgtgtgtggctttagtaagaacctaccttacctttaacaaagaaatcttggtgtggtttctcttttcaataggcaagcactactcaaacgctcacactgatttcccatggtacttagaacttaataataggtaattaacttccaaaaatgaataatctgttcttttgaatacattcctgcactccctcaaaatatatgaaattgtgtaaaaggaagtagagcattatatcatatgttcgccttatttttcgtgcaccactttgtcaaatgtttttctttctcttcaaacagattgtaattgtgtaatggaggatactattggctaaagcagtgccatatatatgattgacattgtgaatgattctgaatcctactttggatgtacataactgagatgtaaaactattgtagcatggcagtatagtgagggcattaaacttttccttacatgagtgacatggtgtagttttcaaaagtatgttaatgtacatgtttttatatagttgaaaaaatattccattgcactaagcagcctagcagaattgttacagtggttaaaaatgcccttttatattttcatgtcaggaaaatcttatcttcttgcatgtcaaaaagggaatttgaactattagcctttaaagacccagaggtaaagtttaattttataatgacataaaataaatgttctattatctaagtaatagttcaccagaaaagtctgaaatggcctcctttctcaaggatgcagcttgtatgtgatgctaatattaaaatggacctgccaaattgagtgatgggaggtgctaataactccaagtggggagatgaaaacaacatattgcacacacctgctctcagctttatgtcagtctcattaagttattgaatgggtgagtataatggggaaggagg

SEQ ID NO: 67377 - DNA, 1054 bp, Homo sapiens
agttcgagaccagcctgaccaacgtggagaaaccccatctctactaaaaatacaaagttagccagtcatggtggcacatgcctctaatcccagctactcgggaggctgaagcaggagaatcgcttaaacccaagaggcggaggttgcagtgagccaagatcatgccactgcactccagcctgggccacaagagcgaaactccatctcaaaaaaacaaaaaacaaaacaaacaaagaaaaagatggtaaggctatgaaacaaatgaagactaattggcccatgtggtgtaaagccatgactttggcctttttattgtgaactacctccccgacagttccatagacatgtatactctgaacaaaatatgagtcattaatccctctaatggagggacctagaacagtgaaatagggaggacaggaaggagaatgatgctgaattgaactgggatcttcttgtctgtcaagcccttgaacagctttccctttaagcaacaaagatgacaagtttttgctattttggattagtgagagtgtacgaaatggtttccctttccttccaggcaaaaataccaacagaatctggcttcggaatgaaagtgctaatttcatttggtgactttcagatttgaaatacgggcttgaacaggcattgtgcattagtcagctgaggcagtggaggttatttttacgatgctaattattatttcctgacagtgatttactttatgttgtctactgtttacgcccccaaactagccattgttttaggaacagaattggttgggttgtcatgctcttttcaaagacaaatcttactattttatgcatagaaatactttcctgtaataaagaagaaagctttattgaagagaatcttgcatatgaaatgtaatctggataaatattcaaaactaataggtttatattttagtcttgatttttaaagtatatttttctgacatcctaaccaccttgctttatgtgcattaaagttaaatctgttttactgggatgcggctgaatttttgttactcacattgaacttagaaagg

SEQ ID NO: 67378 - DNA, 2649 bp, Homo sapiens
tagcaaagacatggaatcagcctaaatgcccatcagtggcagattggatgaagaaaatgtggtacatatacaccgtggaatactatggagctgtactgcctggcctggaaatctggctgtgacaggcactagctgagtgaaacttacctctgtcttacctcgactgcaagatggggataataataataatatctatttcatatggcagtggtgaggattaagccaattagtgtaaaatacacaaaaatactaaaaacagtgcccatcactgtacaatgctgtgttttttctaccttctcctgctcctcctcttcttcttcctaagtcttctctgttgttttactaagaaacacatattctttgaatatggaagagaaaggaatttactttgctcatcctgtaatatttttcctggagatgagctcttagctggcttctgggaaaagaaaatatttcctctattttatccagcactctgcatagcctgtgacagttatataaaaatatcagtttagatgtgttagagattgttttagaagactattccatgtaagccatgcattggttcattcattcattcttgcacaagtgcgtgaggattgcttcttaaatgcagggcactatatctgcatcagatggggacttagaatcatcattccgtgctgacaagccctctgccaaagggatcagtactccacttttgtatagaactgggacagactttccgtcacaattttgttatgaaactgtcaggtgagatgttgcactgaattccctttagtagatttatacagtttcagagattttgttatggtaacttgggggcttttaatttgattttattggattctttttttagactcttaaggcagtggtgttttcatcactacatctgcacaatttgttattggcattattgggaattgcggatgtaaagcagtctatgacttttgggaatattaataaactcctaaagtacttgttcaattagcttctctgacctgctgtccagaggttgagctgtcattaactgaggaagcttcctatggtttaagtggtggtgaggaaaaccattgtctttcttcctcctcatctttgtcttgcctacttcattcactactttcttgggagcagtgcaggaagaggccgtccaattccagagctgcagaggggctcctatgccctagagaatgagaaagagcatgctggttaggttttatattactactgtgcctatttttgattaagagaatgttttctgtgtgtccagaggtttaaaagattaataatttattttacatatctggagaattgcttctctctgcctcaagcattagggccagagttctgtattttgtttgcatacaatttgaagtgttttctctaggtcttataggggagaatctgaagacttcattgctcgctgatttcagtcttactgatgttgggctcttagatcagcttgctagaatacaaaaattattcttttatcgtgacaccaaattctgtaccctgggactccaagtggccattgaaagacttgggtttaatgttagtgcctcatgctatcaactgcctatctgttgtgaaattcttttgttgtcagatttgtcgtttccttttcagatagtagatcatctgatttagagcatgaaggtacgtcttcctaagtttctatgacagaaagatattgaagaagaaggagaaaagccaaataccagagaccagacaaggtggcaggaaattgcaaacatggtggaatttccagtctttttcattttttgaagtcacagataatttaaaaactactcgcttttacttttttttgtttgtttccttgcttttgcaaccatgtctatctgccaacctttctaaaatgtcatgatgtaattattttaacaggcactgtatgctcctttatttgggggatattaacctttctaaacaaaaggaatgttaatatacactggaaacacaactaatgggatttcatttttcttgttaggcaagaagcttgactttttttttttttttttaacttctcgtaaaagaatgcggcaagtgaaataattgccttaagctaatccatgatagcgattttaaacgtgactttccagatcacttttatatggcttagaaagaataatgtgattttcttgtttttgtttgctttagctaaacagtgttgaaggatgatataaattcaatgaattcaaaacaaagaaaatgctaattgctaatgcgctaagttcttttaaggcatgaaatacagtgtttaattcataagcattgtttcgttttatatagatttaatttttttttttagttagtatgggacaaactcagaataaattagccagctagccattttcttaattattgtgtattcctatttgatgtttaaatatatatgacctaaatatgttgtggtttttattaaaaaaaaaaaaaagaaaaaaagaatggtcataggctctcagatagtgaggcaaagcacttttaggatttctacagggcacctcctctctccctggctttccacctctccccttccctgccttcttccctccttccctttaatatccactgaaccattttcacatacttcctgaatcacccttttgaccaatagcatgcatttgccatggc

SEQ ID NO: 67379 - DNA, 1006 bp, Homo sapiens
tcctatagttttcagagatatatgtgatatacataaacttggctctttcccatgacctccctattgctgtttagggcttaggtcactttatattgtaattattgggccacctgtaaatcccttcaaagaaaggactgtgtcctattgaagtttgtgtctccaatgctcccatcagggctttaagcagttgttggctgtcctagtagaagggtccgtcatcaaggctcagtaacctcctaccatttcttgaccctccttccttgccctgccttgtccagtttatttccaggtcttaagaatatcagggttatgtgggtggaaagaagttgcttcgtcctctgttgcagacggatctaggcttgcatattcacttgatctcttatcaactgtgtgaccttcggaacattacatattctttgtgccttagttactcaatttgaaaacatgaataatcatgcttaatttatagagtcgtgagaactaattaaaataatgactagcatgattgtcacatagtaggtccttagtaaatgatagtttccccatatcttttaatcagttcaccttcttcagtaattttttgaaattctttcactgcattagattcttgttaactgttttccctattgtttagtctcttctgcttccagatcagcagagatattgctgccagattaaatgtttattaattttgtactgtgtgctggacactagattttttctttcctgtgcatgattttaaacaaacaaaaacagcccatcactgcttcggttcacagtctggccgtagcctagttttttagccttatcttgtgccatgcctttcacatacctaacaatccttacaaattgaatactcctagttcctgattgttaggaattgggatgagacgatatccagggactcaggaaggctcaaatcccatcctaccaatcacgtctacccacttaccaccctcctttcccaatgcaaggaggagcagaatgagaatctgaataccactcc

SEQ ID NO: 67380 - DNA, 1025 bp, Homo sapiens
tggcagaaacctgaatgggaagcaggctggggtacagcaggagcgaatgcctttgggggagcctgggcttctgccagcacatctagctggggttcctgaaaggcccgagggacattgcttctccattgtcatattggagattttgttccaggagggggatgaagagagcatatatttcaattttcttcacagttgtattatttgttagattcctctaaaagacagttgatttttgtaagccagtattaaaattccaaaaagggattacaaaaatgtttgcattgtaatgttataacacagttggaatacactttagtcttcccttttggttataatgctatcttataagaattgtagaatacaaagaatggttacatgtctgaaaataatatatatatttcttcaggcaattggtgtttttgtgttcttaaaaaagccattacagcatcagtttgtctcgtgtgtatattttatagtagtacattaaacacaaacactgacaaaagttttttagtttagcttaaaagcagtagttatttctcatatactattaggtagaggtcacattgggatttacatggactgctgttttccctgttgaaagggctactttaaacaaatacttgaaatgttgtatagccacatttaaaaaaaatcccttataaggatatggaatataccactgatttcattagacctgtcattcactgacattcccctatttatttatttactcattcaaaaaatatttatcaaggacactttatgtgccatggtctgtgtcaggtgctggagggccagtgaaaaatgttcgtaagtgacatctgctttactgcagggtacttgtcgtttcctcctgtagttttgcttttggagacattagatgtatcaaaattgttaatatttttatatttgcttgtaatttcttccaaattcgcaggttatttaggtcaacttatttgaccttactgtcctcattatattatataatatgtattatataatatatataatataaaatcata

SEQ ID NO: 67381 - DNA, 1817 bp, Homo sapiens
ggtatattattttatttccaaagagaggcttctttatcctctcctctacatgattaatgctcttggccagaatttaagctggcagggcctggcacatagtaggtgaacaatgaatggatataaccattgttgtggtttttattcaaggctctcaacatgtgattgaatgaaggatacctagaaattgaaatatcaaggcaattgtgaggataactgaggaacactgggtgaagcttgtgtaatgtcatgatttagcacatgccttattattttcgtaggtctcaaacttaaccctactaggagagaaactgtatttggaacagtacaaagcaaatatgtcagtgtttgcatgtgccattctcttacatttaaactaaataaatttaaaacattcaacaaagattgagtcaggagcgttttatctgattcatccttaaaaaaaagctttctttggtgccaggcatatagtagacactcagtaaatatttgttggcacactagcttggtgctgaatataagacatattcaattttgttgaatgaccaattaaaaatgtaggagtcactgtaatcacggtgggacccatttctctaaggaagtttctaatatgactgtgtcatgtctttgccttgggctggtcttctatcaaggttgttactgacatggctatgctttattggggtatctactatataccaactattatacttggttctcgagcaatatcatctcatcttaatacattgtactagtgagaattacaagaaatttcatattaaaatgaaagagaaattttaatttaatttttatatccccaaattacttaataatctgctaaagggaatagttgtcctttccctctacgtggattctccatcagaagctcatgcctttgagtgatatacttggccactcagctggaaaactgtcagtcttcataacaacattttagatcctagaacctgtatggaacagtttctcaaaaatttctaccatcttatgaaaagccacacagatgtgccttcattttgtagtatattaacaagatggtaatgcatgtatgtatacaaatctatcctgagagtcttctttgagggttgattgaaaactcactcctcatcttggttttgtttgcttgatatgggaagcacaaaacatttatctttatgttctgacaatagaaatagtagttggtatgaaatactcggtgggcgaagcagtgaatgataagggaaatagtattttgcatgttgcatttgcaaaggaaactcttagaaaagtggctaactttagatttacttatactccttagagttcacagggatgaatttaggtggagagatgatatttgaaggaaaaggtacaggtctacgtacagtagactagattaggtgatcttgttgtgcaatatgttttgaaattactgatgtgacatacattaatctcaaaataattatgctgtgtgaaataagccggataaaaagagtgtaataattgatatggttcggctgtgtccacacccaaatctcatcttgaatcgtagctcccgtaattcccacatgttgtgggagggacctggtttggtgggaggtaattgaatcatgggggcaggtctatcctgtgctgttctcgtgatagtgaataagtctcacaagatctgatggttttaataaagaggagtttccctgcacaagttctgttcttctctcttgtctgttgccatgtaaaacatgcctttcaccttccgccatgattgtaaggcctcctcagccacgtgaggcctttttctttataattacccagtctccagtatgtct

SEQ ID NO: 67382 - DNA, 1722 bp, Homo sapiens
cccatgtcccagctacttgggcaggtgagttaggaggattacttgtgcccaggaggtcgaggctgcaataaggcatgattgtgccactgcactccagcctagggtacagagtaagaccctgtctcaaaaaaaaaaataataataataaggtttgggtgtgtgatttggggcagtgtttttggcatgcacgggtgtattgtgggtgtgcatatgcctagacagacatatgcacaatctgaagacataataggcattttcctcgaaataaatttggctcttagaattgctttcttctcagtcacatgcaaaatatggtgaagaatcataagcagtcataaatactggcttgtatacaccattcagggtcaccttcaacaaaatacaagtcactcaattttatccagcagtcacagtgctggatctactgtgggactcttaaaatgtttcaagtgagagctggatagtcataggtagaatctgagttatacattctgatttcctttatgggctatagattaactgcaactctgatactacttcattataatcctactgacttctttctggtaagagaattgccaggtacccagctctgaatgtcctgaatcctgtcagtagctctagtttataaaggatgatttgctaatgagatttcacagacaagcactagatattgacggtgattcaatgttgtatgttgtctgagtggttgttttgcttcagggtacttttttattttccatttctttagcaacctctttccccaccctgctcttgcagaatttgagatcaagaagtagggcattattaattacatatagacattatagaatgttttgggggttcttaatcaaaatgtaaatgatagtttaaaacatagtttgaatactctgaatgcctagtacctatgtagtcagtaaatagtgattgccgtgaggactacaactgtatcaagacagttttatcctagtgttcagttaaaatcttaaaaaacataaaataaaattcttgctgtattttatgagtaggttttaggaacctagtaagatttttaaggcagaggaacctttagaaggggctcaaggtcacagttggcactcctgtgaaaacgtgtgaattgccttccagacacttttattttgccttaagactgcaactatgttctgtctaggggttctgctgacagcacgaccacacaagtacagtttcctttctgtgcatcagcacaatcagagattgcaatgctgcttgtggccattaggatttagtcatggaatgtaaggaaatttcaacaggaaatgtatctggctttgatatattttcatctgccgtagtcgcttaacctgcatgcctttttggtgtcagcatttaattctaggatttcatctggaatatgtgtgtatatagttttctccatcactgtctcaagtaacccatttgatgctgttcatgtacaggccctgttatcattaataatcatgtaagcagtgttagcaggttttggcaaatgcaccgtttcatctatgccgaggaacataaaactcttatcagcaatataatttaatttcactgtacgtttttggttaggatgcagccaacaaagtcagcaaaagtgcaagttgtttttagatggctcagttgtattatagttatacttactgtacctcactgctcttaagtgtcttcaataacaaatacagtatcagtgtcagcttttggatt

SEQ ID NO: 67383 - DNA, 1956 bp, Homo sapiens
tgtgaagctgtttaaaatttttcaacagtagagagtgataatgtgccaaatgtgaaataaaattgcagaggtgaaactgtcaacgacttaagtgttactactgactgacagtgacaggattcaagaagtatcatagataccaatatgctatgtcacaagtataatatgaccagagtggatgtggtccctgctaaacaagttaaacaaaaaggcttttttttttcttcctagtgctttatattttcccccactatagaaaatgcatgaagactttttaaatggtgacatttatggccatgatagatgtgtgcttctacaagaccaagtccaggtgtttccattgggaatacatggaaggaattgatttaagcaagtgattacttaaaaaggaaaattaaaagagtggaaaatggataggagagaatgttaattgggagggtttcaagtataaaggagacttaaggatgggcataaatgtaaatgttaggaacacatttgaaataacttggccttagaaaagaggtttatagaagcatataatttaagaactgtaggttttgaaactgagacacactcattgccagacagaataagaatgaacatatctgaaatttcactgagaaagatcacagatatacagtcatgtgttgcttcacgatggaggtatgttctgagaaatgcgttgttaggcaatgtcatcataatgcaaaaatgtagattttttttttttgtggatcatagagtggatttaatcaaacctaaatggtgtagcctatgacacgcctaggctatatgctacagcttattgctcctaggctacagacctgtacagcatgttactgtaatgaatatagtaagcaattgtaacacagtggtatttgtgatctaaacatatctaaacagaaaatgtccagcaaaaatatggtattataatcttacgggatcactgttgtataagctgtacattgttgaccgaaagttgttatgtggtgcatgactgtatttaaaattataagaacacacaatcccaaggtcatttgattcaggccccaataaagcactaaaatagtccaagaatcttaccttttcccattagtgaatgaaggcattcttcagacttcctagttgaactgatgcaatgatcagtggaccttgaatcaaaggaaacaaatttctgtttatcttaagccttctcaattgtgcttttgtatgcattcatcttattctttctattattcttaacttagtcatccagattgctgcttaaaatggaaaattagcctaaaatggagtgggcaaacaaacaaatcgatcactgtccagagtttctgaatccttaacccatttcttacaagaagagagggaactattttctttaatattgaaaagacgttacctggagcacccctaatcaaccttggtccacaagttgaatgatgcagtagaatttagaggattctgacattcagagaacagcagccaactgtcagaaaaacggtaggagatggtaataatgacctcgatttaaggtcactggtgcttgaatgcttgcggtattttggcactagctatgccacgtcctgctgatcatggaacaggtgccaggttcactcagtggggccaaaggaactttgagtatagtgacaagaggctaaagagcctcagccgcttggcttataagattgattcttaatggaagattgatctggattgggtgaatctgtgattttttttgttggtagggacttgaaattggtgaatgagataaacatgaagttcagtctccttagcagataacaacagctttgctctatatttctgtcacctagcacctagtaggagcttgactattgaatgaagaatcaactgaacacattttctaggtagacttataatagaattaatatctacattggatttgtaaaagtaatgatggtaccagtatacatttaatta

SEQ ID NO: 67384 - DNA, 2328 bp, Homo sapiens
agatcatcttatattcaggattcacttaaatttgaatttggatatataaagtatctacttctggagataaccttactgtttttttttctaagaaattctaagcatttccagagaattgattaaaatttattaaactacagaaagtgaaatcagaagactactgaataatttcttaaaatcatgttaaaatatataaaatttatatgcatataagtatgctaaaagtatacagaaaagaaaaacgtggaagaaatgcaacaaaatgctaacagtggttgactgggcagtgggattcgtgttctcgttactcctttattattttctgtttcattttctataatatgcattattttaataattagaataaaaagaaaatgtaaatgaacacttaaaaagcacatgttaaagagaacacttgatttgatgtataggttcatcctttgtaggttaagcaaatggaaagaaacttctttgtacaaaaactaattccatgtgggcattggatacctttctcagagaaaataggttgtctagccagcacaccttgtttgttttttaatctctaacaacgttcaggatatcatacaaaagagaagtcttggaaattcttacatatatgatgattatttttagagatggggccttgctatgaggcccagactgaagtgcggtggctattcacaggcgcaatcatagctcactgcagcctcgaactccggggctcatgctatcctcctgcctcagcctctggagtagcggaaccactggcacatggccattgtgcctggctttacataagttattaagacttttgttttgttcagcatatctgggtaacattgcatggcctatcccaaagtctgaaatattttaaattccaactgacaagatgttaggacactcaaaggaagcattgaccacacataaaattgtttaaatatgctcagcacttttcagactatttcacattaattcctagtgaaataatgtagaaagatgactttaagggtaaaggtaatttaggccttttttgtttctttttttttggtgttgacttactctgactttgagtaactcaagtcatatatttccagtttcctctgtgttactcctcatttgacatcttaagaaagtttttggttttgtttttgtaaattgccttatttggaggaaatgcatgttctaagaaatttgaacacaagtgtatccttgggatgctatttctcttcctttctctagtgccattttttacatcacacagatttggaaacaaaatgacgtatttctttgcatgttgtgtgatgagtggaagaaaggaaaaaattagcaactctctgcatatacaaagagacatttcaggatctccgaggggatatgaactcccaggtactagtagactaagcctctttacaaccttacaaaatcctgtacagatgacctgtgtgtaaaatgcactgcctgttgctttggacatcacttgacactaaaaagctatgcattttgtatttttgcatgtcagaatcttagccagaggaattaaaaataaatatttaagtaggttcctgacttttcctatcaaggaggcactgagacaggcaatttgcttagcaagtctttttgttcacctgtttttgtgctgcggagaaatgtgatgtttgcttctgatgattccaaatgtgcgtgcattatatggtcagagcagagtatagaaaatgccagtgctatctgtgcaaggctggatgataacatgtgacccgagtgacagaaataaatgtgtcctggcaaaaaggagtcttaatctgaatgaaaatattaccacacagtgggcagattaatcttggcagtttatggcaatggccctcatacataaaacctattctgtgttcccacaaatgcccaatcaatcagtagacagctgccccagtgttaattgtgaccgtgtgggacacttgggtaaaatcttcccatgttaatgatcctgaatttctaaatggtcttatcctaaaaattgattcttagtttaagcaagattagcaatgtgggcctttcagcttttttgtttgattttttgaaaatgtttatatatttggggtttaaacaaagaattttttttttattttttgccgcgctcagaacatcttagctaatatatgaggtaattaaaaagttactgtagaagtcttcctgtctggtttgattgatgctagtagttggttaatcaaaaaaagtcataacaaattataaatacataccttctacttttcatgttaatattaaatctgtatatatatatttttgtttttttatttgccaatatttgatattagg

SEQ ID NO: 67385 - DNA, 3215 bp, Homo sapiens
acctcatgactgtatgtttctattttcctctctcagcctttctgttacttttgtcaaacattttacttttatgcatatgctataaaccccacaatacattattattgtttattcaatttatcttttaaaaattaaaaataatttaaaatatcttttaaataacaaaaaagtcttacatatttactatatataaagtgcattttttggtgcacttttttcctccctgtcaacctatatttctattattttccctctgcctgataacttcctttagctttgcttgaaatatgggtctgttgctgatgaagtgttgctgcttttattttgcaccccatctccttttttataattgttattgttcaggcaggacagtaaatcttgtccctgttaacttcattttggtgagaaatggaagtcttcgttagttttaaatgtaggttaagttgtcggtagttaatgctgaattctttaatagctgagttgcagtaacattaggtattcactgtgggtgcctctgacttccttcagaggtcaatatatagggatcagggtggataactataaaatccaggttgtattcctctgtacagatagtgtagctgtattagtctgcttgggctgccatattaagataccatagtgtgggtggcttaaacaacggaaatgtatttctcaaagtctggaggctggaacttccaagatcaaggcattggaaagattggtttgattctgagactcttctcttggcttatagacagccagcatctctctgtgtgtttgcatgacctcttctttggacatgaacatgtgatgggggaagacacagcaagctctctgatggctctttttttaagggcactaatgccatcatgagggcctcacccttataaccttgtctaaccccaatttcctgcaaagggactgactccaaataccccctcgtcagggcttaggacttcaacatgaattttgggcggatacaaacatttggtgtatatcagcagccacaagttatagtgttctgtgaacctgaagctttctccttataacttgtgtagtttgtggttaaggaccagagccatacatctgctctgatctctttcttacccctctaggcatctctgtggtaatataaggaacactttacccatcaatagattagaaccttacctgtacttgtctggagagagaatttttgttcccgtaattctttttgaagtgtcaagaacttatttagtttcactggattaaagagagcaaaattatcagcttgaatcaggagcaacttgaaggagagatcagggctatgaagcctgttgggagatctgcatttataaggagatggcttcagcaaggataagtcatatcttaacatcttagtcttaaaggacagatttgttgcaaagaaaatggaaatggtaggaaaaagtgctaagtcttttttccgtggcagcatttcagaattgtgtattgtagctcaatttttgctgttgcctctcccttctgttaatattagagtcagaagcctgatcagacacagtgctgttttttctgcctaaccaaagctgtggacccgtgaaacctgtaaagatattaaagaattgagaaatttcatgtgagtgaggtggttgaattttatttctgttgttaatattaggtgattgcaaatctacttattttgttacagagattccaggatgccaatatgcccttaaatttgttcagaattttatgtgggattatacttttatattttaatttactttgtaacttgttagctattctttctctaaacatctgagagatatttttcttcccggctttaaaatttaattgaaaaataaaactgtgactatgttttgttaagttaaacaatactctctgccaggcttcttaaggcaaataggattataaaatcttacatgcccagttcatattacttgctctgaacaaccgattaaccactcccatagaatcctaggagagtttaaaaattacagctttcttaatgtttctcacatttgcccaaaggtttcaaagaaggtgccataagaaatatatgaaggtgcccttggagatataggcaaagaaggtgctgtggaaattagctttcttttagtggcatgtttgcagtgagattgggctattaggggcattttagttttcctgtacctaggacaatctgctacttacaatgattccctgatgcctttataaagggaaagaggcttccgtttttaggattcatctaacaaagtgttattgcttacctaattttttttttttttttttttttttttttagattttttttcactctgctaggcactggggagctataaggactaagaggacctcttcccctctagaactgcactactaaattgggtagccattagtcaccttgactatttcaatttaaagttaattaaaaattcagttccttagtagtacaagacacattacaagtgctcaatagctatttgtggctagtggctatcatgttggacagcatagatataggacattcctgacactgcagaaacttctgttggacagtactgtactaggagttattattcagatttatttacccacaaaatatggttgttgtagtagtgtttttagtctcagagtcatgttaacccaaagatggataggaaaacaaaaatatgctacaaggaaaattattatgggctattcaggtgttcttgttactgtatgtgcccctaatattaggattttcttcacagaacattatcattcaaaaaagaagtcattacatatattcaggttcttacaaaggctctcatgttactgactaatctttcaattacagtactttattttgaacatcaaaatggctttcatgaatgtttgcttatgatgcttgaagaagttactggtaaaatcagatttataaagaagaaagatttaacacaaatttagtaatttggtcatgacctcacaacgacaagtgttgggcattattgtaaacaaccctttttaagaacagataaagcaacaccacaagtgtcattgctatggagatcacaacccctgcaggatctatgacaaactgtcctgctatttagcaaattggtacttgtggtaaccgtgccacacctgaattttaaaaacggctatcccccaaacaatctggaagggaagaccatttcctccggaaagtaaaaaaaaaaaaaaaaaaaaaaaaaa

SEQ ID NO: 67386 - DNA, 2618 bp, Homo sapiens
aagagtcaaatgaagtccgtgagtataactacttgattagcacgccaagtttttcttagcctatagcttcttcatcccttttttctccctcgaagtttaagaaactggactgcttgtcccataattgcccacagtctgattttgcttattatgtcttcctgatgttgtttaacatgttttttaaaaatttttttatttcttattagtcaaataagtctatgagattcagtcttacttttcttttttggggtatgggagggtataaagggtaagaatacttcataggtaggtatataatgtctgtacctttttgtatgcatgtgatgtcagtaaccatttgaagatcactgcgtagatttattctttcagtgagggctgcaaaatggtgaggatcttattctgccattccttcataaagagaaacttccccttatcatttaacttaagtgcaatatacatagaatggccagacaaatgactgattctttacctttatttactgattttcaaaataattagttggttctcagcacccttcaaaggtatttatgaaagttttgttttgctttagtattattttgaatttatagggttaaacatgcttcaatccattcaattattattcttactgatgctcaaattatcctgcttttggctagtggaagactcttttattatgaccccagaatctttgctaatatccttttctggttgcgataagatattccaggctcatcttagaaggttttttgttttgttttgttcttgcctcaaacctggaatcagctatttctcctagaagctcatttcttttagtggaaaattagaaactatactctggtccctgggatgtgcttattcctactggataggtcactgtttttagatctttttagtgtacagaactaggcaatgtattgttgttgtcttaaagataaaatgtataaggactccattttgactcttccaattcaaattcaagactacgtagctttcacttaaaatcatgtatttgtgttttcattcatgcatgtgaaaaatcctgacaccagcattggagattcttaaactgggatacatcatacgcacagtagtttctgggaggtaaagcttggcatctgcatttttaacaatttccacaggtgattctgatactcacccaaggatgagaaccactgatctattttttacgaactattttatgttatagatacttaaatggaacctcccattttcttcttagaatcccccttttctttgttgattgtccacattctttcttcttcttcttcttctttttttttttttttttttttttttgagacagagtcttgctctgtcacccaggctggactgcagtggcatgatctgggtcactgcaacctccacctcccaggttcatgcaattctcacgcctcagccaccggagcagctgagactacaggcgtgcaccaccacaccctgctactttttttatttttggaagagatggtgttttgccatgttggccaggctggtctagagctcctgacctcaagtaattcacctgcctcagcctcccaaagtgctgggattacaggcatgagccagtgcgcctggccaaggttgaccatattcttgatgagccacctgtgtacaatctgaattcttttcttgtttaactcattggtctgtgcatctgacagtaaagttgagttatttcacttctgtgaaagccaggctgcagttatctttgaccgcttgaaatgctaaaatacaggtgaacctcacaactaaggctctgcccaaggccagagagagaatcctccctcattgctttgagcagaatgcctggtactggagtagatttgcttaaaggcaactctgcatttgataaaatatcagagcaatttatgtccttgtacccttgttccttttctttcctcttaggcagaaatgttaattgacaatcaaaggagtaacaggtgcatacctgaattcacaagcctttggggcccatcttgaatacttctgcagatccaggcctggtttaggttatgccttctttcatccatgctcacctgagagttccagtgttttccttgttcttgtttctgcattcagagttctaaaatttgactctggctggtcattttatcacttctctctcttagagtagactatagatctatatctgaacatttagcttctaattgatttgtattgataataggtgaaaaagaagttaattagcctggaaatgactacaccataagatcagactttggttaaaaatttaaccacattaattttgataatcttttacattcatttaatattagctttgttttatgttaaatttgcaaactttcacatttttatcaatgttcttgagagggaggcaaagaaattctcaatttatgatgcaaaatggaacttcaggtcaattatttgacctctgtgatttagatcacacatcttataagtgggggagcaactgctcagtctgattcctggtatttttttctgttataaagcacactcttaaaaagaaagaattcaaagttgcttccaaaagtacaatataagaaaaataattttaggaaaggtcaaaaatgattagaagaaggaagtgagaa

SEQ ID NO: 67387 - DNA, 2189 bp, Homo sapiens
tatatatttatgtacttattgacttatacttctttgatggtttgctctgtatccgtgcagttttccatagtgcaggaaatgtggatggaatgaattttcctgtcattctcttatctgacagtctctgcttgatgtggcaaaggagaatcaggtgttcaacctccaatgagagtaatttctgatatcagttggtagttgctgtttaattctcaaggtgcagacaaggtggcggaattgacttatctcattttcacattctgggagatgatctgttagtcctgaggatgctgtcagttttctggtattactctccctgcgtggtcattaacaatagcagagtccataaattgatcccaggtttgaattgtaagttgttggccctgaaaacttggtgaacaaacttgctgtcagtgtttgtattgatggaaatagtctgaggtcagcttcattactgcaccctaactgtctcatacattgtccgttgatttttcggttgtgttgcaagagggttcttgtttcagacacttgctaccagacatattcacctcaaatatttacagtacaatgaatcattcaaacttaaggttggcagtgtctttttgaaatggtgttcatgaaggactgggttaatttatcagatacagattttgagaagtttttttctcttaaagcaaaagttcaatttgctaataaatcagtggcaactctgtcatctgacacatggatacttgtctctttcacactgaagcttgccactggtatcttttgcaagagtggacatattcttatctataaagtattttctagattcattcagaaaaaaataaagtgagaatactagtttccttcttgaataatggaacttaaagataggcctaggtatatgaattattactgttgcccattttgaatgactactgagctttggcgattattatcagcttatttctagaattatttattaagtagggaattttattcattgtcagatttgtaattttagctaagttctgattagatcaccttgtggtttcttgcaaacatttttagtccttgttttgtgtcatcatgaaagaaaatttaacaaaaagatgcatacttgctgtaactcctgggcatttttatttattcatttatttttagtcctgtggtttctctctataggtgattggaacacaccagacctctcagaagcgttctgctgtttccttcctcccagtaagcagattatttgcaagtgacttgaaaataatttcaagtattggagagctttcttctcagccacccttgccaatgttgtaggtgatgcacaaagttctgtaggtcagcttgaaatcatcatgcttgcaaggaaaaaaaaattaaaattgacttcaaaggacaactctgacacggtcaattaataattaaaacagttttttaatgagctatgcaattacctgtatgtccctggagatgatggtttatggtattattgcagtgccctttctttagtcatggcgcatgacatttgtaatttaaagccggctagacattaaagtgacagaactttcattaaccttgtctaaagtttgctgatgacaaatgacttataaaacatgctgttgtcaaaatataccacatatttaagtaccttaaaagtcctgtgggctctgagaagctatggagactcagagagacaccaagaccaccagtgtcctgtggaattacttgacagaatccccggtggctggcactatttctttgtactcaggtaagtggtacctgcttcagacaagagcttcatgtacttttcatggctctctggttcaggtaggtttcccacgggtttttataccacgtgacacgattctctcaatcagtggtttatgactattgaataatttcttctaaacctgctttgatatgtaaactttcaagtctttagaagcagttttattttttcatcttgaaaccatttagcaattatgttttgattttagctttttttgtatcttggctttctaaattcttagccctctgtttgcactatgccatacctctcttttgtcttctccctgtatttgaaattttcattttttgtagaaactatgtagaaacatcctctaatcttaaaaaattttctcatcatatttcttttagaagaatatcttgaaatgctaccaagggagatattgcaggtggatatc

SEQ ID NO: 67388 - DNA, 1088 bp, Homo sapiens
ataatcaggactggcatgcgagggctgagaattgcttgagttcaaaaatcagagctagtgtaagtgcagttttgtgtaacttctcttcggctgccaactgaccattttataattctttcttcccccgattgtatttttcttggtttcctgtttgacttatattccaaattcactttacatctttgaaattatggaaataaggaaatagaggaactgtatttcttcctttctgagtgtagcatctggatgctctggttttaaacgcgaaggggctgtaaaccctaggaatacaatgtcttttaaggaccggaactagtacgtcttcagaactgacttcaaatagtttatttcaccccattgatctgacctatatgtgttgatttttattatatagtctatactgtagggggaggaagagcctgcagttttactattacctcataaaattaattggtgcctaaaacaaatagtattaaagatactgtattttataacataccaagatgactgatatagtttctgtagggagtttttgtttttctgtgtttgtgtcaataaactcataaaatctgcagaatgaaatgagtcataatctcatttttactatcaaaaagtgaagttgagcagaagcatgaccacgtagttcctcccagtggctcaaacaagtaaataatttaacatgtcttcataacacagggttttgcttatatcaagaaacacaatcaccaccccttccctgttcaatgtaaggggcttagctttattggagtcaaaaaatctagtgcagtactttgtcagtcagtgaatattgtgagcttctttattttccctgttgcttttttacacaaatgtgggaaatgttggtatcacaagaaaatcagactacatttggtcttctaaaatgtaactccattgtccccatgctggactgaatttctttttaatgtgctgttttcctcaacccaacctttctatagggaagagtagtaagtttattgtcagtattgtggatattttaattgaagataaacgagttttctttttaaatgtcttcagtattacatatctttagttttattatcctaatt

SEQ ID NO: 67389 - DNA, 2534 bp, Homo sapiens
gaatgaatgtcagtatgacagtgatttttgtgatatggtcttgaagctttattcttcttgcctattagctaatacaggatcctaattagccattaacatgctcttaccttgtatggtccaaactatagaagcatatctcactgtatttcagagaatgtaactgctggttaccttttcacttattctgttttatgtatttcctttcgcattgaatattctccttttgtacatttctgaaatagagctgtacgcttcctgggcatggatagcattcgatccctttcaacatagcttcagttgcctgtagctatctacctgtttatttatctaaactaatactatgtacagataaattttgacatgatgcaggtttactgttaaaatgttatagaagaatcatgcaggaagacaactttaaaatagattaaagaagcaaaagttaatacattgtatgagttaggagatgataataagacttttgttttaagatatgtcagagttttaagaagggctagcctattgtgagagcttttaaggagtctgtgattttccttgggaatacatgtaaagtccttttctttttcttccctattttgctacccatttccctttaaagggagacttggtttgtttcactctattttcaaatgcaaattcagcttattcttgtcacgtgtaccatctctaaggatgatacttgctgaagtctaaaactatttagcgttcctggatcttacagttttaagtagattgttccttgttttgctccaagtgtcttgagtgatttggctgttaaaccagcagaaacctttgttttcttagtttcctataaaggaaataaaggtgagaaaataatgatttcctggataattcaaagagaagatttaacataaaatctctaacatgccactatacaaggacttgcaaatcagcttatgttacaactcagcatgacaattgttaaactcatttatttttaaagagcttttatatgtgatacatgttaaaagagccaagaagagagggacttttagcactgttcttcttgaatataacatacatgtttctgaactcttacttggggtatttcatttgtttgctcattcttgatctgcacagcccttaagctgtaagctttttgaggacaggaaacctctcgtgtgcattttatattcctagaatgtatttttttttcttgtgtgacttaccccggatctttatattaacagtattattatttacataatatttctctttaaattggtttacctttttacccaacctcatgcaaatcagtattagccatgaaattacaggtttgttgggctgtatcttcttttaatacatattaatatttacattaaaatcctaattattgccacacacggtggctcacgcctgtaatcccagcactttgggaggccgaggcgggtggatcacttgaggtcaggagtttgagaccagcctggccaccatggtgaaaccctgtctctactaaaaatacaaaaactagcccggtgtggtggcgggcacctgtggtcctagcaacttgggaggctgaggcaggagatggcttgaacccgggaggcagaggttgcagtgagccgagatcgggccactgcactcaaacatgggtgtcagagcgagacttctgtctcaaaaaaaaaatcctattattagaacttatagatttttatttgtataccacttaaaagtcatctcatgcatcacacttgaggaatggtgccctagcatagccttgcacattctcacatgtagtcactatttgtttaattgtggaggggagggaataagattaatgtacttcgtgtgtcaggtattgttttcaatagtttacatatggtttctcttttaatccctataacaaccgaatgagaaagatgtctccattttatacataaggaaagtgaggctcactaaggcttagtgactttcccaaggtcaaatagttcagtaaaaattagagctgagctatgaacctaggtttatctgatttcaaagcttgtactgtttttgctacatgttgtggactctcagtgattagtgggttaaccttgtgcattactgtctgctttcctgttgttattcctctgtagttagaatagagttgaccctgaatggtatttacagtttgtcatcttgttctggaattgcattttgcacagtcttgaaagttgttgttaccaccttctttttttttttttttgagatggagtctcactctgttgcccaggctacagtgcagtggcgccatctcggctcactgcaacctccacccccgaggttcaagtgattctcctgcctcagcctccctagctgggattacaggtggctgccactatgcccagctaatttttttgtatttttagtagagatggggtttcaccaccttggccaggctggtctcgaactcctgaccttgtgatccacctgcctcagaatcccgaagtgggattcaggcatgagccaccttgcctggcctgttaccaccttatttttaaggtttgtatgaa

SEQ ID NO: 67390 - DNA, 2495 bp, Homo sapiens
aataagacttaaaaatacatttaatataaaggctgacatatattccagctctgcataggatataagtgttcctcccacttagggttgtggtcagatatataagctttcttttttaatatttggaatttatggactttgcccatgcaatagtctcatgtccttttctttttcaaaattacaacgggtttgtggaatgatggactcacaacagttaatcctgaatgacttaatgaactgccagacaggttaaggtgaaatggtgttctaggacagatcttgatttgtagaattaagggtggcaacaaacttcaaaattgcttctttcattccagcaggtaattttgttagaggtaactcaagtaatcttaatatctgaatgtgttcagttttatcctgttcttatacaggaaatcccaatgcagggaagaaataaagtagcttgaacaccaaagatactagaaaggtagagtctagggagctgtcagcaagctttgcttctattttttatactggtcagttgtgacttttgttaagtcaaagaacttagaaatttagatgaagggaggctgcctttgtgcagccagttagctggtctgggcagtcaatttgagtggtgaaattaaggctttatctacttatatttgggaggaattttctggcagattgcaaaatcttgattaagttagccccagtttaatatgtacctgtggcgggcttttttttttttttttctttaatcctttacattttcttgttataaattatgaattggtccacttcttattagacagactttgtatacattccaaggcaaacataaagtaaaaatcatattttcaaatatgtaatagaataattgagatgattctcagatgcatgtcccttagtagagtcatagtgaaggcatttgctggctggctggaggcattgttttattgtctgtttcaactcttgagagaaatgaacagatggagacctgtattagaagtactcacacatagaaaaagctttggaatatttttagcattgtactcaggagcagcaaatcctatttccacaattttgtgtatttgttagtgtgttatcttgttaagccttttttcccatctgcatttaatgggtcagttgtttctaacttgttcttttgaaatttttaattgaaaatctgttttttttttttttggaaagcacattttacaaataaaggctgttcagctaggtggctaggtggtaaaaactaaaatgagtatgaatgtatgttttctgtaagggttctgaaaacaataataggatctctttaagctctactgtatagggaggcgagtgatccatcaaaagcacagtcttagatttgggtcttctatttagattaggaatgttaagaaagatggatggtaaatgtcttttagctgtattgtccccaaaacatgaaatgaaatctaaagactctcaaagaaggtttcaattacactagcaaatgacttgaacaaggattgggtaaagggaggtcacgggccagtggaatgccagttgtggatttatattgtttaaaatgaaaacattatttccattaacccctttccactaacacctccaccagagttattttcagactgtacgtttgtaggtgttagtcatacttgatagaaatgccttatcacaagtgtgaattgcacagcctttccatgggtatatattttttccttgtccaatacacaatccagggtttcacttggctaatcctctagagaggtactggcatccctgtgttcttcaaacttgattttaaaatgtagcagtaagctacccagttgcaaagaagcatttgtaaatgttttaattaaaaacagaatgaatggattctgtgttgtggttttctgtgataacagccaatcgactgccaaatcacactgtgtacttgagtttagggagggaagagtctaggtttaagggtgactctcaatggatttgcccttaactgtcaatgtgggtttgagtgtggtttttgccctctcactgcaaatggagaaaagagttggtaagcagaagatgaagcatccttttaatgagtcggctatagtgtgcactcagggcagacactttaaaagagcaccattaatttgaataaaacaggagaaggtaggtactttgtacatccataaagcactgaaggggataaatccaattatctgttcaatatttaatggccatgaagttaaaaattttaaaggcagtacctcggagactgcttagtcaattctgtccatattatttttgacattcaaaagtcaaggtagaatagccatattgatggcagtgctcatcacgttggtctgccgatttagtggcagtgaccctgggatttgtgtttctctacacagatgaagatcagttgcaatttttttttttttccaggagctcttagggaaaccttaggatctactgagcttccaacctgtttctttcagtcctttgctattggctcttgctatgaa

SEQ ID NO: 67391 - DNA, 1001 bp, Homo sapiens
tatctttcccatctttgtttattaattttattttttgaatatgtggaacactaataagctttccaaattcaaaactctgtataaaggtatactgagacatgtattactgctagaagttggtcatttatttatagcaaatggggttcatctcttcaagtttaaaatgatcaactttattttttaatcaagcatacttattagatattcaaagagaagaaaagcaacccttgattcttgtgaccagccttagctttttgtatagtagaaaataagagatgtttggttcacagataaggcaagtgacaggcacttcacgacagaggcttgcttagcccctttgtctgtgtacaatgggttatgttccctgcttccatacactgttgctacttggttgttgttgttgtttttatattttacttcttgatgctagcttactggtgataaatttcattagttcccactcttctagtttaactttgaaaacatctttgaatagtgggtatatcaactatatgcatttttcaagggttaagctcttgatcacatgttgctttggttgaatgtttgtctcctccaaaactcatgttgaaacttaattcccagtatggcaggcagtattgagaggtagagcctttaaggggtgactgggtcatgaggctctgccctcatgaattgattaatctattcatggattagtggattaatgagttatagactaataggttataatagaagtgtagaactggtggctttataagaagcggaagagagatctgagctagcggactcagccccttcaccatgtgatgccctgagccgtcctgggactctgcagagagttccttcaaacaagaaggctctcaccagatgtggctccttgaccctgtacttttcagcctccataactgtaagaaattaattccttttctttataaattacccagtttctggtattctgttataagcaacagaaaatagactaagacatgtgtctttgtttt

SEQ ID NO: 67392 - DNA, 2331 bp, Homo sapiens
ggctcagaataaggagaaaagaggcattaatggctcatgaatgtgtggatgcacaactctaaataagtaccacttacgactgtctcctagtatgactatgacttctctgttttagttcccatctttgagactacaagtagctcagattcgattttgatagtcgcacatccacagtataatttacttacataacaggtgttcctgaagataagtaaatgtaacttattcctactaacttctataatttaaagaataaagcttcttttgtattatataattattagattatatatctaattaattattagtagaagagaaaaaaaatcatccatgaaccatctcctaggaacagatgaccaatattgatagtttcttggatttctttataggcatttttgtctaaggtttttccttttatctgcctgttttacttagttgtgatcatgctatatgtatcatctttagtcctgttgtttgcacttaatatcatgtcatgtgttttcaattgttataaacttttgtaaacacatttaaatactgcataatgttctttggaatttacatagcataatttaaccattctcctcagtttttgaaaactacatgtggtattttcaagttgcttgcttttataaacaatgctttgacaaatatctttgcacatatgactttttccacattgaggtgatatttccagaaataaagttatgagattaggaacaccgtgtatgttattttaaattcacaaggctgtgtgagtgaagacattgttttgtttgtctgttgttgttgtttacattttttatttggaaatcgtttcaaacttactgaaaagttgcaaaaatagtacaatgtatacccgtattcattttacacggattcgcctcttattgacattttgttccatttgctttatcatttgtgtctgtgaactctccctctgtctttttcactccttccttctttatctttttcccttccatctttctctgtgcattttttctgaaccattctagggtaagttgcatccaccatgtctttttgcctccaaatacatcagagtatatttccgaagaataagattttcttatgtaactatggtataattattagcttcaggaaatttaacattgacataatacttttatctaatcttctgtcagcattctccatatttcagtttggtcagttgatctaatgatatcctttatagcaattttcctccctacagtgcaagatccagtccaggattacatattgcatctagctgttatgtctcttcaatctactttaatggggaacagttcttcaggctttctttgtcttttgtgacattgacattaaaaaatatacagaactcccccacctcttttattttttaggtaaaaaagttttgagtttgatgttttgtcatgatgagattaaggctgtgtattcccaaccagaataatactgaagtaacatgtccttcactattattctggagattacactattacatccagaggtacccaatgtccttctaccctttgttggtgatagtaattttggttatctgatcagggcattgcctgatttttctactgtatagttactatattaacccttacaactaataagcaatccgtgggaaggcactttaagagcatgcaaatatcttgttcctcttcaaaactcaccccttagatttaacatctattgatgatccttgcttgaaccagtcttttctatggtgattttccaactataacacttcatcaacctttaccagtcagtagttagcattctcctataaagaatttttctatccattcatccacccatccacccatccacccacccactctcattgtctgtcagtctgtctatccatctatctgtctgtctgcctgtctgtcagtcgtattgacttatagactcccctttttagtggtgtatagttcactacttttcttaattattttggtgctcaaattgtcctagatttaattggtgggggcccctttagattgtctcttgtgttcttctaatatgctcccatcattttctcagcactaactttttctggtgtgagatgtgctaggcttatcttgtcctttccctgccctagccctgtaatcaaccatttctctgatgacttctgtttttgttttttgggtagttttgtttgtttgtttgttttttttttagaggagaaaggtattagaaaccaatattggggtgctaggtgtgctgcttactaacagggtagatttgattctaggccttttttaggagacaggaaaaataatatacacacacatgcatgtgtgcatacacaagcacatattt

SEQ ID NO: 67393 - DNA, 3844 bp, Homo sapiens
cttcactgcaggacagaagcagtggaaaatttaggatgaaatagaacaactctaaagttaatctccagcatatctgttttggaaaagaagtattcccttcacctttatgtgctcctaaaaataaataaataaataaagttagttaagtggtgacttgttgaaggttggccaacgaatattgttgaaatgaccaaaatgccaaaaagccagcactaaggaaaaaatgttatgtagctcaaccctggctctctgaagagtggtcaagatttatgtttttaatcctatgctacagtaatgaagcacaaccatgtctgtagcacataaattgatacaccattttttctggttttcttgtaaaggactttcttctatcttaaatctaatgtggtcacattcacaaggacacgcgccctttgcttccaccaccaatgacaaccacatctttattattcacagacatatgtggaggccctgccaaactgagaggcatctttgaagtcaaattttgtagtgctcatagcacgttagcattatggtccctcaggggccccttcatcatctggtatctgggacagtctcccatttggatggcataaaaataatctaggttctttcctagggatgagagatttctacagagttaagctaagtacacaggtgatcctgtgtgcatgatgaactctttgaatgtcatgaaccaatggtacaaatggaatgcatgtaccttaaatcatttctttaaaaaagaaatacgggacagaaggagaataaaatgctatgtagcaactaaaatcttttggactatgtttaaataatatgtaaaattaggaaattagctacagtgagtcttttttaaaaaaagttggaattacagggtttaggatttttttcttgccctcttcttccatgtttgaacttaatagagagttttaatatccttccccttattaaaataaaccattaaagtaggcaaggttaagcaagttcacatttcaaacatctccgattgctggcgatttgtcactagaaagctgtggtagtcaccttggaatctgcatacctttttttgtgtttatgagaataatctgtcttctgctctctcacccaaatccttcttaaaggactggggctctgctgtagaaactcatgtcagcataatatgccatgtacctctataatgattttttttcagcattttgttgagccagcttcagaaacagcagtgagtatgtgtgtaaatgatttgctttaaaaagcagatgtagattaatgcattggtttagtaattttttcccaactctttccttttccctttatctttttctcccccttcagttctctgggataatcccaatgagaaatctgaaagaaggtagaagaatttgtttgttttctgtactttacgtcaatgattcccaaacttggagagcatcaagaaatcctgaatgcctgctgtcacccccaaagattgtgatctaattgtttgggggtgtggtttgggctttggcatttaaaaaatatctttaagtgattctaatatacagacaagtttgctttctgctttctatatatgaatagctgaaaattgaactatcaaaggcaagtctaaatatcacacgtgtatttgatttttataaatctgttgtgccccttcctactttatgccaagtctcatttcctctgtataagaacatgctataaaagtaatcaatctctgacccacgaatttttccctttcttttggaatgaataatggatgaacattaattatctctagcgttttgttttgtttttttattttctactttttaaaaaaattggcttcaaaattttaggaaattttgcatcaagactataaaacaaagtcatgtggctcgtagggaaatcaacagagctcctgtttcagaaacttgattagcactggaaattgaactttagtttttgacattgggttccacactatgcaccatctctgtagtgtgctcagtctgcatgcagattgttttccttaagctctttataaataagatgacattaaaagaatagtttaatcatgttttcgtttttcaatatgtaacgctagagaagacgagaagtagatttcttcatctcataaaacaaactacctttgcaataaagttctgactaaaacttaacccggcattttttttttcatttatcttggttattgcttttcacatgtctcgtggttcttgtaaacatgattttccctctggagctagatagaaagctaaagtcataaaggaaagtgttggtatccaagcatcttgcttctgatgtttagccttaagaaatatatttgagcttaaaagaaaagtaataggtttgcttgaattttcttacttttccttcacattctcttttactgcatctatggatagctctaatacttgctttagatagagatctgatgtaattttataaagcagtgctgtaagatgactgcaaaggatgttaatatttctgttgacactgccttgtagatttccaatgagcatgtgcagatgttaagtctgtagatctagatctgtaagcacaaccattgtctttgttctaaatgtttgaatttgttttagatagtcaaaatgattactctacctgtacatactatgaaaaagggcttccctaagagcttgggtagttttttcttctgaccatccagaaaggttttttgttttctttttttttcttcaataaattcagccttttcatagcagatgatttattaccgtggtcggtgactctgtatttggctgatttattgaaaagtccatttattatcagtaactttagtttatattcatggtaaggacagtgctaatgccataatgctttgtattttctcatttttttcaggtttgttcctctttcatagctatgtggattaggaactaaaactgaaaagatcccttgtcaaatttcagattgaattttaagatacaaattttaatgagataattttggaatgaatggaccctataaggttattcagagctgtggatttttttttaataggggaataagaatgcattctgtttttaaaaaatgctacctctatgttttttttttttcagatactgttaacatttgctcttttttctaatactttatttactaagacttcattcttctgtttgattaatgacaaccccgaaaagtatattttatcccaacttttctattaagtctttctttccttcagtcttctgtgaaatctgtttcatttaaaatttttttctaattctaaaggtagaatatctttatgttgataaaaaagataatccataaaagtatagtttagaggataaaattcagctataatcctaccactcagagaaaaatattcttgatattaatatttttcaccttccatgcatattaccatgcctagttcagattagactcttcttgtttttatttatttaatattgtattatttgcagtcttctgtctttgtaaatattcttcaagcatatgttttaaagactatataataattaattttgtggatgtatcataattgaatgggctatttctccttttttttttttttttttttttttggaagagatggggtctcgctatgttgcccaggctggtttgcagtggctattcacaggtgcaagcatggcatactacagccctgagctcctggcccaagagatcctccctgggcccaggagcctcagccttctgagcacatgcgaactacaggtgcacaactactgtgcctggcttgtttcaccacttttaatcctctagatttttccagaattttgctattgtaaatactgctttcatgaatatctttgtatttgatctt

SEQ ID NO: 67394 - DNA, 3117 bp, Homo sapiens
gtatacttttttcactttctgagctttttgttttattctattctgtttcttcacgcagcaaaaccacactctttcacttgtagaagctgtataatattttgaaatatctggttgtgcctgcctcttccctatcctgatgtagaacacagacacacacgtacactgtttttcttttttaggttttcttggtaattatttggtctgtttgtttttaatttgtttaagtttttatagccaacagacctagttggcatctaagtagctagcatttctttgctatttctagagactttctttgccacctagtatcgaccaattctttgttgatatgtcatttattctgaaaaagaatgagcattttatataggctgggtgcagaattttgtatgtacatcacacatttctggaaatttaaagtttttgtgggcttctaaagcaaattatgcagcatgtgtaagattcagggatatcctacagcctgctctcatgtcatgttcatcatataggtcagtgggtagaccgcaggtggactgtgaactggctaacgctatgtgaaagagggtttctatatgtgatttttctggagagaagatacatgaattttaaagatgttttatcatcacaaaaagttagactgttccaggtaaaggtgagaaaaaagactggaatttaaatactctgttaaaaaaagaatgaggatggctttgaaaaattgaaagatgaaaaaaaacagctctttttatactatggtgctcaggatacattgactataaaattaaagtgtgttttaatatattagtaggtaaagtttctgagaggtgaatgtctacatttacaataatggtgttttctctcatatttcttttaggtaagtgacaatcttatgcttggatacatcagcttcaaaatggatggattttgagggtttcattcctcttctctgatgctgtagcagtaagtcatacttctcatgtgtgctctgttctggtctggtctgggccaggggattggcttgacaaaagaaactagataatttcttgtaaacactttgcttcttttacttgatatacgtgttttgttaagaactctttgtatgtgtagtctctgagattgcacagaagaataaaaggaccagcttccaactttcaagaagactggattttcgtaaggatacaacagaaagaacttgggttttggagttgtattaggtttgaatttcactttttcattactgtgtgataactcagttggatatctttttcttcttctatttcctcatttactcaataggtgtaataataactacgtatcagattgttgggaagattaaatcagggaatatctatccttatcacagtgctccaatatatagattttgttgctcatttcttctttccagctctatcccatggctcagaaagaaacaacaatgtctagaacatataaaaatagagactaactctccctcctgttatctgaagggtctttggctgagattcaggaaatcttggagaccaggcaccaaaggattttgtaaaggaatctgtagtgggtctaagtaggcactttttaaagcatcagccatcttcttgaatgtcatagtcacattaaaagagcctagttaaatgtggcttagatattgtttcacaagtggccttagtggaatccctgtaaataaatatgttagaatattaggttgggaaaatattgttttgtttaatctaaaatggaatttaaacaaatgactaaagaatgtaagctgagattgtttgatctcatgtgattctttaaataattgtcacattgttgtgtttagaattatctagctatctggcctagtaaacagatgagcaatattcactgagaggggaagtatatacaatttggtttggaacgtggaagagaaccatgcttaagttggagagacacaagtcagaaaagtcagggggagattcaggcatggccattttagttcatatggctcaaatacctctaatccagtggcataaggcctgacaagaaatgttcctctctaaggagatgctggggccaagggagactacagttcattgcacattcagagattaaaatatctccaaattagttccagtgaatcattttaaattattttaaaagccttttatattttaatcagagcctattcacgaccagttaatttggatggcacgttctaaaattactttcccccaatgatgtgttgtgccactgccattgaatgcagaaacctcacggaagaggggattaaggaaatttgaaagtaccaaggagctgttgatcttagtcaagtgtttactggtttatgagtagattaagatttcgttcttgtcatctgatttggatgggaaaatgagtaatgatactcttgtagagagggtgagtgattccataggatgccaaaagtatggcgatgtgcccatttccccaaatattcagggaagacttgatgctgtggcattgctgcagtactttcttcaatatttggatgtagtctctgggtttagggaggtattgttttaaccatctttgctagtctcaaaatttttatccaccattttgttaatctgttctacaattagcaaaggggtgcatgcctgttaagagttccaactgtatggtacacttcctagtcattaacgtaactgatagagtacaatgtctctattgtcattgagaataaaaaaatgagctatacagatcatgtgttggttcaagtttgacttttatgctctgttattctcacttcaaagatgatgagactgaaactcaaagaaagaagacctgccttgggttacatatcagtttagtgatggaactctaggccagcgcttttactgatagtgatcttcactctctgctcctctttgactggggaggagccttgtgcttagctgtactattctacatcttgatacatagacttttcattttgtgggagagtagcagcaagtccttggaagttgttcattttgcagttagctaaggtagaggggctggtaatgttcagtttttctgtaccattctcctgatatgttggctcaagataccagaatctatcttggaatgttgtgtattacccattagttaccaatcttctgc

SEQ ID NO: 67395 - DNA, 1141 bp, Homo sapiens
gtactggccagatattttgaagaatgtccctcagtttggatttttttgatattttctcatggttgaatttgttatgcatttgtttgcaagaatgtgatttgtgtcctcagtgtaacgtatgaggaagtctataatacccatttatcctgttattggcaacgttaacttcaatcatttggctaaggtggtgtctgccacgtttctccacagtgaagttactgtttttctctttgtaattttagcatgcattctttcctatggtgtttgctaaatgatttctattcccatcatcctttccacatttgttagttgcagttctatcagtaccatttattgaagagtccatcatttctctagtgagttatgtttacctctgtactgatttataaatctacttctacatctctgctagcacctaactcccttcatttagagttttatacccttttgccttctcaccagtaacatacaaaggtgctatttcccctcagcctcataaacggagtatgtagtcaaacttggagttttgccaatctgatcagtgaaaaaaaaaatgttatgtctcttattatgaataaagttgagcatcagttcacatgttttgagccatttttgcttattcttctgtatactccctgtttatgtcctttgcctatttttctgtgggaatgctggtatttttcttttagatttcttagaagcttttttgttttgttttgttttgttttgtttttgagacagagtctcactctatcgcccaggctggagggcagtggcatgatcttggctcactgcaacctccgcctcccgggttcaagctattcttctgcctcagcctcctgagtagctgcgactacaggcacgcaccaccacacccagctaatttttgtatttgtagtagagacagggtttcaccatattggctaggctggtctcgacctccagacctcatgatctgtccaccttagcctcccaaagtgctggtattacaggtgtgagccaccgtacctggaccttaggagctttttatatgttaggcattataattcccttgtctgtgataggttgcgaacattgtttttccaagtatatcatttgtcttttggctgatggcattttgttttattttgctatgcacaag

SEQ ID NO: 67396 - DNA, 1013 bp, Homo sapiens
gatgaattttccatttaagcctctttcttctttcttatctggcttttgaagtctcctgcacaggtggattcctttatgccttctcactagatcaggattttaaaaatgttcattgttcatctcttcatatacgttatagctgcctgggctccctttttgacctccttgggctgatgatgtgtgacatgtgacactgtgcaactagagttggtatttgccaatctgtatgcttttggtttatttcatattaccggattaaaacgaaaatctatttcattccagtagcagcagaaagcacaaaatcttgaggttcctgccaatattctctttttggaacactatcaaaaatgtaacttttctgttggaataagtatttttctggccaacatctccccctctgcccctggcttctgtgtgatgaaataacattggcttcttttagctcaagatttggactatttaggagccctttcacataagaaatggatgtcttaactaattttcttggagtagagttgattatgaataagtactaggaggaggggctatgtagaacctttgtaatgtaatatggcatagtaaaagcaggactaaatgagatttctcaggattgggatgggggcatatccttcctatgtcatgtgattttaggtcagtaaccaacacagttgggaacttctccacagcttttggccgctccacatctttgaagagtgctggcctgcatagtgggatagaaatccaggccttcattgatttattccttttggtttcagtcccagatcttgaactgtgcagggatttaaactgatcagggacagccaactagctgtagtataaagaaatgagctgttgtgcttgggggaaaaattgtttgaagaactaaaaatgacacatttcctttaggcagaggaaagttaatacattggagtgttactattttttaagggggacgtcattccattctcatttccagtgttcacatgtaaaaataagaaagagtggggcttttg

SEQ ID NO: 67397 - DNA, 1097 bp, Homo sapiens
tttttttaaacatcgaagagcacctttctgctttttttgccgtcatctgtatgtcatgttcttgtccatctcatcatttcacattttttaaagctctgtaaacagacataatgcaccctctgcttccttttcagcatttattctgttgctcttccccccaccctcccattctgcctctagactttgtttatttttcttagagaggaattctaaattaaacaatgcaagaaaatgaaaatggcaagggtacaacattatagaggactaaaggggaatagaagtaagttacgttattgaaatctcagtgtgagggaataatgaggataacacaggttaattttccgatgtgtcctttacccacataattgtccaggacatagatgttatcggagagaagctaagaagcacaatttgtaagagtcttaaaagggtaatagaagacacacttaggcttagcatcgttaatgggcagagaggttcaggtcatagttgatttgagtctgctcaaaacattgtgcagcatgttgtattcagtgttctggttaggatgttggggatggcccaagggcccaataactaacagtgtataattttgatttgagtgcttaagtagatatgttttcctgaaaaaacatgagcagtaaaggttgacttggatttgtatgcggcatgtttccaagggggacctgggaacagatgtgttgtctgttctgaaagcattgggatgcatccatgttttgcgtacagacccccttctgtctggtgcactctgccctctaaaagcttcctgaattgctttgtaaacaaggcagctactacagctgcaactgttgggtttggacttttgccagcttgaaatttatccctgccctaatgctatatatctgggagcaggcagtggaatttttttttttttttcttcaagcttatggaagcatttgctgaggaagatcgtcttgagggtcaaggaacccagattccttaaaactgcatgcattctccgtggattattttgaccaccaggtcagatttcagcacctttcctgaacttttctccagttacttagttgggttactgcttcattaaaaacccataa

SEQ ID NO: 67398 - DNA, 1032 bp, Homo sapiens
ttcaatgggctcttgaatcttttatctttagtagactatgatgttatatagtttatgtaaatatttgtcttgacgtgctttaagtacttgctcttgtaaagtctcacatttgcattgttttattgcagtcattctgtgtaaattaaaccctaatctcttcaattctattgtcaaggcctcactcttggcttgggtgtaatggagataggatttggttggtcctttaatgtggtatatttaatttaatttttcaggtagtgacaaacattggggtttgggctataggctctttgacattaatatgtataaactctgacctcaaatatggaacagtttaaagtgttacactgaatgcaatttgcagcacgaattttttttaaatatataatgtgaaatagtatttctggtccagattctgctgtagagcttagctgaagcaaacccccaatggcttatgctttcctgaggctaatagaatttttttggaagcctgtaagggtagtagtttgatatttatctctcagttctcatgtactataggatttttctaaatatagccatcttgactgtaaataggttacatgaagcagtagactagtagactggccgttcttgttaagtgtaataatcttaaccacttgcgtgttccactccccttataccctcgggctatactattaaagaagtttcattttctttttcggattatcaaaatatatagagcataaccattgagccacaagtgacttttgcattccaggatgggcaaggcaaatgttctctctcttactgtaagatcacactttgttgaagaaagacatcttttaatgtgcaaaaggtaaaagaggaaggagagcaaaatttttcttcacgtcaagttgaattattttgttattcattaacattgcttcttatccgcatctgaattagatgttatatagtcagacccaaaccataatgtgaggtaatcagatccacactataatataataaggataaatgcatcttcactacaggtgtcgtttgctttag

SEQ ID NO: 67399 - DNA, 1775 bp, Homo sapiens
gctgctgattttaagttcagctgcgtaattttacttgtttgctcagatgtcctttaatttattttctggggacctgatgacagtagcaagattttaaagttaattgctagattcaaggacaagtcccatgaatgggctggaagcatacccttagggcataagcctgtgtgcggatctgtgacaaagccctaattttgagtttatgtaatcatcgtaccgaaatatttaagatgggaatctatcaagtcttatctgttgagacgtgatcccttttatatctggcaggcctcatgcaacaaatttcctttcttttaagtgatctccaaagctgtcaagttcatttgagtgaactgtgcttgagagaaacatgtacaattttctctggcaatggcatgctgctgatgacatatttttagaattagctttttctctcccccacccttctagaaactgaacttttatttaagctccctgctgttaacattggaaagaaagtttcctgtgccaatgtttgcccaaatggaagaaaatgtttgcattttgtatgcagtgttcataaacttgatgagtctaacagtttggcaccgctggtgagcgcgtctgctttgagttctgaagggcaggcagaaatagtgtagtgaagcactgcagctactgtgaaaaggtgtggctgagctgctgtgttgagatgcgacaggtcgagaattcagaattcatttttcctagtgctttgaaggtcagtagttaagagagacatctcccacttgtcaagtagttgtaagcaaaagaatcatttcttccctcattcatttggttaaggttagctgaaacactggcttgctttgatttctctgggcaagattgttttagcaaggccgtttgactctctgtttctgtgcttttggttttagtttcaaagatcttgccaaactttgccagggcgcattctggtcttcaaaccctttgttctgaaagctggtgccaccaaattgaataatgtgcaacatgttatagacccactgtagaaaataattgcagtttgttttaacattaagttaaattttttctgtatgcaatgcaaaggtcaaggaaaaaggcattaaaaaacatccctgcacaagtgagtcatttgcatagaaaatgctccactggatgatagagtatgaaagcagtagggaattaactggtaagtgtatggcaaatgacctagccaaggatccaagcaagaatgatttgttccaagaaccagtgtaagacgatttaggaagatgcacttttctttggccctcatcctacagcagcattgaatcaggagaacgaaacagccttggctttgttcatcatcagtaagccaagaagatcacggcatgggtcattaagatttacagctcaaatgtaaataattcaggacccacaaacaataattaaaaaaccaactgcggcactgcatgtagtcaggtcctctgggcctctttgaagtaggaacctctcctgttttggctggagacctgtccatctgggtacagatggttgtaagagctttttaatgaccttttctaatgctggtgaatgtgtctttggacaccatcgtaaccaatggatgaggagggtggaaacagcaggatggtggcagctgaggaattaaatgtcctgaatttgttagacatctgcagaaacatgcaatttgttgggcagaaaattgtaaacaaaacagactgagtcaattatcaatacacctgtgacaccccgggatgccagctttggctgacagcttt

SEQ ID NO: 67400 - DNA, 1098 bp, Homo sapiens
aatacggtcacatcatgtatgcatgttctgtgattttgtcacttaatggaaatgtaggatttccagcatcaaactaacattacaattgtcctcttcaggtgttcactcgaatgttgaaggttgatgggtatgtaaatcaaaactcatttaaattttatccagttggcactaaggcctcgacttttgtctttgctctattaaaaatgcacaaacattaaaaaaaaaaacagaccgtagcgttttctaggtttatattttactgtgttcagtaactttcttttcattttttgttgtaggagaaagtgttttccaagtatatattttaaaaacagttaaactgaacttcgcttggggttttctgacaaacagaatcttgaaaatcttccgtttctgagtgtcagaaaaatgtacagtttcaataaaatcatagcagtcagtttcctgacaggtgcatcaagtctagaattaaatcgaaaggactgatgtgttaaaaacacattaaatatttaatgttaaagatcagcttatagtttttctcttatgttttcaaagggcacagcgaactatctgtgctgttccaaagagttgcacttgtaaaagggtctattcaatttagaccaggatccagaaatgtaggttatggctaagaggatgagataacaaatagatgtgttcagcttctacaactgacttggtagtttagtggccatgttgtccctgttgagatgggaaagctttctgattggtatgttacagctcaccgctgcatcaggcatttcttcaaaccagcatagtgttgtaattggagatcatcttcttgaagatggagccttttatttttgtggctttctggggagttgtaatgcctgcctgtttttccttttaatcagatgtttgagagctgcagcttcgggtcaaacgaacatattcacacctgatttttacagtattttttcagcaacttgagtattatgtttaaatggaaaactatcctgaatagtccccttttaggaaatagtctgtctgagagcggcattttccagcatttggtggatttgagagaaggcactgacacctgtaatttgtaacccagttaaa

SEQ ID NO: 67401 - DNA, 2139 bp, Homo sapiens
gcacattaaatttgggtgaagaggatgcattctgcataatgcctagagatgtctcgttacgatgcggttacctagcaacaagtggaaactgtatgaaaatgaggcgcttatctgttgttgaagtgggtgcaatgaaacttattacgctagcctgtttggcttggcatgttattaaaatcacagctaatgtggaaagaactggagcctgttctcatttgatacagaagcactgttaaatgctgctactgtaaaatggcaatactttggttaggaaaatagaaactcgcagcctccttaagcactcaacattgagatgttagagtttgatttatattatcaaagacttattaataaaagagcggacagaatctgtagtggtgacttaagaagcagccagttatttagatttttaaaaacattcagggagccatttatcgtttcatctataataatagcttagtacggccctgtttcttgtagccaaattgtctttatctgctgagcttattgaattctaaccacagtcttcttaagtttgtttaatttacagaatcggggtgcattgtcatgatctttaaaggttctctttttgtctagtcacattaaaacaatctgcacatattttatactatatactgatgcatattttgatgggaatagaaaatcttcttatccttactggatcatgggttttgttgttgttgttgtttgtatatatagaaaagtgtgttttctggctgggcgtggtagctcatgcctgaaatcccagcactttgggaggccgaggtgggcagatcatttgaggtcaggagttcaaaacaagcctggccaacatgtcgaaaccccctctctacaaaaatgcaaaaattagctgggcatggtggtgcacatctgtaatctcagatacttgggaggctgaggctggagaattgttgaacttgggaggcagaggttgcagtgaacagagatctcgccactgcactccagcctgggagacagtgcgagactccatctcaaaaaaacccaaaaaacaaaacaacaaaaaaagaaaagtgtgttttcctacaggtttgtcttactacttctttatgtatagtatatgtagcttcatatggaagtctaacttcactacattaaaaacaacaaggtcaaactgagaattctaccaaaatatcctctgtgggtggcctgtgatcctaacatgatatagcacctgttatcctagagatgaagaaaagttcaagtactttctgtgcttgtcagagacctgtgatgacacacagaaatctggcatacaggacccgactctgttagctgtattctgacgttacttctggggctttggaatgtgtttatgtgtagcagatggagctattagttagctgtgctatcttgaagaattgctttcccaggtaatcagctctgctcatttaggatgtcgtttccccacctcgatatgtcagctcaagaagcaggaatgattaattgctgcaactggacagtgcactagaataaggggaaccatcccctggtactcccattcaacagggagtttgaagtgctatgaggcagagcaaacaagatggaaacgatgaccaggatgcttcctgaagcttacctgtcagtatatagagttgctgtggcaacctgaagatttgcaattcataggaagagtagagcgagacaaaaccttaagtcatggctgtcattacagtggaatgggtgccaccaacacctggcaacctctattacttcaacttgtttcttttcacgcttggagaaataaaatgcataaaagattaatatgcatagtaaaccttttggtaaaacatgtatgtgttctgcatttcagatgagtaaaaacttcaagagttcccctctacttaaatcaatattacctaataaggttcaaagtgaggttaccatcagactcttgataaaataagaactatgatgcaaggataaagaaagcatattctctttcaaatttaaaaaaggtggggggatagataacagtgtatttttaaaattgttgcccctcctggaaatgcttataatgtattaatgtaaattatgtgccctctttgcagctttctctgtcaccatgcatagtaaggagaaagttagttctgggttttg

SEQ ID NO: 67402 - DNA, 1048 bp, Homo sapiens
tttattgtagtttggaaatcaaggtaaccaagattattagaagtgtgtgaaaagtatgttaatagagtaaatggtgacagctcgtcatcctttcccatgacttcagtagcacttacatggaaccaagacatttgagtgacttagatactcccttgtaggttctctggcactctggagagttgggcttgccacgtactgggcctcaaacgtgagatgttactgaaactatcttgtccaaaatattttcctgtgaaatcctttgaggcagtaacctttttattgcaacatagtacgatgttttataattttatcctttctggatttcctagtctgctcatatgcgcacacacgtacacacacacacacacacgcacacacacactgctagttttttttctctatagctaagctttattgagtgaaacctttaaaatgatatctctacattctgtcagtggtatattaagaattataacaaggcaagaaatagtgaaaataagaattgaggagcttatagacaattgcaaggcttctagactggatgctaggttacatgaacacacaacatattgatttggggaataagagctatatatagtttagatgcaagctatgacagatgggggttcatgagcaacaaatctgatgacttctaggcatcattccaaactcttaaaaaaaaattcaccagatgcaaggactcttgcctttcttaatgaattcttttttatataaatgagtcccatttatatatttcctcccatggccaattatcctgagggcattataagaattatgattttattattatttttccatttagtggatgtattgccacatggtagtagggtagttacattggtaaagttgacttttttctaaaggaacccataaatatctagatagcaacccagaaatgtctagatattttaaacctatataagattacaatctaatgatacgttttttcataaatatttgtacctttgtctttgcaatgcttttcaaaattatctcttttggaggaggtagaacaggttcatctaat

SEQ ID NO: 67403 - DNA, 1365 bp, Homo sapiens
ttaaggtggtgaaagtactcagttgcaactctaataagaagtgcaaaaagaagcagttccaagccagaagataatatcaaactaaaatatttccagcaatatcagcaaaatgtaaagacaatatcggaaacaaacatttgctgcctcctaccttctctgtcgattttaattcagaaaatttaagtgatttttctcatatcgaaaatgagttaaaatactagagagtcttttattccttataaactaagtcagagtaatttattttatctggaggagagtattaaattagctgtcaaccgtgctatacaggtggatggtaactattgaatgaaatgaccaaatctctggtcctgcggcattcatttttaatctctgctttccattgaaaaaggcaaaacatgaaatattgagataatagtactaaaactccaagtaattgcttttgttagctcaactcatgtttactcatattaattactgaaatttgataacccctttgttttttacttagcctgattctgaatgcagtggacagagctataaatcaggtaggtggttctcactaaggcaggactcttttgctttgatgttggcagcttaaggctaattctccaagcttgataggtttataattcaagaagatgtgatttaatgttgatggaatttatttttgaaacacattataggaagaaaacctttcaaagtaacaaatgaagttttgaggtaaatcttaaataaataaagattgtcaggatctctaaacgcccagcgttagctatctctataggatagttcctccacctttagctggagggaaatggctggaggagaatgagaaagtgaagagacaagatgtggaagctatagagccttatgaataagtcatgcatttaaagacattacttttttgtatcttctcctctttctaaatttacttgacattaccttcttttcataatgtttcatttgcggggttccttacaagttatttttccaaaggttaccctatttggtatgattttttttttgacatttaatttgcactataggattgtagaatgtggagaaatcctgggttcatttctttttccagtttgctgatacataaatttcatcccccctcacgccctcatcttatttgtaacactcatcctttcaagaggagtacatgccagacactgctccgggtctgggggatgtaagcagggaacaaaccacactgagttttctcatggacatccctgctttggacactactattactaggaccacctaaaatcacattatctacttctaattttttattattttttgtaacctcatggcattgttagctcagtagagctcagcagagcttagtgcata

SEQ ID NO: 67404 - DNA, 1034 bp, Homo sapiens
tgtgactaggaagataggccttgatcatttgagtaactgtgctctgtgaatccgagaggaaaacaaactctcagaagtgcataaaagttaagttaatttctttttctttgtaagccgatagactcttgtttaaatacaaatttgtgtggacagattttcgtttgtcatgcgtgagctgggtatgttgcatttgtctaaagggagcagttttaagtaggtggatgtgtaatacccgtaggctatcagaaccaccatttcaataaatcccttctcatataacaaccgtgcaggaagtttgggtaattgattctcctgagcaatacaaatattgaaattcttaattattccaagtgatgggcagagctactacttttatattttaaaaaattctgtttattattcttaggtgttcattaaacacttattgatcagcagtctacagccaggctgtaggctagatgctgagatgccaagtgggcaaaagggagaatccttgacctcatagaacactaaggaatgctgatcccacatggataattataatgcataagttcattaattcaagagatttttgtttatttagtatgtgctagatgctgggcattggggagggaaagacttgtgggatggggagaaagggacaatggtgagcgaaagcagacttggccctcatgctccttatggtcagggatcagttattaaatatatttagggccgggtgtggtggctcacgcctgtaatcccagcactttgggaggcctaggcaggcagatcatgaggtcaggagatcgagaccatcctggccaacatggtgaaaccccatctctactaaaaatacaaaaattagccaggtgtggtggcgtgcacctgtagtcccagctactagggaggctgaggtgggagaatcacttaaactcaggaggggcagaggttgcagtgagccgagatcacgccactgccctcctgtctggtgacagagcatgaatctgtctcaaaatatggtattatatatattatatatatggttttatata

SEQ ID NO: 67405 - DNA, 1052 bp, Homo sapiens
taaaagttctctaacagtttattagtatcattagaaaatgtagcctactaaaaattctaaatgatcattttaatgaaagctgtgtcatttgtgagtggcacttgcctataaatttttctagagctatgaaaataagttagacaagaggccaatggtttttctttcttctatttttttttacatttcccaaagctctgtgaacagctctgactgtctgatttgtttcatcgttgccttccactgcctgtagaacatctgttggaaaataatgcttgtcctgtcagtttccagaatcagcagcaaaccgaagtgtgcgcacaaggtagatgtcagcattatactgctgctgccaccaggctactgaaagacagaattaatcctgggctggtaagattcattaaaaataaaaaaagatctggaaaccctattcaggaatagaatgcttatcccaaaatggaccaagcagaacacaagcaaagtggtgattttgaactaaaggcacagatataggatgattattgcctgttatttagtggatgactctttgttctgagactaggttatactgttttgctggaagctcacaacagatcaatagtaattttgttatgggccagatgtcaaaacagaaatgtgctttcaaatcccactgacttgctgtgacaactagtatgctaaaatacattcgctcagcaatcaggcgttacacggtgctcctggagttctgttttctttcatgtggagccttaaagctacgtattgttagctgagtttccctgattttgtagttctttctctattacatatgtacctcttttggttgagaatagaaacacttcctcaaattctcccctttcctctgccttgataatgagctgggtgtaaagtctacaccataacttcctgttacaagtatcatttttatggtaataaataaaatctgtggtaggaaaatggtcacgaagaaaagcaaaccagcaagaagcatgttatttttttagttcctctgtagtccaactttggaattttaattttggtctggtgaagatttg

SEQ ID NO: 67406 - DNA, 1335 bp, Homo sapiens
tgatcatattcacaaatttaatagcatagtgataaatttctcacacaaaaattcctcaatgtatctttatttcatgatagaaaaccacctactgtttccaagcagtgagcttaatcttttcttcagtgtttttgcagttccacataggagttacagttatcattattaaatgtcttgggtagaggtgaaacagcattctggttttttgtttttgaaatctgtgtttgtcttatattcaatatctctgcaaactttacacattttgtatttgaatggttaaaacttcaaggctattgagtcatcattttcattggtgtgtcccatcatttctgtgagatacaacacaccccacccttttcatggaatgggagaagccctcagccagcatgtatatgatttctaagcctataggtacaagcatgagcaggcaggacttcactcctttggccctcgtcattagttttactttttttttttttcccagaagaaaaaacaccatgtccatattgctaaaatcagtgattgataaaatcttgaactaaacttgacataggtttctgtacttgaagaagaggtggtaggatcacctgaacccaggagtttgagaccagcctgggtgacataatgaggtcccgtctccacacactattaaaaaaattagttaggtgtggtgatgtgcacctgtggtcccagctacactggaggccaaggcgggaggattgcttgagccaaggaggttgaggctgcagtgactcacgttcatgccagtgtacgctagcgtgggcaatggagtgagaccctatcttaaaaaaataaaaataaaaatgaatgaaagccaaagcgactgagtatccacagttttctcagatactcagaaggaaaatgtcaagaacaaggataagttgggtgattattcaaatggtggcctgtgggtcctgttgaatctaatgcctccctctgtggattcagtggtgtttcctccaaactccccttagctgtctgtgtgtacttaatacatgaatgcttatatatgaggaggaacagttcttatctctgaagtagtaaagcatcttattgcatttgtttaatgactttgagatctatctggtaaactccaggttataatttctttctttgaatttgattgattttctcattcaaatatttccggaagtatttagtgaccatctatcatgtgctatgcacaatgctggagattgggaaataatggttcacaagacagataggatccctgttcaagagcttagcatcgagtgggaatacaggcaatgaaacaattacagtttatcacgtgtggtaagtaaggatagggaa

SEQ ID NO: 67407 - DNA, 2074 bp, Homo sapiens
ctgtaagtggggaagtagtggtctgtccccaagccgactgcttatcactgctatgttatattgcttagttcaactctagttttgagacactttactagacagaggttattgatgaaaacccagtcaaacccaaatcagcctgagtctagaatgaaagggaaggcatatacttcaggacaggttgacataaatctatttttagtcatttaaatacatttttgagaattgctttcccccttccaaatacgttctgagatcaggatgagcaaaagccaaacacatattttttatgttttgagattaaaactgtgtttgtcactatgttatagtcattagtcccctactgtgcttcacacatagcctctcctcacccctccacgtgcctgccccctgcaaatatgtcacagcaacaacaaactttagctttgtacatcccatcttccttacgtagaagctatggttgatttctccctctagtgttcctaatctgcttactgacctttgctatttaagctgacttttaaacatgaggaagagaggcgaattgattttctactagtaatgtgaaaaattagcgatttaatttcacaatatttgtaaataagaaaatgggaccaatggcctagtctcagattacattattgacttcccagaagttgtcctctagcccctacctctagtcgtgtggacatacagaacagagaactatggaacctgaatgaagtgtatgttcagatgccaacagatgattccatttctccctttagtttagtaacaacattattttcactgttcggaaaaagattggcttggtagacgtaaggaaccactttagtcagtgtggataaatgaaaaaacacaagtgatcagctttcatcatgacaaatggaaactgtcatttaatttttatccccaattatacagctccaggaccaatttttcaggtggaatgttggagccattaaaaagaaataagtaaactataccatattccatcatttttctggcagctaaccaatgatctgtagccttattacatgtacgtttttatagagatatttttctcttaagtttgcagaaggctttattaactctttactgatttcttctggaatgcatttttccaaatgaattccttttttctttttatcgctgagtgttggttgggatttactttggttttctctggaagctatactcattttcttcttttatgttttttttgattactagaattgcatggagccgtatttctttaattccaactgaagttatattagtggtcctaatgttgattacagactatgttaatttggatttcagaatgtgatttattagaaatataggacacacaaaaagacccgaccaaccaccttttgtctcctgccttaaagtgatactgaaaaagttgggtatccccaaaagtcgtgctcccatagcagtttgtccgttcttctaataggtcatgttgtaatttgccggacttcatcttcatgttccccagtaatttgaaatcttggtactgtggatacctttctatttggctgagttatctttgcatccacaaatttagcagactgcttggcacatactgggtatgcaaaaaatgtttttcgaatgactgattcaatgctttttaaaatttccttttgggactatttgtaattaaaaattatttaacaatattgaagtctagtctcttctgagaacactaaaaccctttacaattatgtgtgtagttttatttattccatatagaaaaattttacatgcagtgggtagcctttgaattttccaggtgggagaaattgagatcaaaggttactaatgatattaagaactccagagagaggcaatgctgtgattggaaccattgacttctgggttccaagcccttttttctccccaggctacacagctttgggtctttctgcttattgtacaatctgccattacttttattatcaaaaaatgtcactgatttatttttgatgtataattaacacagagagtggtggtgagaatgatggtcagaagatcggttgttttggttttggagaagctggttaatgga

SEQ ID NO: 67408 - DNA, 1147 bp, Homo sapiens
cttgtctaggtattatactagagatcactatttattcattatttagttcacttccagctggtcctacagatgaggggagttatgcaggtgagtacctgttatgtttgtaccatatatcagattctgaaacttaaaggaatagtttgtacctactttagtggagtccctgaaacctctttttttctagctgtaccttagctgtgttattatcagttacagttcaggattcatacctgtttgctcatttggcagctcccaggggtctcaaattgggttccctggagggtaggggcagacgatgatggatcctggttttttatttgaaatgttactttttctcaacctagcttctctcctcagggatacccctccaggacatgcaacccttggttgtctcctagtcgaggctgagggtacagccttgctctttcgaaagagcagtggcccttttaggctacataggtttatctcacttttgagtaatagattcatacctcaaatttttgtaaaagaagtgtcattttcatactgatttacactataacttttagaactcctttatcacttgactttgggtgagttacttaacctctctgggacttagttcttttatccattctttaatctataaaggggaatggcctttataaagctcctctcatcttaaaaacactcagtgcctatttctagtttaacatcttttggcagcagttccaaacacgtgagccttcagttgctgatcctgtccctggcaagtagttgctggattacaaataaatggaaggcagtgtgatgtgctagtgagaatgtgactgtggactcagacccaaaagggttggaatcttagcacctcagaacttagtagttatgaggccttaggtgagtaatttatttttctgtgtcttagccttttcctttgtgaaataagaacaacaatgcctgacccctgtattctgatgaggagtaaggaaaatgataataatatgtaaagcactttgtacacttgctagcacatagtaggtgttctataaatgatagatattattattccccatgaaattgtaagctccttgaaggcagggactctgtcttagtcatccttaaattactggtagtactagatatctaacaggcacttagtaatatc

SEQ ID NO: 67409 - DNA, 1592 bp, Homo sapiens
gaaatgaaggtggcttattggttttggcagggaaagggttgtctggtaagaccattgagcctcttagctgaaaatgctgacaagttgagcagagagcatctgtgctataccaagcacaatcattattttcattggcaaaatgtattgctcacagttttgggtagtctgtccattttgtcagtaatttaatctaggttgaaaaaggcatgggatataaaccgctattgttgagcatccctgcaggcatacctggcaggttccattccaacttttaatgaggagtcttgctttatgttggggtccgctggtggcttgcaatatctattttggggcgttttaagatgggggttagctcttgaaattggacaaggtgcctgcataaaagatgatgagatattttttccctcttggtctctgctccttgttaaattggtaattaggcgagactttcagacagaagtaaaaatacagatgacatgggattgtgtctaaggtgatagcttttctttcatgggaagaataatcctgaggattgaaataaagaatttgaagtagaaacttaatacatttgagatcttctatatttttatagtaattttatttcacaatatgtgccaataatacatgacaccttcaataatgtatttttatactcctttacccaagaattaagctggtacatttgcaagaggaggaaatacatgttgactttgtgatattgctagtaaccccattctttttcttttcttgggagtggcgctccaccccaccccaccccctcctaccccccaacacacattaatgggttattcttggctgggaaatgttctgttttctataatttttcaaaatattgcagtttatgagttgaaaaatgagaaaaaatggttactacttaattttttaatgttttatatattaatcaatttgattctttagatcattttgggaatatccttggcaagaaaaagcaggcattttcacacattgtggcattgtctttaggtcagacaagcaagttgcagaaagaattttctaagctgtgtgttgaataaggagacagttaattctgaggcagccctcattttttttctaatcagatttatagcagaaactattggaactaacttattcacacttttccctaacttattcatattctacttataccatataggaattttgatagtcaaaatacgcccatattctaatcaaaacagaatgagaaagggaaacaattgccttttaagaatagggatgagaggtactcaatcatttatagttattcttatgatatgtgctgtttatggaatactgtatgccaggcactggtctagaaaactgtattaatctgtgtgcagtcgagagaggaaccacacagtaatttgaatagggaaagcttactgtgactcgttaactgtaacaaggtattggaataatgagggacttgctagtaagaagtaaagagaattgtaaagaatgtagaaacagcagatctaatgagcaaccattaccctgtgctaagaaagagcacctaagaaagaacacctttcccaagctgagatccaggtagtattggagaggacacagct

SEQ ID NO: 67410 - DNA, 1042 bp, Homo sapiens
gagcatttgaaagatgatcgttatttgagaaatgtttctgaactagaaacttgcaagctttgaatcctgttaatactcactggcaatgatagccattttccattccatgagatcactttggaacttgagcataattttatttctgcttcacagttcttaaaatcctgtttggaaatgtcattaggaggataagggatgtaatgaaaaatacgttttctcatgtaccaaatcaaagtgtatagttatggagctggctatctatactgaacaacagttaacaaaatgaattggctgctttccgcatttgaagttgtatagtgtaaaattcaatgaaacgttcaataactggaaagatcacatcagcatcaaggatgcatttagcaggtttcctcctaccatattactaagatagaagcacagttttagaactaggaataaaggctatgaatgaagttaaaaactgtgggaggcctggaagtagaaagataagtaggagtgactgggcctggaaacttggatttggatgcaagtgaaggaaacagaaagatgggcctgtgcggaccagtattttatgattggtgctcttgtcagtatcttccactgaaggctgaaagttatttcttgaaactagcacctgtcacacccctccttaaggcaaaggaccttatttttggtggttgaacttgctgggtcaaacagaatcactatgcctgattctcatgttgtatggaaagacatagggaggggtgaaagcagctttttttccattcagcgtttttagcaggtttttagagtgaggagttattccatgagtgaatgaatggaatgaatgaatgaaaaaaaaaatggccaggtttgtttttcttggaaaggttttatttcctataaagagatatggcataattgtgttttccctggcataaaatgaaaaataaaatctagcaaaatgcatacttaagggatgtgtgtgcacatgtgtatgtcactataatatataatgagactgttgaactctctagaatgtttggaactataaagttta

SEQ ID NO: 67411 - DNA, 1032 bp, Homo sapiens
ctattctagtgtctactattatcctcattttactgatgaggaaactgagcattggatagattacattttcttgtttgaagatcacacacctaacaaagctgggatgtgatgatctcagttgcttttcacttttgctgcttgctgtagaacatattggtaaagcatagctcattgttttaaagcctttataattatagttacgttgttcctcactacatatgagcatttatacttttgaaaattaatcagagctcagtgtaattagagagagagagagagagagagagactttagtatcccccaaacatcagcttattgcttccacagctgagacccacaggggaaagagaagagtacacccataaatattttctgtaaacgccacaggtagtcatgctgctcttggatgcaaaaggtctctagttcaatttcctgctggaatggattcttcacaaataaggataatccctcattttatgtttactcacatgtattccttctgtattccatactgtccacattgggctttgcagtttttatatattcttgccagaatgcacttattcattagccgtttttattagtgttacggttgagatgacattttcccattctaaactccaattttctgtgacttttaattttacaaaacaattacctatcaggctgaaactccttaggctggttttctgctcagaaaggaggtataggggggaggttttaaagtctgttccacttttcttggcagcctagacatttagattcatgtaagtgctctttaaataaagttgcaattgcttaattatttaaataaatgggagctgaattatttaaggatttgctggcaagacaaaaggttctgggttttctctcctacccctcactcagaattttcagtcccattttgtgctggctaactaagaatgaatttctcatttgtattttgatatatctgcaaatccagcaacatcttttggagttcttaccctggctaagtccatggattttaaaagtcaagtttgaaattttaga

SEQ ID NO: 67412 - DNA, 2708 bp, Homo sapiens
ttttttctggaggaaagacattagtaaactgaggtggggatagaattgtttcaagggctgtggtcagaggtgtctaagtgctgaaaaaataagtttgatgagttaaagcagagggcttccagagtggggtccataggatcaatcaatagccttcaggaggttggtgagtccccagaaataacatgcaatattttgcatgcatttttttggggagagtctgtgttaaaactagattcttaaaggggtagagaccatgctgaagtaaagctactcctgccagctatctccaagtgcctattttacaggagcccatgagctctagctcaatttatttctcccctttcttcccagtcaccatccccttccctagtgggcacctactacttcatccctcttcatcctgcttcatcccctttccttctttctcccctttctattcttgatcccactgcctttcttatgtgtggaccttttaaaagaggatggtctaggtgctagccatatagactgccacgcaaactggaagggcctctcttaaaccttcctgccttgaaagtcagggaaataggctcccagcctctgcctggacagaacaattaagtcttgttgtgattataacccttacctcgttgatattcagatacttttcaacataatcatgtttttctaatgtcccttactttcctccctcctcctcctccacatcaaaaataaattatttgtggaatatttaataggttcatggggctctgctctggtgttatctgttttaattctgtgtgagatgagatgcggcacttgtcagcagaggccgctgatgatgtcggtacaccttactgagcacaggtcacggtggcctgcaagccagattgggtgattcagccaaaggagcgtcactctgtcgagtgggagaactcacagataacccgaggtgctcacatttagccctgtatgtagtgcaggtgatatgcaaggcggttcctttccggtttaactctcgcctcttcctgggctgcttttcagccattcatttgtccggcggaagcagtcagctttctgaaatagatcacgatttaattgccgctgcctccgctgtactgaaatgaaactttcgaaggtcaccaagcatcagtggcccttagttaagcattatcttctttgcccgccccacagtatttggcaccattaacttctgtttccatttaaaaattcctccatttgttctgcagcactgcctgtacctctttggatagcattatttggcagcacttgggctagctcttttttctccctctaccggctaaatgtttcccagtgttttgtcctcggttatttgcttccctttttccatgggttctctttggtgttctagatcttattccctctcacaacttcaagtgttgcttttccctacagcccaacttttttcttttctttttttaaattcctgaactgcattgtcaactacctgctgttcctgctacccctgggagtccccctgccctctcaaacttccctgtttaaaaaagagcttacctccaactattcactatctcacttcccaagcaaatatacaaatatactcaaaatacaaaaccccaaattagaaaggctgcccctatggccatcaccaaaaagcaagtccctcaacaggttcatccatattcatttctttttcctttcatagctcaccgccgttcacctaggcagcccctgaacctaaatctctgcagacatcttcatcttcttttcatgcttcatgtgcaagtagttgccagatcttcctgaccttggtaataaaacattgcctacatccggacttccttttgctttgctcagggtcagtttcttattccctcatggctgtggtctataccattccccgttagctgctcacctgttttcctaacttgcgattctccacagtttgcagtttctcacctttaagaattttgttcagcttttatcttctcccatatccattctttgagatattatttaccctttaccttcctatatgaagatgacaccttccctgacaacctttgctttatctcaactacattattattttttgtgagatgtatactatccaattatgtttagagttttaaatcaccctactaaaccacaaatattgacagattgggagctttattatatatatacttattatataatacaagtatgtgtgtgtgtgtgtgtgtttccatttccattgcacagtaccaggtacacgttaggaacccagtaaatctgtattgaatgaatgaatgcctacactgaaattttacttcaggttggttagcaggcttagaagatctcttcctactaaagatcttttgctaattgtttttggagcctttctatttagccatgcaaattagcatgggttcataggcccagaacctgaaataaattaatccgtacttgaaaggaacaaggctgtggctgtatatggatttcaggaaaaagaaaaatggaaaacattgagccagtgtccagttgatataagtgcttccttgtgtttttttttttctttctttctagtgcataggcagtataaagttacttttacctccagtgacccaggccagaatcatggcagtactgtcaccagagctgagaaaagggagaataagaggtacattagagaaagaaagtatgatgcttcaccatgttaattactcaataaataacttttgtta

SEQ ID NO: 67413 - DNA, 1045 bp, Homo sapiens
gtggaaaggacgagtcaatgttggctggtaagtgatgtactcacaggtttcctgtaagttcgggtggtgctttccgcagtgtatataagtgggttgtgcaaaatctgagacctacgattcaattgattttcctttgcataatcataatcatattcatatttggtcagctttcatgctctttgatatttctgatccttatgaagcatgacaaatgttagaactcttttggccttctagacttattgcagcacaaaaactcgagatcctaattgaaagaattttgaagagtgtttcatttaacccttttcttcctcgtccaaatttgatctcacacatggggaaggtaaatgcacaccttaatattggtgcaacatgttattctgaagacacgtgctaaacatttgaaagtcttgttgatttatatttccaccatgttttctctttcctgaaaaaccttagccagcgactgaagtagttgggttgtattaatggatgtttatgttgtcctgtgacagctggttttgctaatttgtttttacagggcagtttgtagtaaatgaatggcatgctgaatattttactgagatttcagattatctaaagaatattttccggtttactaattggtagataatgctgagtacattgatgttgacatgagcaaatggatttaaaatgatttgaagtgagcttcattaaaagatgctctaatcacagccagcaggaaatgtcaaactagttctgccttcattcactctggtggacaggaactgttgcagacttacgatgctacaagtcattgcagttttgattttggggtgccacagggtgggggaaatggtggaagtttttttttcatagcttttttggctcatcatgtctttaccagaaactaaataacaaattactaattacctgtatggctaaatgaacattctctgaaaatcatagtcacattgctggagtcttataatccattatgggttgaatacatggaagtcatgtttgttgctcactctgaactagaagtctgtaaattacttgt

SEQ ID NO: 67414 - DNA, 1685 bp, Homo sapiens
tctcataatttccacgtgttgtgggagggacccggtgggaggtaatttaatcatgggggtgggtttttttctgtactgttcttttaatagtgaataaatctcatgacatctgatggttttataaaggggagtttgcctgcacatgccctcttgcctgctgcatgtaggacgtaactttgctcctcctttgccttctgccatgattgtgaggcctccctggccatgtggagctgttagtccattatacctctttttctttataaattacctagtctcaggtatgtctttattattagcatgagaacagactaatacaggtatcatgccctagtctgggttttcctgtagacttatgttcatttactaaccttgggataaatgaaaatttggagcatgcctgtatgatttctctttctaaaaactcaaaacccacaaaactacagtaaggtgctgtcccccttccattatccatagacccttttgcctttcttaaaaaacacatgcacagcactcacacagacacacccctgtaagacataaggtaccttggccattttcatgaaactgttgttaattcctttctttaaaattgaagtcttttaggattttaacaaatatcctattcatgaagttttgtctgttcttttcttctggatttcacaactcacctgttctaggagagtcttcattattttggagaaggcttcaaatctactatcttcaagcttttttctttccagtgcacccgtctcatctcatgtaacgtggtgctgggaatataagactgagattgtgatgctcacagtttttcttctttgtaattttctgtgtcttgattttttcccccaatgaacatgtatctatttcacaaaatctattttactgttaaataaaattttggtaaacactggaagtaggaaattaaaatgtgcaaaattgtaaattatcattacagtttacttatctttcttgtagataccagatacagaatgcttttgttttattacatctttttctatatgcaaaccgtaagctgagtgtagcacctggttatgaaattttgtacttatagaatatattcacttttattggtggctataatcaagatgaaatgcttttcttaataattaatgttaagaagagaaatgtaaactttagacaactttatgacttctctccagaggatgtatggatgtgactgggtatgtgatttaaaaaatttttaaagttctttggattttttttcttttgtttaaaggtccttaggcgtttgccttggcttgctgaagagtaaggagaaaaccctgtaaactcattcactcagaataggatgagagtattgtagatttcttttctcctttgagacaattttaaaattacaatggtcttagcctaagtggtccctgttacggcttctctcttttccatgctcaacacagcctttgaggaggggctgagggacacgccacctgttttcaagtgtatttatttctttatgccttaatatgcctagtgcatctcagaatggaaatgtcctggaaattgaacagcttcatagttgggtggccccatgagcatttaggaaatattttgtgaaactgttgtggtcatcttgtgtactggttctggtactttaatccatcattttgggatcatagctcttctgaggaaagagcagccttgca

SEQ ID NO: 67415 - DNA, 1044 bp, Homo sapiens
ctgtacattgatttgttaataactaggcatgcatgtgcacgtgcatgtgcactctctctcacacacacacccccccctatatacatatatatgttttttgaggggcatctttagtgatttcagcctgggtactctgttctaatatatgctcttccttctgagaacccatttactgtcacagatccaactttcttccaaaggcaaatgactccaaacccatatctgtgttgtgatccactgttaaacttaatttccctccctgggctctgacatctacttagctataggatacaattactaggatgaccttttgatattggtaacttatacacaaaactgagttccgtttctcctcatcctcacaaataagcaaccattctcagtttcccctttattttcttgaagatagacttgctctttggaacctcagaatcatttttgactctctctttctgggaccctggtgtggtcaaatctgtagtcaatttctgctgattgtctgtgcctggttggtttggacctagctcctctttccccttgcagtgcctgccatggccccttgccctcttcttcctcccttgatttacgttcacctttttaatgcctgctagcttctgtacatgaactctttgcatgcccaacccaatctttcttgttttatgaccactggtcttgctattcattccatccatggtgtcttccttctcccccactatctctgcagattgaaagctaaagtatagctcactgccatctcacgtttgaaaccctccagttcactccagtcaacaaactccatctctcctccgatctcagcccatattgtgcccaggccagcagcgtcaacagaatctgggaacatgttagaatgccccactccagacctgctgagtcagaaactctgggggtggagcctagaaatctgtgtgtaacaagcctttggggtcattctgacaccagctaatgtttgagaaccagtgtactgtgtaaacccagattcacatactcagtgtgaaaggctgagtagccctacctctcttcagc

SEQ ID NO: 67416 - DNA, 1046 bp, Homo sapiens
acatttgggttggttccaagtctttgctattgtgaatagtgctgcaataaatgactactgatgttgagcaagttttcacatgcttatttgcgatatgaatatcttggtgaagtgtctattcagatattttgcctaattttttttttttttttttttttttttttgagatggagtcttgctctgtcacccaggctggagtgcagtggcgctatctcagctcactgcaagctctgcctcctaggttcacgccattctcctgcctcagcctccagagtagctgggactacaggcgcccaccaccacgcctgtattttttgtatttttagtagagaccgggttttaccatattagccaggatggtcttgatctcctgaccccatgatccgcccacctcggcctcgcaaagtgctggattacaggtgtgagccactgtgcccgtccatattttgcctattttttaaaaactaggccattttcttattgtcaagtattgagagtactgggtataagcctttcatgagatatatgatttgcatacgttttctcatagactgtaggttttcttttcagtctcttaatagtgtcttttgctggttcttaatttttataaagtccagtttattaattttatattttatgggttgtgtttttgatgaggtaactaagaacttattgtctaacccaaagtcatgaagattttgtcttgttttttttcctaaaagttttatagtttgagattttgctttttggtctgtgatttatcttgagttactttttgtataaagtattaggtatacattgaaatttgtcttttctgcctataaatgttcatttgtttcagaagcatttgttgaaaagactattcttactccttttaactgactttgcacctgtgtcagaagtcaattgaccatatttgtgtagttctgtatttggattctttctgattaaagcttgtctatctttctgccaattgaggtagttacttttctttttgagacaggatctcactgtgtcatccaggctggagtgcagtggcggcataa

SEQ ID NO: 67417 - DNA, 1039 bp, Homo sapiens
tcattgtgtaaatgttgagtagtctgtttgtgtatccggtgatgctaataaggtctgcattttcttagtgtaaattatgccctacagaatgtttaattctaggatcatgttctcctaccacgcagcgtgctcctggccccctcctgctgccatctcctgatgcatgcagagagcatgcaaacccattgtaacactggactaagtaacaaagggtttccacctctaagttaagataaacctgcctcagaggaaaaacaaacaaacaaacaatcaaacaaacaaatcaccaatcattctagtatagttacaaaccacatggaaatgatcgtggattatctggtcttggtcatcttttagtttagatactttagtattgactttgaccaagataattttataactgaattttaacctttgtttttatattataaaattagaatataagttatattcttgagactcttgagagtacagatactatatatggcttgtatatattgtagaagccaactctgtgccaggacataattggttcttgataaatatattgatttaatttgaatgtgaattgcatattaaatactgagactttggtaataccataataattaaaaattttgctaagtgcttactatgagcaagttacattcatcatttcattgagttcccactactattttataagagtgaacctttttgctagcagtaattttaatttacacctttaaggatttatttttaaatttacataaactgaaatttactttttttgggtagagttctgtgaattttgacacatgcatagaattgtatatctactttacagtggtatgattaccacagtcaatatacagtttcctcactcacccggatcccctcatggtgtctctctctagtcaaacctccttccaactgctaacctttggcagccgtattgatctgtttgccgttgctatagttttgctttttctggaatgtcatatacgtggaatcatactggatgcaatttttgaatgtagcttcttttacttaatatatt

SEQ ID NO: 67418 - DNA, 3141 bp, Homo sapiens
atgctaaaaataaatagacttaggtatcttttcttaagtggagatgatactggattagatgagaatattatttgggacctgtaaaaaggtaaaacttaaatgctgaaatgtttggaatttctgttcttacaaactttataattttaaagataagtagatttattcacacattttaaaattctttcattccatatttcaagaggatttactaggtgatgatgccacagcaaagaatttccatatctctcctgttgtctgttgagaattgatgattatattaatagtctctccatctagagtgttaaggttaatattgttaacttgtgaatgcttctttgggatctaccatccatgtccttagcctagacaagaactaagaagcagaaaatagaatgtcttttggataaacacagatttggtaggagtgatttagtttggagcaggggaaccttaattaattatcactgtttataatacatttttcccctttgtttccaagaatgagaatagttcagcaacacaattgataaataaaacataaaaggacagttatggttgccctggtaactatatttctcagcaagtattttgtttgccatgaaatgtgtccagggttatttattggaaatcagactccaaatgtcatgactttttgtatttgaatttcttatgtactcatttaggagggacaattttgtacgtttttttgggttgggttctgaagctctatgtgtgatggggatccttgtgtgtttttctttttttggaagacaaataggaaactgtgattacagtgaatctatttaagatgaatttccaagtctaaagtgggatttaaaagtatttgaatcattttggggatacatgaaatttcttaaaactggaatattttaatgtagaatttgaacataagatactttctgatcaatgatcaggaatatgttaacattacattttgacttaattcctatgcaattaattttgagtagaataaattattctcaaaaaagtcttaaagataaaaatcaaaataattaagcaattagagcaattgccacttctagatgatttatggtagtgtgaattaaagctaagtgaataattttttatacgtttattgtattcttttacccccaaacaaaatcacttcagtctacagacatagttttacaagtgcacaaatatatacgtagaaagatgtaactgctgcatagattttaatagcaaaaaattggaagcaatccaaatgtccatcagtaagggactggttaaataaattatgatctgtccatacaatggaatacttggtagccattaaaaagagtgatgtagatctatatctactgacaagagaagacttccagggtgtatcagtaggtgaagaaaagcatactgtagaacactgtgtaagtattttatatataattaatctataatgcatactatctaattggcatattcatttaaaatgtgaagaatcaacagaaagctcttaacaatggctatctctagagagtgagattatgaaggacttttactttctgagttaactttgcatattgtttaaaatttctgtagtgaatttgggttaccttggtaattagagaaagagagaagatacaaagctgtatttaaagggtctaaaaagatcagttgaaatgggtgtggtatgtaaatacattaggctttgcagtaatcgtttatttactctttgtttttgtctagatacataggagtttaaagaggtatttatatttatgtcttttgaaacatcatacagatttttaagccttttctagatatttacccctttttttcttcacattttcagttattttctgaatatatcctttactttagattatcactttgcaaggtaacctgttttatttacattttagttgctattgagtatgctttgatggactttgtcttttgtttaaagcattattgctggcctgattactagatttgttttattttaaaattatatgatctccatatacaataccagaagatttaggaattttatgtataatttatagtttaaaagtatttgaatgattattgggatacgtgaaatttcttaaaactggaatattttaatgtagaatttgaacaaaggatactttctgattaatgatcaggaatgcattaacttattacctttttgacttaattcctaggcaattaattttgagtagaattgaacctcttatccaaaacctctttaaaagcatgtttccacccttttcccaaggacaagaatagaatggaatctgtattctgcaggatttcatctggatgcaattttctagattctgcctccattgcactgaatgtaaagttttcttgtgtttgtgtgtgtttggtcccaggctctgcctggaccccagctgcagcagcaatctggagaagacacttctccagtgcagccagtttgtttttttgcagaggagtcatcaatgcaaataggattaggaagaaaatgcacatggtctggccgtttattgccattttcaatgtataagcttagtttgttagcacacagagtggagcagaaatcactattccagacccttgctgtgaagtttactgtttcaatacagtgatgatatctgttaggagaaagctacaaagtgaggtagactttaggtcacagtgttgacattgtggatatattttatggatctgttgacttaatgcaagtttagaaaacaggcttacatttttaattttcttcctgtctgctttggttacatgaagctggataggcaattcctcttcttagaaataaccattggattcttgtccttgggaagagaatggaaatagcctttaaagaggttttggttaagatgttattataccttggataagatttaaggcagtgtttaatttttttttccatgatccatgcaactgtatgcacaataaatttatatggtgtatttatcctttactgcattctgtgtaccttgatttttttcttcattgtgctctcatatttcctttcctttccctttcctatcaatccaaacctatccactatatcctgtccaccttaatctgtgcaccatcctatcctgtctaccctatgctatcctgccctatcctgcccgactctgttctgtactcttc

SEQ ID NO: 67419 - DNA, 3169 bp, Homo sapiens
atttttcttgactctcctcttgcttttcatgtctaaaagcctttggaatatcttaatagtcctttcctcatttgaagaattaccccttttggccttagatgggtgtagctcatctagtgcatagattaatagctctagctttgtccttaggaaggtaaatcttgaaggttactgttacatgactctactgccgtatgccaattcacattgttatttttgtgtgtgtgtgatgctgaaagtgagtgaaatgtgaaaaaaacattattcattttaaatagttttgactgccaggttaatgcaactcttaagcagagcttcatgaggtctggccatagtaactgcttttaacttgatttaaagttcttaaacgttctgaattgcttcacctaatctttttatactgaacgtataattttcagactcgtctttattttcaaatccataactgacagctgctcaacacctcattcaaatagttttaagagttttagagaaaagttgggacagactggatttactgacatcagttggattgagatattgtggatttaaagatgatagagaaggagagggaaaagtatgaaataattattccgtgttcactgcttgcccaatgacagtgatttaaagcctaataactaacaaaactgagagatggcagaaggacatttgaattaacttccaaatcttaatataaggaatgagtattttctttgaaaacaaaattttcatgtgtagtcctattcgttttattatatttttaaaaatattaatgcacagaaatgcatatatgccaaaacctcactacaacctttttcttggcgtatatcttccagattctgtgagattgtcagctccttaaaggagctaactctttaggggactccatgatgtctagtgcacagcaaacattttccaaacagaattaaccatcttataagagaaacacgtttataaatacctctacttccaatgacaaatgaaatcatcttgtgattcaactcaagaaggctctgggctacagtgaatatagagaagcttcaggaagtactgtttaagagttaaaattaatgtgactaaattttgtcctcatccttttgagaaaatgcatgcatgtctgtgtgtgtatgtgtttgtgtgtgtgtatcacttactatgtgctagacactgataagcactaggtttacaaagatgaattatataggctctcttccatcaaggaacttatattttagatgtttttgcaggacacagtaaaaataacaataccatgtgccaagaaccataatagatatagttcaggagtgctgtggaagcatagaagaggaatgtctaactcactatggagacttagagtcaggaaagacttctagggggtctcttgagttgagccttgaaaggtaggtaggagatagccagatagagacggtattagaggagtttttccaggtagagagataatgggcggaaagacaaaagcatgggggattctgggaactgcagatagtttgctatggctgaggggaatagcctttgaaggagcaccaaaatatgaagctggagagggtacacaattgtcaaatcatacaggaccaacttggtaataaagagaagtctgggttttattccatggagagtgtcaatgaggggagcgggagggtgcaggacgaatctggaggattagagactcaggtaggagagcagttagggagcagctgtggaaggccagctgaaattttgagggccagaacccaggtagttgctaggcagcttgggaggaagttggtttcaggatatgtttaggaaagtagaatttcataactgatcaagagagtgggaagaggaggagtctaggttaatggtcaggttctggcttggctgcctaagtaggtgatgggtgtagtaactaagacaggaaatttagaaagcagacagtgttgggattaaagaggatgtgcttgaccctgcagaagttgagctggaggcacattcaggtgaagatacctagcagcactctgtggcactcatttggagacatggccatggatgagatctcctaagaagaatgtatatggaagaggaagagaagctaaggacagaatgtcaggaacgtcaacaattaaaggtaggcagaagaagatgaactagtgagaggagtgaagaaggggctgtcaagagactttgaggaaagccaggaaagccttttgttttggcatctaagaaggtgagtgagccacagtgtcaaatgctacagggaattcagataagataagggaggccaccatggctatagaacttaggtattcataggggacctctaccttacaattttagtgcagcagtgagtgtgggaaccagatggcaatgcgtggagcaaatggaagtgcagaataggaagcatgctgtagacacatgtttgaagaggcttgactggtaaaggtagggtgagggagaaggggactggaaataaggaggtgtagaacttagagaaattttaaagtatgtatttttttgaattagggaggtgtgagaaggtttatatatatcataaaataagagatattacagagggagatgaaaaataggaaagtgagagttgatcactgaccatcaagggccatgatgaggctcaggaggaggcatttgctgagaggggtgggggcaagagaccattgttttcttctgaggtggagataatgggcaaggctttaagaaggagggtggatgtagataagattgcaccctgcagggctgaggcctggagggagggagaaccttcttgggaaagtaggatcccatgctaaacctgttgatggtgagatggagctgtgcagggtgagaaactgggaaggtttgaaatgttctccctccaggagaactcagaaattctaggaagcaaccagctgaggctggaaacattacgttgcagtgacccaaggccccttgtgtgctgattatccttgtctgagcagcagactgaaatgtcactcttcccagagaccagtctgagatgtccttgatatcttccttccctttcagagggaaggcaggtcaatgtatcatggaaatttagagctgaaggggactttagagagcacacagaactccctcatcttgtaaatgaggagaccagctcagaaaagtgaatgacttattcaagtggatccaa

SEQ ID NO: 67420 - DNA, 1747 bp, Homo sapiens
aaagcactctaccatttcaacaagagaaactccatgttcatacattggatctcccccataagattctctttgaaaaaagtgttttacttttttaaaaaatggtttaaaaaccactggacttaatgaatctttcaatttccaaacaacaaggctggagcaaatgaagcctggttactgggagagcacatcagggctaagaccaaagccgtaggcagtaacaaagaatacttatttgcctgacctttcctctcttcgtattctccttggggttctggaaggtgggactgtggccacagcagagaactggttcaggagctgagatttcagatcacgggcacctctatctttccattagagggatataaaggagggagctagcctggagtggggatgcctagaaggctttccatttaaacaaagtctcgaaaatatgggaaggattgctattgagaaagaggtgagaaggaaaggcattccatgttgaggagaaccatgtgaataaaggcttacaggtaggaaaactaaaatggctagtgagagatgggattagcaacagatagtttggggccagactgtggaaaaactttgaatgtcaggtttaaatgaaattcaaggccaggtactatggctcatgcctataatcccagcattttgggaggcctaggtgggaggattgcttgagcccaggagcttgagaccagcctgggcaacatagtgagaccccgtctctacaagaaataaaaaaattgcccggtggtgtacaactgtagtcctagctacttgggaggctgaggtgggaggattgcttgaacctgggagatgggggctataatgagctgtgattgcaccactgcactccagcctgggcaacagagtgagacctgtctcaaaaaataaatacataaacaaataaataaattcaagaggtcattggggagtcttaaattttttgaacagtgaagtaacatcaggttggttttttaggaatatgaatcctgcaatgataagaaattgagaggttcatgagtcctacaatgattagaaattgagaggatcttccattagaaatggagagattggttaggagtataatagttcaagcaagacaacaaaaacttgaattagggcagtgaaggaagaataggaggtagaatggagcctccattgatggctgactagagaatggggattgagggaaaacaaataatagaaatgaaggtgtgctttgattttggacttgaatgactaggagaatgactactctaatgaacaaaaatgtaaatgttatatgtgggtttagtaagggaatgcaatgaacttggttttggatatgttaaacttgagttatcactggaacattcaggtagaaatgtttagaaagcagtttgaaataagagtttagtagaaaggttgagagcagcgctgcagatacagatttgaaagtcatctgcaaagagatgtgtcttagcgttctcacactgctggtaaagacatacccgaaactgggtagtttatataaagaaaaagaggtttaatggactcacagttccatgtgactggggaggcctcacaatcatggcagaagacaaaaggcacatcttacattgcagcagagaagagacagaatgagagccaagttaaaggggtttccccttataaaccaccagattttgtgagacttattcactgacaagcaaacagtatgggggaaaccgcccccatgattcagttgtctcccactgggtcc

SEQ ID NO: 67421 - DNA, 2009 bp, Homo sapiens
atgctacctcctctaccttaagcaccttaatgtatatggctagttcctacatctctctcaagattcacctcaagcactgcattctgaaaggaaacttccatgattactcaggctggttaggtatcttttctttgaacccttcttctgtacttccctaagggctactcctaacttatcttcctccttcctatcaaacagacttctctgaatggcctgagtctcttctatatgcccgctacacatttcgtccaacttgtttccaccaatagacatgtcctatcctcataccttccacgtaggcatatttaaatcccatgtatatgtaaagaccgaagtccagtgtttttaagtcttacataatttctcagcttgaatatgttttcctttcaacttctgtcacaacttctctaaccatttcatgacatttaacattttttacacaatttgatttctaatatgtatatatcctatccttttcatttcttataaatactggttgttgggatacagaatatgccaaggccttagtgtctatgaatttaatttagtggtggtcttattatcagcttttttagggctataattcttagttgaagttgtttgttctcccataatgaatgaagagctatcaacgtgcctgacttttgtatcttgaaggaatgacttctagtgtgtttgttcatacttggttgttgggcatcattaaagagatttagtctagcagtccagataagagaatctctttccatttatttaatcacttcacagtcctgggatacctagactttgagtcattgctgaggctatatcgtcactttagagttgaagcaacaaaccaagaaacttatctctgaggtcatctgttcctcttcacctcagctttcatgagaggcttgtcttaaaactgagatatatatattcttagaagaggcatggtgaacatacggaaatttaaacctcagggtaacagttttccttgtacagtaataaagatgtatctggagtcagtggctacaggatcaaaaaatagatcacagtaatcggatcaaacctgagaaatggctttttgctgtgtttaaaaaaatgacatgggtaaggcagtctgttttgtggcgatgcttccactatttgtgtgactatacagtctgtgaaataggactggcaaagttaagcttataaagttaattgcctacaactgatctagctttaaacagaaagtaggtttccttttggtcttgtgtagaagaggggagagatttcatgtgtaggcagagagagtatgtgtttgctaacattaccttttaatttaggagaagtttggagtttgttctttcctgtgaatatagaggtggaaccactctaaccagagtttattgctgtaatattttttaaatgcgtttgtaacactgatgtatctgtgaccttgtgaaggagtttttgagaggagggggtggcaagccctttttctcactgtcataagtgatgcctactcaataactctaacttcctgacattattgggagggggaggagggcctctcataacttgtttttgtatgacttagttctaaagtgttcccttcatagtcacatccatccatttagacttcccttttccctgcctaaggcttgcatccagcctagtctgtgtttggtactttaaatgctttgaattatggagaatcttagtattttattgatgcttgccttgtagctacatagctctatattgtcttaggttacacagcttgcatttcttaggcattgtgagtggattattgcaattagttgaagttttgagaggaatgctatgtcttccttgatttctaccaagtgccatattctttttcttggtagattttttttttttccagggattgccttttaaaggaccttttaagttagaggcattaacctttctttccatcataactctcagcagatatatctttttcagcatgacctactgtcaagtaaataatgatttgatggcaatgttcaagaaaaatt

SEQ ID NO: 67422 - DNA, 1019 bp, Homo sapiens
caggcacccaccaccttgccaggctaattttttgtatttttagtagagatggggtttcaccgtgttagccaggatggtctcgatctcctgacctgatgatctgcccacctcggcctctcaaagtgctgggattacaggcatgagccactgcgcccggccttttttttcttttaattcatcaagttacttgcaagaaaataaggattgcccttttcatacaatataacgtgtctctgatatttaataaccatgccttaccttgcttctgatcggctgtctttttttaacccttctccttatccaataagttggcaaataaatgcctcaaaccccaattcttccaacttttttttttaattgcagtataatttacttttaagtgcacaaccaagatgtcttttgcatttaaacctcagactatgttctaaaagtgcctcttggacatctcagtccggatgttccagttatctcaaataatatgaatgacaaaacagcagttatatttagtgtctgtattcatgatctcatttaatcctcactgtcaccctatagttaccactgttgccccattttacagaagaggaagaggagaggacagtaataggtcccttgtccaagaaacacaaatggtaagtatcagaaccaggatctgaactatatctatgttcaaaacccacagttttaaacacttaactgcattttcctaaaattcaagacgtctaaaactgaacttcacatctgttctggccgggcatggtggctctcgcctgtaatcccagcactttgggaggcccaggtgggcggatcacaaggtcaggagttcgagatcggcctggccaatatggtgaaaccctgtctctactgaaaaatacaaaaattagccgggcgtggtggtaggcgcctgtagtcccagctactcgggtggctgaggcaggcgaattgcttgaacttgggaggcggagcttgcagtgagctgagatcgcacccctgcattccagcctgggcgacagagcaagact

SEQ ID NO: 67423 - DNA, 1056 bp, Homo sapiens
tgctgcagaatctatcagagatcacacattggatatggtctctagtctcttttaatctagaaccattaccctgcttgccacctgttttttctttaaggagtttttaaggggtatcttttatggcattgacattttgatgaatccacctgctcttttgtagaatgttctgtagttctacaaattgtttgatcatttcctcatggttcagttcagattaaacatcttttgcaagaaccctgcatagctgatactgccaacttccttgtaacactgcctcaagagggacataatatcagtttgccctattactagcttgatccttggttcaagatataaatttagttactgagtgtaggtgaatttgtagggttctccatttttgtccctttataattaataagtaaccttgtgtatacatatcttgtgagcaaacttcgttgtgaagagccctctgtcttctttagttttgagcctgaagatcttgttctctaatggccctttacttaatggattgagcagcattggtaaaccttgtctgaatcaaatattatgtccgtggttataaaactgtgattttctaattctgtaattcctctacttgggtagaggcatttctgaataaagaagagcttgccttccctactcttccccctcttttttttttttttttagaaaattacaatgggttcagtatggtatgtttcattaccatcggatttggccagtgggaaccccttcagagtggctcctgtatccttttaatatattctcattaatttttaagctcttttgtatttcatgtcacaagaagatatctatgtttacattgtattttcctgcccccatacctggaatcagttatttctccaaggaatcctgattccttttagtcaaagaatgatatttagacagcggacacatctaagaattgtgctcattgctactgacttgtcattgtttctaaacttttccgtgagcaaacaagggtgtgtgtgtgtgtgtgtgtgtgtgtgtgtataaaatatcctttgtctcaaaaaaaagttatatgtgaat

SEQ ID NO: 67424 - DNA, 4322 bp, Homo sapiens
acccctggtcgctctatcccctctgtgcttcttcctttcctcagattactttaaataaatcctgaacatcctatcatttcttccataattacttttagaatgatttctaagatacagcccctctttttccactccttatcacagtattattatctggccgtacgcacagtattctcacctggatgtaccgaatttttgccttagctttactgaggaagagagaatgaaggcttgttgcagttggtgaaagcaaaggcagaggccagagaagctacagcacgattattgcttctactgaggagaccttctcctatggtttggtttattttgagcaaggttttgtttggatcggataagatgagttttattgttgtgcaaatacagttgtgtaaatatgcagtaattgtagctagtccctcaactgtggcgtgcgctggaaagcaccgttggcgagactggccatttccaattgttcccataatgattaccgtccatgtgaggacttctgtaggaaaggctcatgttagtttgatgactatgagataccccattcgtatatttgtctttaaaggcctccatggtataaatacctttgcattttgtgaatatattgcttaaaataaaaatgtctctttccatttcgaactggctaagtgctaatttcagccgctattctgtaactgaagtgatcacaaaatgccttctttggtgtgggaaactcatgcatcaggctgtaagtatttgggccttatttttgtgggatggtggtgaaggatggtggggagagaaaaggttactacctttacttcttaatatttgctccattgatttaaaatgtgaatttttaacttcagctagaaatgttggaatgcttcagtgttaatttcaaaaagtctttggtttttctgaaaattgttccgttttccaaggttcatgaaatgtgagggtttttttttttttttttgaggctctttctcaaaaatttcattaaatatggactataaatctgaagcatttaacatttggtttttttgtttccagacaaacagggaattatgcatgagatgattttgaggggtccgaatggccctggacaggtgaaaacctgccccctgcaccgccccctctgagttgaccaggccacaagaaaagcacaaaggaatgcctacattcacgatttggggagcaccagcaaaatcgaataaaaagccttagtttggaaaccatcaatgaaggaaggaacccactggaatgtttgtaattacaagtggcacctccttgtttaaatttcagaagccacagtttctttttcagagatttaaattgcaggctctagccagcagctgctgttgtggttaatgggcagtttctctttgaagatcttccaagtgctggttctcaaaagctttggtgcagttggccttgaactagggttagaaaaaagggcgatgtagatatttatacaaatgcacagctcaaatgacgtgtggcctttattattactcaaaagaaacttggtgttaaggttgagaaaaacccagcactgagaaaaacctgttatgactgacaggtgtcttgaatgaggtgattatcttaagggagataaggtgggagaaattttttcttttagtagatgttttactggaatacaggcatttgacctaacattttgatctaggtatttcagaaatgttaaataggcttgaaatgaaagtgctgtgatatatatttaaatgctactcagtgtttgaagttgatattccagtgacatagacttttaaaaatgcctagaataagtatcttgctcttggcagacttccttgggaaggtaggtgctctgattcctcgttggctgtccagcactggactgcagtgtctagttggaattgagttatgccgtccctagaggaggtgggaagaatctgcctgaaaacaaagggttctccagttccctgactcccattgtctgtgccatatctccacttggctgggattaacctaaaagttaacgtttaaaaaatttgaacctttaatctttttgcagtaggtatcaacttttctcaaagtctccattattaccaatgacaccattgacatcctggtctccaaggcccctaaatttggagtcttttttcccctccttagctttcctgcttgcactgaaataaaatggggctgattgtttctaagtgacattctctggaaacatcagtgccctctccaaactgtgttttgctaacaggaggctcctagccagttccccctactctagtcctctgctagctactgcaattctaattcttttcaggacaggatcataacatttcccattcagaaacctaatctcaaattcttacttcttgcatcagattcaaactccacactgttttgtctttaggttgttcttcctcaattgctctcccactccctctctattgccctcatttcttattacttttcagcttaatcctgatgggactggaagactgatgattctccagtgaaactgaggaagaaagtggttctgcctatcagccttcagctggttacctttgcataaaatactctctttatcttttttcccttaactaactgtcttggtttgtaggtgtaggatggctgatttctctttgcctacattgagaataaacaccttccttttacatctttcattttaactaacacatacttacctaaaaggtacctcaacccacaagtttctttcttgacttcacaggtttatacatgattatgtttcttgatgctaagccaaactgtgttgatattatggccatgattttcgtgaaaatttaaaacaatacattcatgaaaatgtattgtctccatttggtagtttgtatttgaatatggggatttcctacagcatgaaaattgtgtaattgactaaacaaattacaagctgtcaaagtaagactttcagacaaaaagtgaagtcctttagaagtaggaagactttttaagggtcacagtcagagggcctcatgtggaactgctgacttggggtgaatgagattggctcctctgaagatgatccaagagataccaccaccttagaggagtatttggtgcttgtgtctggtgcgtgtagttacctagttaccagaaaataataaataaaataaaataaatcctaaaaaatctacccagagagatggaagggaagtgctttaaaacccaggcctttattagctagtgttttcaacacgtttgactttgggagcagagctgcctggctaaatgaagttaccgccatcagtcactgccaggccagcatcgggacaggtctaggaatttagttacattttgcattttggtagataacatagagggtggattatcactggctcaagaaacaaaaaaatgaaacctttctttctcagtctacctgctaaatttgttatcgtaaggatcttttcaaagcctttatctgggagcaatatctgccagagttcttccttccttttttgcttgcctgacacccttcccttcagagttcagttcttgctagtagaaaaaggctatgcagcatgataatacagtgattttaaaagttgattatcttgaagtattttgggacagttttggggaatgggttatgtggtatatatttatttggctctttgctgaatatggctgtataaatccagcctcctggatgttacaagtcatccccttgatttcttcttttgaataaaaaaggagcattgcttcatttttcttgcagaaacccttatttaaacaatgaaaacttcaaagatagggagaaaaaaaccaagttaatttagtactaaattactgctcaaatggttttatcttttaaaaggttcaagtagagattagcttaaatacactgaatttcacttttccttgtacgtacatatcttgtgagcaaacttcattgtgaagagctctctgtcttctttagttttgttagtaatcacataattgttagttgctgtttatttccctttcctgaagcaaatctctccatctctgggccaggttggcaagtggaatacccagttaagattacaggatagtaaaacccagtgctttaatcaaactgcttactttacaagatggcaaaaataaaataatatatatgaacactcttaagtaggaagtgttttctgcctatttacctatctctatttatcaatcacttttattaaaacagcaatacctagtggtgggggttatttctctggctactgctaataataataacttttgtaagtcttccacattagggaatactgaaaaagaaaatactatgtaaaaaggattaattcaggatgtac

SEQ ID NO: 67425 - DNA, 1120 bp, Homo sapiens
cgaattaggaccatcgtgcgtgggtcctggttctgttttctcctgtaactgaagccatccatcccccgcagaaaatctcctctcatttctcctgtgatgtttggatgaaatggatgttaatgaaatgcagtaaaaatgggtttgcttaagctcactccacagtgttaatcacgcctgttatacgttcaaggtgcatgcatgatgttgtttacgatcccgagtgaaccagtagctgatcacccccctcttatcattttcaggattagagaagatggctggtggatgggggatttatggtggtgatgggaaggaggggggctgacttttgcttgctttggcctgttggggcttgcaaaccggggatagagactttacaaaagtgccgccctgttattgttgcctttccctgcatcagattgaatagccgcagtagggacttgcacttgtctgtgatagatttgataaaatatccctcattaatgccactttatatttacagtgtgtcactggagacgcacaaggcttcatttagtgacttgtgtgacgagacaagcttgcattatttgcctgggacgttttggaggaacaagagacccattgagcaatcttttgaaatgaacaaatacgaaaaagggggggaataaaagagcaggcagttctctggaacaaagagctttattcatatggatgttgtacatgctttatccagttttccccaatggccctcctggtaaaggggagtgggacagggaagacgccaacaggcaggacactttcgtttcctctctcacttcctgacttcatattcttatcggagttggtccccggctcactgcctgctcatctctctccacactctctaaaatcccagaaggtaacggattcctgggtctccacagagagattgtgaaatcctttcttccagctctaaatttcaacagaagacaatgctagctacctgttgaggttgatgttgttggaggatatattggttgaagggaaagagatgtcacttttctatgacatgtgtcaagaagtggttgatagtgaatgtcagattggtaagatgtcttgcaattataacattagccttattatttatttggaaagaaatgctgtg

SEQ ID NO: 67426 - DNA, 1035 bp, Homo sapiens
cgcggcgtcctctggcccctgctgcaggctccaggcgggcgccgggaccgagtggcacggggccgcggggtgcgagcggcgatgcaggaggggatgcagcagggctctgagcctgcaaagcccctccttgcagctccagagctgcaggacccgggagcaacaagtggcggaggacgccgagagctcagcccccacctgcggagccccaggcccgggcgggcacagcgttggggccacggtgctgcttcaggggcgcctctccgcttgggctgtgccttttgtttacacgctagaggacacacagttatgtaaacaccgcaggagacacgctgtaggagacgggggatgtgtgggggtgctagcttgagatttgggggacgccgggttggctgcttgcccccaaaataggcttgcaaaggagctcggcttgggaaacctattggggggcgtctggcagcagcgtcaattccagcgctgagggtttttttcctccatgccactgtctccggatgttgtttatgtgtttttcctctgtgaattcttaatttatgagttacgagataattgggttcagccgatgccggtgtggttacaacttcatttcaggtgatgcctctgactggatgggttcaataaaatgttcctgaaagagatccctcgtgctgctgcattgtaaaaagcgccagtgtcagttaaacgtgagcgtgagtaaaggctcggtaactggcgcataatagaggcaacaatagacttgtattggctgcaaaaaaaaaaaaaaaaaaaaaaaaaaaagccggggggcggtggaaagctgtggtcggggatattgctttttgactaaaaatgggagtcgtgcaatgacgcttggcagcagaagtaggattagattatgcctcccctgtcaagactgctcattgaaggcaccgggtagtagcaacggtactatatttgtaactatctcgcggtgagaagttgccttccctgcgagggatatatgctgacttaggagcggtctggaactcaaccgtgcatgtc

SEQ ID NO: 67427 - DNA, 1082 bp, Homo sapiens
ttttagaaacaggtgacagtaagactgaggatatctgtcctggagtcacacctggagctgttgatctttctcctgcttgaggaacatagacataaagctgttcttgtggaattcacacaaacacttgatttccccagaaccctcttgcatcctgagatgcactgcccagcttcccacctctgtgccccacaaaccttcctcttccctgtcatccgctctacaaagcccctgctagaagttgacaaagctgactggctgcttaatgtgctacaggtgttgttgctaggcaaccaccccactctgcagctcagactctgtcagcccaaatgaaacccctggtagcacttaaccccgtaactgcttaacacaaacactaattacgcaggcccaccaaacagcacatttataagccataatcaagggtcaggagggcgcattctcagcaccttcattccttccacctacacttcctaccactgagccgtgggtcaggctgtcacaggcaggatttcgaggccttttgcctgtaagtgctggttccctttttcctggccataccaggtggacacggaattgtagtgctggtcctccctctgcactggactggattctgccaaagtcaaccaagcgccttcagttgctgactctcgtctccaggtaagaggctgcagagcctgttcctgcatttttattgatgtttaggctaagcctcttggcctaaaacctcatagttatagaaaatttgtttctctgatgtctgtattcggttgagctggagatgaccacccatttttgacaattctcctaacacttgagcgttttacatttctgtggttcggctcatttccccagatggaataactcacattcctttagcttgaccaggaattataggaacctctaggcatgtagatagatacttttgtagatcaaactctagtagaattgatctgttcttgagttggtctcccacttctagactgtgatcacatcactaactcattgtaggtactcaacaactattggtgaatgcatgaacacaaccatattttaaatttccacttcctcaaccacagagtaaa

SEQ ID NO: 67428 - DNA, 1036 bp, Homo sapiens
tattaagtccttaccatatacaggcttattcaaaccttgcccaagtcttgtggacctccttcctgtccacctggagggcccattccttctgtctcggccagcaggcctgcctttcctcttccttcccacttgtcccttccccagcccacctccatcagtgatgtgtaacggggacagccttccgccatttgcacaatcctcccccgcccctggccccccaccagctgctctgtttcaggtgtcccccacttcagggggatgacacctttttaaagagactgttgtttccggtgacactgacaatccttcagaattgacaagacctgtctctgcatctccctgcctgccgccgggctctcaacctggggcctaagtgatttgtcatcttctcttgtcagtcgccggctcagctggtgatcctgctcctccctccccactggagccataatcctctccctctgataacacaattgtctccatggcactgagcagccctcatggcactgcaggggctctcggcccacggaggaaggtagaaaataacagcaacaaagaccttctttagaaaagaataacgtccatctccatgtctgcacccactcccctgcctcttccccttcctcaggaaaaaaactgctagcggagaagatacacagaaactaggggaagggcagaaggccctcagacagagggctctgtttgctgctgctgttccttctgagtgagattactttttttcctatctaagcagcgtgccagagagagctggctcctgccctgtctcctcagcaggacaggcccagcctccagaagctggtgaggagctgctgggccttgggctgtcctcatcattactccaccttaggaggccatgggactcggctctaggaggcagggagccaggcagggatgggaagacagtgcagggtttggaattcccagtgatctctctgcagggcttacagctcggcctggaatacgtgctcagctcactcaagtcagtcctcagagttttgtatgttttgagggttctatt

SEQ ID NO: 67429 - DNA, 1096 bp, Homo sapiens
catgcagcctcgaaggccccttttctcccacggggctatctttaggacccatgatgcttcccctcctggggtaggaagggaaatggctgatgttagaatcccagacttgccggtttttataccaccgattcaaatcaagatactgtctttcagcctcctctctgccttgctaaacccattccggttcccttaccaagccgatttctatcgggggagagtcagtccttgaaaacatggggatttctccagcaaggaatggccatgaggagccaggccatgctggggtggccatctgcacactctgatgagcccacgctgggctcctctcagcctcatctgcaaggctagccccttctagtttctaattgctgtctcatccaaaaggctgagggctttctggattgactaaagaagagatgaaggtgaccctaggtccccaggaatgcccacctccctttctggctccatcctttttcaccctatgcctggtgcctccactccaggctgttttgtttgctctgaggggttaggtgtgaagggctgttctgtggctccccaggactgtctctggacccttcaggcagagcagcaggtgtatttgggatgagaagctctgagggtcaaggaccctacaattttctgtgtggaatccacaagggcaccaagcccaagtgagcataaagcccaacaaaggctttttaaaaattaccatgtgctgtccttttctctgattacaaaagtaatacatattcatgttcaaaaatttggaaaatacagaaaagcacaaagaacaaaaattcatccatattccactacctagaagcagctactatatctgaggtgtatcacctccctgtccttccccttctcactgtctctttatctctgtcttttaataggagtctcatgcagtaatactgttttgtggcttagttggtgacagtgtatcaggagcatttccccacccaacaaaactcatttgatgagtgtttcgccaggtgggaaacatggaacagcaggcactcagaagagatctcagcattgacagacctggattctctcctgcttccagtggagacagaggcccataaaatcc

SEQ ID NO: 67430 - DNA, 1039 bp, Homo sapiens
agatggagggagagtcagtatgagctgtggaatgccaccagaaagccctagggatatggagacaaccacactgagatgggaattgtaatttgagaaagaatttccaggtgaagagccagactcctgggacactcagagcactgggaaaaaaaaaaaagactaacaaattcctgtgtgaaattttcagctggaaattttttttaaaaatgtagccttaatggacaaatggacacctaattcctgaagacgttcttttttttttttttaaggctagaggaggtcagggcagaaatgcaggaacttattcctggcttttgtcctgcaccatcatctgaggccggaccccctggggttctggctgctgatgaggaactggatattgagggtcaagtcagctctggaatcactggtactaactgccagttggtgagaaccaatagttcttccagaaactggaggatggtactaggaatatgctgctgagaatgaaagaaaaaaggtttgagtcatagtagaatctgtgtagaaatggcacagggtggccaagcttgtgtgtagggagatgccgctgttcagggcacacaaagagtaattaatatgacccctcacaggagctgttcgtggacccagaggcatgcagactcacgtgtctgcgcagtgctggccccctgccctggaatgaacacatggccatgtgggaggaatggctttctcctccctcagcattttaccttggcccatatagaggaactccagcccttttggaaacagtgatcagagctgcttctgcttatccctccatgctctcaattgctctctctctctttctccaagtgggtaatgtgataagaagtggggccggcacaggggtggcacaggcacccttccttgctctgctgtcagggccgccctgccttcagggagcctgcattccacccgtcctcactggagcaaggtctacccctgcacagaaaagacgtgcagttctgagtgcaggtgaaagtatcaagagcccagctgtggatgtagacccaagcta

SEQ ID NO: 67431 - DNA, 1048 bp, Homo sapiens
ccaacaggctcagcttgggaatttctggctttaggttgagagaagggctgctgggcagagcagaggcccacttgtcctccccattgggaaacttccaggtcctgagctctccagggagatgccacagcaggtccagggctctttcctgtcttctaccaccctctctgctcccacagccctggattcatgcctctcaacatatgattttttttctccaatcatttgcttacaggtcagcctcctctatcagaatatgagctcatcagctaggatattggccttgatcatcctggtgtcctctgcaaggagacttgtgtctcccggccagggtaggttttttcctaagaaagtcctctcagaaggttcttgagttgggattggggtctcggggttgaggctgggatgagatactcccagaaacaaatcctcctggactgggtgttagtgtttacatctcttgccccattagagtacacatgtgaaaagatgaaggaaggtgtggggtagaagtcagtagactcagatgcgcatcctagtcctgccattagctgggagagtgactcccttcttgaagactccatttccttgtctgtagaatagagctgataatacctacctcaaggcattctggggagaaccgactggagtaataagtgataaagaaaagccgtgctgctctaagaggctgtcagtgcactgagaaacgcaacccgagcatctgtatttaactttggtccctaaacagagacacatacattccacacacactgtaccaatccccccttgctacagccttgggctcagggtgcatcgctagataacagaagggactgtactactggagcccagggccagaatataatgctggggtccaaggaaatgagtgaggaggactgaggcagatgctgagctagtcgtaaggaagcccggctcgcatggcatcctctctcatgggacacagaggcaaggctgctggctgaagtatcctctaccagagggaccctagtgcttgggaccaagggggcaatccagagcctccctggggacc

SEQ ID NO: 67432 - DNA, 1023 bp, Homo sapiens
gggtaggaaatccacagccagacctgttgccccctccttactcccagtgctagggcacagagggtgcatgtgtgtagtggagggcagggggaagaaatcaagagccagcattgtcatcatgttcgccccagccatcaggactgttttctgtgcagaagtctcattggaaagtatctaggctgggcccgttgaaaatccctcctctgtaccaacacggctcaacactattcatgttgcgtgctatcctttagccagctctgaccttactctgtcactagagtctgcaaacccaagggcactctctttgtggagtccagggttttgtggcctgtgaattctacagaaaggatgtcttattttctcaagtctcatggaatcacctgtccaaactcagttatgcatgccagaggatgggtgtatggctgcctctcaaccctctcagttcctggagattttgtgtgccatgtgatggagcagctgcgagcctggatggggcagggagtgacagagagcaccctgaatgtccaggatcaagctgtggctctgctgtgtgactttgggcaagtcacctgctccctaagcttctgttttacaattgataaaataggcatagtgatagatgctttgtagtatcctcttaagagcagatgagataacgaggatgaaaacgatgttgcaagctgtaaagtgctgggcatgcattagaggtggcatggggctgacataaactagggtcctggctcctggggatgggcagccccctttggagcgatcagctcattcccacagagcttgctgtcccccaggcagatcattcccctcccctagagctctctgttacattttaatccacctaattgaaagaccgctggatcaggcaaggaacttatcaaagggaaagagagaagagcctggtgccatttggctccctgcacatttgtcctttcaaatccttatagataattccatttctgtgttaggatcaagactagaaatttggatgagagggagagggagggacag

SEQ ID NO: 67433 - DNA, 1303 bp, Homo sapiens
gtctcttcctattgccgggtgtctcctgatgtgcaatgtcagcctgtgccacccttcactcctccacgcatgtgataggcagagcctgtactcttcccctctcagccctggctaaggggttctggtctccaagtcctctttcccatttcctcattccactcaccctccggagctgggggttatctccaaagcttgactccaatacagcgggaggtgggattccctggctgttggaggagcagggtccccagcagcagatgtctttctctagttttagaaccaggcttcatctttacctccaaacctcctctttcattggacttcctgaattttgcttctggactatttattggctcaggcccctgcactcagtctcagaattatctctgattccctgtgctagagactactagctcctctccaatacccatccctcctttctccttagtaacacaacttgaatgtactcagggcatggcaggtgcatccaaaagactacgtttcctaccctcccttgcagccagtgctggccatgtgcctaaattctggttagtgagatgtaagagggaatgttctaagagaaagtgtgagggttccttaaatggagctgactcagagggagacttttgcctcctgccccctttcttcttcctgctgcctaagatgtagaaatgatggcaggagctccagcagcttttttggtccatgaagtgaccttgggaatggaagccatacactggggtggtagaacagaaagtaaaagaaccagggtccatgttaaatctggacccatcatatcagtcctggcctggcttcctccagacttcttttaggcatgagacgctatcttgggtttctgttatgttcaaccatacctaagtccagctgatatgctcctctttctgcttcgtgcacccctgtctagagagtagtaaagcccagtggtctctttctccaacacacctcgtgcactctcctggccattccctcagttttgatcatgtcattacccaaatcaaatacctttcctagagccccattatcttctaaatatcaagttacttcccctggcaaccaagaccttccatcactgggtctcagcttatcttgctagtcgtatctcctacatcctgtagctcagccaagtggatttccaccaccccagacaccccctgcttttctacctctcctcctttgctctgttccccagcttgggatgcccacttcctcagtcttgcctgtcaaaattctacccatagttcaatgcttatcttaaagtttctttttccatgaagccttccca

SEQ ID NO: 67434 - DNA, 1026 bp, Homo sapiens
ctggattaagaaaatgtggcacatatacaccacagaatactatgcaaccataaaaaatgatgagttcatgtcctttgtagggacatggatgaagctagaaaccatcattctcagcaaactatcacaagatcagaaaaccaaacaccacatgttctcactcgtaagtgggaattgaacaataagaacacatggacacagggaggggaacatcacacaccagggcctgtgggggtgggggactaggggagggataacattatgcagcaaaccaccatggcacgtgtatacctatgtaacaaaactgcacattctgcacatgtatcccagaacgtaaagaataataataataaaatgttttgtcagatattcccaacatctcattcatctcagggttggtattgtggattgctttttgtcatttgagttatgatttttcttgatatgaagggtaatttttaaataattgtaacctggaattgtaggagacgcaggttcttatttaaactttttcattttagcaggtggtcactctgtttaggtttctcacaccggtcttggcctctatatgtgggtgatcactccaatgacaggtagattttcagcactttccttgtgttgttttggtccatttggtttatctggtgctgctggggattccgcttggtccctgctcatgctgcctgaggggtagaaggaattttgcagggctgggtcacaggagggctctccagggagaaggggagcctcaggcctaggagggaaggacagtgctttcccaggggtggtgtgtctgtggcacccatcaatcacaaattggtgttgagcttacctgttgttgtcagaggaattctgtttgatgttggggaggaatgagcctacttcccttctttgctaggttggggtttgagacatggtgggtctggtaaccttctcttagatgggggagcatgagatacccttctacttgtgatctccagtcctaggtcacagaccaatttgccttctcaccccctttcagagttctct

SEQ ID NO: 67435 - DNA, 1052 bp, Homo sapiens
tgtgtgtgtgtgtgtgtgtgtgtgtgtgtgtgtgtgtgagtgagagagagaaggtaaaggggtgggaagtggggagataggcatgaggggtctggatgggccctcctaccttgttttaggagaagcagctcaagtaagagaaaactgtttggattctggagttgaagagagcaaggtttgaatcccagctctgccactttctactgtgaagttttgagccagacacttaggcactttgagcctcagtttccctatatgcaaaatgggctaagattccccaccttgaagatgaacgagatgaggacaattacaaagcagtcagcagaaggcaggaagcacatcagatgcactacactaagccacttgtaaagtggttagcgggtaacctagttcataggacatactcagaaatgaaactcactttctgtgcttttgtttttatttggtcatcatcaaatggcttttgaggataggtaaagaggattacggtcatccagaggagaaactgaggctcagcaatgtcaagtgacttgcccaaggccacacagtgagcaaatcaccaggtagatcgtgactccaggcttgtctgacactgggtcctgcccacctccagtcttgctgactttcctgacccagccacctgcctccctgacatctttgtgcctgcctctgggcctgaggcagtggctgggagcctgtggtgtctggtggctagcctggatcctctgtccttgcctggccctctgcaccccatgccccccatcaccagctcccccgactctgctcctcggccgaggggcacactgcagtgaatcagcctcctttgtggtgttgattagaggcctcctcctacaaacatcaaagcttcaattaacatgggccgcttgcaaccctcttgcaaaactctgataagaatagaattttctcttggaaaatggatttttatttagttgtgtgtactgttggttaaatgacctactctatacactggcgctgagattctggggacagtgagggggctcgtcaggagctggttatctgaaggaaacagg

SEQ ID NO: 67436 - DNA, 1050 bp, Homo sapiens
tgcatgtgagtgtatgagagagtgtgtgtgtgttagtgtatgagagtgtgagtatgagagtgtgtgtgtgcacgcttgtatgtgtgtgtgtgggggcaaggggttcaggcctgctgctggccaggtgtgcatccatatttatcaggggagagtccctggaaggcagccggatgctgagcacttgaggcaatctgcttggaccagctgctctgttcctggccagacactgggaggaggagatttgggatgtcagcctaaacagtggtaccctggtctgtaatgtttgctgatttctgaggtgtaaatacctctaccatggctgagttcaagctaccaacatgaagctaacaggaatttcaggaattcctgaaattccacacggtggcccatcccccttggtgtagggaagaaactggcccagaggtggaagggcccgtggtcacatagcaggatgatgaggggctcagctggatgatgttgccagactgcactggagtgtctgtctgtcttcctggtgtcaccattgataatgggtgctctgtgacagtggggcaggatgatgaggggtcactgtgggcgccatccagcctgtgccaataatgacccaaggacaccacagagcaccaggtagtttagcaagtgctttcttacctgctctttctaaataaaattttcacagccacgcagcagagcatctattgttacattttgcagatgaggagactgaggttcagagcgatgatacgatttccccagggtcatatgaccagtacatggctgtgcattcacccaaacctaggtcttctgaggccagtcctggttcttaccactggcccaggatgctgaggtcacgatgccttcccctcagtgtggcctctccaggggcccgatgaccctccatctataagacctagaggtggaggtggggtgtgcatgccctgtgccttccactctatcaggcatgggagggtctcataagcacctgctgttgggtaatccgacccttgggaaatgggcaggtggctcagctttggcttccacttctccccg

SEQ ID NO: 67437 - DNA, 1054 bp, Homo sapiens
cgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaattatcttcttaactgggtattctgttttgggaagaatacaggctaatattgaacctgtggggatttggggggtggtggttgaatttttcactaatctagaaagcagtgtgagtaaaaactttcttagtgatagatccttcctctgagaaaacaggaattagtactaaactagactcaggaatagacacacagatatttggagacatggtgtatgataaagatagtgtcacaagttagtagggaagagatggataatagtgctcagaaaattggcttattatatggacaaaaataaagttgaaccctcataccatataaaacaaaaatcccaaagtgattaaagacctaaatgaaagataacgtgatatacagctagtaggaacaaatggcaaatgtttttgtgccttggggtaaagataaatttcttaaataagatcccaaagcacaatgcataagatttgatagctttgattactttgtaattaaaggtttctatttagcaaagcatcccatagtcaaagctaaagatggatacggattaggagaaaatatttgcagtgtctaaaactgacaaggattgcatatacaagggatagaatatagaaagagcttctgcaaatcatgaagaaaaagacagatgaaataaaaatatgcaaaaatatgaataggtaaa

SEQ ID NO: 67438 - DNA, 1050 bp, Homo sapiens
atacaggctttttaagaagtttagataagaagaccaagagaatgcatggtaattaaagggatttgaggtccactcactacctccttgaaattcacccctgtattgttttccatgacaccctactcctggttcttttctctgatcattcttggccacctttgcaaactcctcttcctctgtgcacctcttaagtctttcccagggctccatccataatttttagctgttctcactctatgtgctccctctggctgattcttacctagtcatgttttcaactatgacctatatgtacatgatttccaaatcagtatttgcatcttggtctggtgtatttagctgtttgttggatttctctattgatttagacttgagagatttcaaatgcattgtattcaaagctgaactcatcagcttctactgtaagcctgctcctactcttgtgctctctaacttgcctcctccttctttgtccttgtgtacctaatcaattagtgctgctaattagtcttactaattttgcctcctgtgtcttctctcttccgtccctctttatcattgccttcatcatctgttgcctggaccattgcagtgattttcctgccccagatcccctccagagtgatctctttgaaatgcagtttaagttcttgctttaaacccatcgtttctggatgaaatctaagctttttaccatggcctacgcagctcattatgcattggcctctgcgcctttccaactttgactcatggctgttccctttgtcatacttcaggttccagccataccagtttgcctttggtttgctgcacataccaggccacttcttatttccgtgcctttgttcttgttgctcattctgttctgaaatgacctccagaccctttctggcccttccatccccagtgctgtagttaacacagagcctttactgatcattcttgcccaaccctcatgtcacctttttatcatacctcccccaagctgattaagatacccattctgtttccatgacaccccatgcgtatttctaccagagtttatgctgt

SEQ ID NO: 67439 - DNA, 1046 bp, Homo sapiens
ctgtctcaaaaaaaaaaaaataataataatgtaaggaattctttaatttctaggttcttctcccagccataggagatttcatgtaagttcttcacctagaggacatcagagtcacacagattctttgctcctatccaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggtcaggattttcaggagccatgtccttcttttcgtgtgactcttctctctcagctttatatatgtcccagagaatcaagccaagaagaaggatgtagctctgagaagtgtagtaaatcttagttaaaaggacctttggaggtctttccttctgaaggcaaactggctataacccatcccagatggacttacagataccagatttcccaagtagcttctgcgtttatagcctcttaattctacaatctcattttaacaggtctagaaaaacttcctattttcttaggaataaaccgaggactgtaatttgcagagtgaagtttggagcacaagcattgtgtcaaacggatcacatacagaaattctccttctgccacttactgtctgtgagatttgggcaagatgcttaatatctctaaacctcagtttctttatctgtaaattgtggataatagtagtacctactgtgtaaggttgttatgataattaagccagtgtaagtaaaactcttagcacagtgtctgggacaaagtaagcatctagtgttagtgatttactagtataaattggactataggtctctgtatccagagcttaaggagaggcacttaaaatatgaaaccacttttagaaatcatgttgtctgagaagtcaatggtttgttttaaattcatgataaggcttgatgaat

SEQ ID NO: 67440 - DNA, 1677 bp, Homo sapiens
aactgaaagacttgattctaaatggactgctttttaccaaggaggcagaagttagaagatacataagggagaaaagaggggggtgtgggaggggattttttttttaagtgtatgtaaagaaggaaaaaaaaaggatactctgaggccccttttttttctgtagtcaagctcttgtcccagttctggagttttcattttgcaaatctgattatggattgaggagaaatggtaccttgtccggaggccaagataggaaactgataggctttaagttgactgaggagagagtctggtgattgatgtacctttaccatttattggatacttaccatgggtcaggcaaaactcttctaagttctttccaagattaagaccatttgtcatacttttcataagaaggtgcagatataacaaaataggtggattgttccctgattctggggctggggtcttctacccctggcccatgtgggctctgttgctacccactagttcagtctagccatgggaaattggaggccaataaaaagaaaaaaacccaaaactcattctgttcttgggaaggtgggaattggaagctgcctgcagagagggggagtggcacagcggcactgattgtctctccttgaccttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggagtttgttgttggttttgagtatataaaatactgactttgaacaggaaaggagtctcctgaggggagaccgagtccagcacaagtgaaggagttaccattgaaatgatgactttcaaacagcactggcctctgtattgaccctatccttgtttgatatcatgctgttagaattcagcctcctaaagaaaattttcccgtgtatctactgtaatttggggattgcagctggcatttaattcattccttcagcagatgcttgcttatctactttatgccaagcacaccacagaacagaggacaaaataaatctctttcatggaacttgaagtctagtggggaaaaatgacaataaacagatcaggaaaacagtacatcagatggtgattagtgtcatggaggaatgtaaagcagggaatggggctgggttgtgcaaggaaatggggagtagggaagatcttctgaacaagaaggtgataatttgacatttgggcaaagctgaggaggaggtcagggagtgagctgtgtgggtatctgggggaa

SEQ ID NO: 67441 - DNA, 1071 bp, Homo sapiens
tgcctcagatatgaccagagacctcctcaaggtaacagtctgcttgggaaagtcactgttgtcctcataagttagataaactgtctctatctaggggaagttgtcttttagaaataatgttcagggacatgaggtatctcctacttccctggctttgaggacccctgagcagagggagttaatctaagattggaattgcaggtttagaaggtgaccctgttagctctttctgatgacctggtagctttttggcctccagtgtctatctgggtcctcttctctgtctgtcccctagtgacaggatacctgacagctcgaagctatgactgagtttccctttattaagttggatctattcccgtggttcagatggacaggagtgagtctcaagctttaacaagggagtcagagaaaactgagacagctgcccttgtccgcagtctatcactgctggtattaattgggcaggaggcctctggttggctttctttgcttctgacttaaagcttaaactgacctctcatttcacagtctgagacttgcagtgtggaaatcccagagctagaatttgaactgggaatggcagtcctcgggggcaagttcaccacactggaagggctgctgaaagacatccgggaactggtgagtcacttgagtagtgtgtaaaccacctttgagcaatttggctgtgtgaagagggactggaagacttcagacatcctaattttcggtgctggtaactgtgggtttctttgccttaaagctggtttaagagacttaaatattactttggatggtgaagacaagtttatgggaaatgttgaatggaaattccaggcctaactttgggactttatagttattttgtggtcttggacaagtcatttattttactgtaaagttaggggatgagggtccttctagcacctaaaacttcccaacataaaaaacatacatgtatgggttgacttagcccaaatgtttatctccttgatgaattatttcacttgattctctgttgggcattttgtatttgtaaattgtactttttctttgcatttcttctccaaa

SEQ ID NO: 67442 - DNA, 1040 bp, Homo sapiens
gtcctcatgttgtgttccaggtgctccagttcagcacaaactgcccagaatgcaatgcccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaag

SEQ ID NO: 67443 - DNA, 1928 bp, Homo sapiens
gaacagagaagtggtgaagactgactctgctgccacaaggattcctgagctagattttgaaattcctgcctttagccagaaaggaggtaagtttaagatcagagtatttgggctgttcgcatgtagctagaatcttaccctctttcttgcaaaaccccctggtgccaggtctagtggtttgtgtatgggttctaccatgtaatcattgtgatcttcattagttaatcatgagtggaaagcttaggtaaaacagctcgagatggtagaaagtaatggtaataccatagtgtgtttattgtagaattttagcatcactattatcagacatgaatggaaccttgcacctggccttctcattttacagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaaggaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaa

SEQ ID NO: 67444 - DNA, 1017 bp, Homo sapiens
ctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggcggtcggatcttaaataaatccccctatgtctcctagccttagtttcttttgtaaaatggtactggtgttgtcatcagctcaagtga

SEQ ID NO: 67445 - DNA, 1883 bp, Homo sapiens
atatatgtgtgtatatatataatataatatatgtgtatatatatattatatatataatatataatataatatattatatatatattatatatataatatatatataaaatatatatatatatgctctcctctttcagcctctttgtcacagggaagaagtgtaggaggttgccttgggccctgcctctctcctaacctcctcttccccactgggtaccctcagcccctatattttaattcttgatcatgtagaaattgtttttggtaaatgttgatattattgttattatcattattaataaataaagagaaaaggaatttttgtttaaatgagaaatgtttaaccagattctgttctatttgaattgtgacttgcaccttttgttcaaagtatttcctttaggcattgtaattgtgaacagctcttacttgtgccagtgacagatgcagtggtctcctttccccagttgaagcagtgcatacgcagtagctattatttgtgttatctttatttctcttcattgttagaaaccaaagtcttctctgctggctggggctgagagagggtctgggttatctccttctgatcttcaaaacaagagagagaccttgaatacactgactcttccaccctttttttttctgggaaaggagagcaagaggtcccgagtcccctcctagtctttcatcctgaatttgcacagaggaaagcgggtgcccggcatggccatcctgatgttgctggcgggatccccatgcaccttgtccttctccactgatactggcagctcggctcctggacccaagatcccttgagtggaattctgcagtgcaagagcccttcgtgggagctgtcccatgtttccatggtccccagtctcccctccacttggtggggtcaccaactactcaccagaagggggcttaccaagaaagccctaaaaagctgttgacttatctgcgcttgttccaactcttatgcccccaacctgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctaagaccttttgtcctgccttttgtccttccttttgtgaggcacttacttacaacttggttacttagttggacagcaggaagttgtgtagataggagcctgattgtgttcttaggctgatagattatttgcctgtggtttggagtctagttggaagaagcctcaggtaggtgggagctggagcagtggaggctggagaggtctcccaggctaagggtggggctttgagtgacttaagaaactcgcattctctagaagcctgaactctgcttcacactgtgtccctgggcacccagctcggactctgccctgtcagaagggagcatttgaatttgctgggccaggtggaaaacagcttccttgaaagggcacttttgaagagtacagggaaggatccttaaagagtggacacaggctggacccttcatgacgtgacccccattggccgagtgaaaggatagccaaataagtatttggaaagaaagggaggggcctggcatggctcacgcctgtaaatccagcacttctggaggccgatgggggtggatcatctgaggtcaggagtttgagaccagcctggccaat

SEQ ID NO: 67446 - DNA, 1196 bp, Homo sapiens
tcaaaatcaaaggaccatgatacaaaattaacacttagtcaataagatagatgatccatttcccttattcataccacagtttcttggaatccagaaattcctgactgccatccaaacagctaactttaaacttgtgcaatagaaaaaaagtcagcccaacataatttagtgtaaatagtgtgggaacaagagtcagagcaccttaattctgctcttgcagctatcataaatacgataactttgtcatttaatccctctgattctgattttcctcatctgtgaagaaggtgttggaggaacaatggagtatcttacggtgtatctgtggagatgaaaacatgtatatatgtgtttgtttctacataatgtttgcatgagagagagaggcacattcagatcatctgaaatgtttgagttcagtgcataaatgtgaggtattattactctggtcgttttattagtgagctaaatgcagaatattacagcatcataagggcccccattatcatttcattttgtaccactttataattaatgagtatattcattatcattctgaaggagatcaggattgcaattagtaagttatacttagaaaatatagttccattagcatcacggcattcatcctagacaaaatcaggaatcttgcaatttaccactcctcaccattgccatccaagggaataaaaagcaatttatctgtaaactgtacaaccctgagactgagcagtttcttccatccttccctccccggaactacctgcatctcctgccctgtcatttaaagtcagtgctgaaaactcagccccagggggaattcggtcctgcagcacagagcagtagagaaggccttgctgtaaagcggtgtctgtgaaaacgccttggtggtgccaggttgtactcattatgcgctcttaggggggaattgttgcctgaaatgccaattcaatcctgaccttttgaacagatgggtgtcatccagctgagagattggctccagtgagatgtactgtgttcacctgtggctgctgtattcttagtagacataggagggtgggagctttcagaaccagatcataggtggaatggttaacagacctgagggtgtttaggattgggaggaaaaactaagagaaacatcacgcttgttagatggaagaagggattagatttttctgggttcatattatggg

SEQ ID NO: 67447 - DNA, 2073 bp, Homo sapiens
actgtgctggactgacctgggtatcagtctcttcacaacctgagcttctgaaaaagtcatgaaatacctggacctgggattttctgtgatgggagagaattatttttgtgcagaaagactgtattgctacttgaagaacatggctttctgaggggatcagaaacatgtccatttcagaaaacattgaaagcataggaatcaaattttaggagaaaatagtacttacttgcttctacttcaacctgaagtagaaacagaaatgacaagttataaggaaatgcttctcaacacagccttcatgatccctgttcctggattgtggcccgccaaattcatttgttttttgtgttgctgaaccaaatacatgttcgtgctcatttcattagctcactgctgggtcaagcctcaggtagagtctgaaacaaaagccatcattagcaaagacagggtaaaaggctttcacctgctgccagaactctctggatacctctgcacggtcattagattcctcctggtcccgcgctgtctgcattgtatttgaactcgcttgttaacctgcttcctgagctgtggttctgcttcagtcccaaatgaatcactggcaaggtagcacatcatttcatccaaagttcagtgtaatggcatctctgccctggacatgaaaccctgatcctttccatctgctactggaatgctgctgccttggcagtcttttatctgcttacctcagcccataaacatctctttctgatcatcaggtcacaagagtaggtgttagcttctaaccccgatgctgtcttaggcattccttatcaatagcttgttctttctttctgtaagattctggctgtgttccagttgagcagtggggtctttgaaggtaatccatatgattcctctttcattaggaggttgggtgagtgctgctgctctgagaagttgattttcacagtaggtgaccttatttgttgaccaggtacgtgcaggatctcaaggcccacattccttaagaatttgttgtctccatcccaggatcagaagtcttcattttcccccaccccaatcgccaccttctattttctgtcacagaacctatgagttctaggccagacctttgaccacaaaactgactgttgtttccctctggccatacggagatcattgctcagggaaaactttggctcaaatggtgaatttaaggtttctaaaggcactagatagacatatgattataaaagcaagagcttctgtacagtctggcctggaggatattgagaagcttttctctctggcctagtgtatttataagaactggatgtacttgatctcgggacctcaccaggcttggaaagtaagccaaccgaaggtaagtagaaatggaagatgtacacctggagccctctaaagggaagcaggctagggaaacgactgatgtctggaaatggcatgaaagtggcataatatgcagggctacctgggcagccagccgtctttatgttcatctggaacagcagtccctgtgtgatttggtcaaagcccctgagtcctagcctctaaccttctcttcccatatattcagctctacctacaaggactccaacactctgcacctccctacggagcgtttctcccctgtgcgccggttctcagatggggctgcgagcatccaggccttcaaagctcacctggaaaaaatgggcaacaacagcagcatcaaacagctgcagcaggtaatggaagaggtggcaggcatccctggaggagcatgggtgacagaggccaggattgcaggaggactggggtggtaaacgtaccccttttatgtcagcaacattgcagttttataggttaaaaaagtatagctttctgggccgggcgcagtggatcccgcctataatcccagcactttgggaggccaacgtgggaggattgcttgagccctgaagttctagaccagcctaggcaacgtggcaaaccctttctcccccaaaagattaaaaattagcatagtcccagctactcctgaggctgagatgggaggatcacttgaacctgggaggtagaggttgtagt

SEQ ID NO: 67448 - DNA, 1077 bp, Homo sapiens
tgccatcagttttgggatataagcacttttgagtaagaatgttaactaaacttctctgtcattctgttttgtatcagcacggaagttatggaagatctgcagaagctcctacctggctttcctggagtcaacccccaggctccattcctgcaggtggcccctaatgtgaacttcatgcacaacctgttgcctatgcaaaacttgcaaccaaccgggcaacttgagtacaaggtacctagacatggaagagggctggctccagaagaaacaaacttgagcttcctttgagaggctatgaggcaccttccctaggacttaagggtttacttatagagaaagatgatttatcttgcaaagtagctcgggtgagcgggaagcgtcctctagtctctgtcatgacccatggctcccttaatttccatagatgagtggcttgcccctttctccccgccttcccctcatctcatggtccgtcctccccactctgttcctggcaggagcagtctctcctacagccgcccacgctacagctgttgaatggaatgggcccccttggccggagggcatcagatggaggagccaacatccaactgcatgcccagcagctgctgaagcgcccacggggaccctctccgcttgtcaccatgacaccagtgagtagcagcacagagcccaattcactgtctcagaggcttttgataaaaaggttgtgagcctggggttgggaacccagggccaacctacatgtctgaatttcctttttctccaaacttaggatgctccagcccattttcttcaggccagtagagttttccacactttatttttggcgaacttacttacttagccaagttatttctacattgaactccactcctggagagctttttcctcaatgggcgctcacaggtaccctggttaagtccagctgcactcctgccagcttggggcaggtagcagcctaactcagagccttctcccaggcaacctttccctgccagaaggccaaagtgcccttaaattaattggtttctagactggcttccaaaattgccttttcactaatgctttctccat

SEQ ID NO: 67449 - DNA, 1192 bp, Homo sapiens
tgctacagttgtggctctagccttactactctggaaatgtaattttaataaagcgtactgttgtagatggcatttactttattctataggaatgtagaagtctttgagatgtacactgcatttgaatatagttttaattgtaaagcaacaacaaattgatgcctgatgtaagaaatcattttgatataggaactttgttgtattatcttttgaagttagagtaaattaaaataagagtaatttatcttagttacttgtagtattcttttcacaacagtaatatagaatggtgtttgccaaatggtatagaaattgaagagttgaattcaccctagaaaagtagatcaatttatatccatgtggagatgtataatagggtagtcaagagcacagcttagaagtcccaactttaccatttctttgccatgttgaatatgttaactttcaaaatcttgtttcttcttcatttataagtggagctaattatagtctctaagttaaggttgttgtgaaggttaaatgtaataaagttggtaagcacagtgcttggtatatcaaaagtagttttttgtaataatgtcttactgttgttgttattttcactggccagttttgttttcaggacggttgtgattaaatagaagcagaaaatttaaaaacctatagaaaattttattttaaaaaaattttcacaattacaatctcatttgattaaatactcaacaaatatttatttacatattcagtagatatttatgcagctcctaagtgtctagatataataaccattttaggtactggagagttgatactgggtacaacagaaagaaagacatgggccttgcattgcagtggaggagtcagacaataagtaaatacataaacaagatggtttcccaaagaaatcatttgcgtgaagacaatgaatgtgatgtaatagagagtgactggaggcccatcttagagtagatggttaaagaagagctttctgaggaagtgacgtttaaactcttacctgaatgacaaggagccaatcatatgaagatctgaggaatggccatttccactaaaggaaaaaacaaacaaaaaaacacatgtaaaggccattggatgagagtgtgttaaacatgtgcaaaaactagaaatgtgcatagtggcaggaaaccaggtcagagagggaagtagggggcca

SEQ ID NO: 67450 - DNA, 1046 bp, Homo sapiens
ctaactctggctggcttcttagcaaaagaaggtatcttggcagaaaacacccctggtttcttattgatttactttttaattatttctgcagggatcatagcactgcaagatagtcacactgttctgtccatgttataacaagatcaggacattataacagactttattttcttttcatgaggaaaaacagcatgttttgtgtgcagtttgtcttttaggaaaaggcaggcagcattaaagaggtgctctgagacaaacattttttaaatccagaacatctaaaatacagggatagactcttatcaaagccatgtggctccatcctgagattgctgttgcaggccatccattggtcttgttctgtttgctataatagcatcacttctcccccagggctggtacccgagctggacaaagtgagtggataacagcatcaagcagtgtattgcatagcatccttgttctgaaaactttaagactttaatgtcatttaacttttaaaaggtttttgtcaagtaattcattttccatagaaacatgtttcagagatttaatcgccaatttatttttgtttcctttttagattttgaaatttagaaaaaatagaaccctctttgaagtgagaattgtgccagaagcaattcattactaagaagtaaacatttttaagaagtttgtttaaattattgaaaatatagaactcttgggctgggtgctttagaattacctttgaacacacctaccattgactggaccaagtacataagaaactagatcatccccttcttctgagcacctgtaagcagcatgcactttcttgcctgcaagaaagcctttctgtgccttctggtacacagatgtcttctgtttccaccagctcaaagcagctttatgtggtcagaaagaatccatgactcagtttcttctatgccattgctcaccacagagctggaaaggattgttttgccatgttctgttctttggtgtcacatgcagggtttcagggacaaatggctttccctccttcataggatcagcctgaagag

SEQ ID NO: 67451 - DNA, 1024 bp, Homo sapiens
agagtcctttttctgcttacgcctcgtgtttctgggcacagttgtatctcagtagacctggagcatagtcttctgatggaggcgagtgctggctgcttttcagcctgtgaggccagctgctattgctgtattacgggagatagcgtgattgagagaattccttatgcacaagatccttccttttctcagctgttgtcataggcttgagctgagtttatctgtttttcttcctgaagggtctagaaactccagcagagctggtatagtgttctaaatgatcacttggaagaccagagggcaaagcctctaccatgtagctgcttctagccaagttgaattccagagtagctacatacagctgtgtgggaggccatgctctgcaaatggatatagttagctcaagaattctaagctgctctctattgtcagtaatgtgtggaatgaagtatcctcacaattcatgtatatttctatgcctggtgttgtttgtttgacacaagtttcctttcataggcatcctgagatgtactaaagacatatattttcaagttggaatgacagtggcatacatttaaaagaggatttatttgaggctaggttgattgtataccacctagtttttataattatgtatgtgtcttcctcctctccccactagaatgtaagcctcttgattatcagagctgtgttttacactcaataccttccataaaacctgacagcccctggtaagacataagcattcagtaagtgtttttgaatgaaaaactgagtcatcactacttaactatggaatcttatatcagactcttgtttttttttttttttgggagacagattttgccgcccaggctggagtgcagtggtgcgacctcagctcacggcaacttccgcctcctgggttcaagtgattctcttgcctcagcctcctgggtggctgggactacaggtgcgtgccaccacacccagctaatttttgtatttttagtggagacggggtctcgtcatgttggccaggctggtc

SEQ ID NO: 67452 - DNA, 1047 bp, Homo sapiens
gtcttgaattcctaaccttaagcgatcctccctccttgacctccatgagccactgcgcccagccagcaaacaatttttttaaaaaagcaaaacttaccttactatgtacagtgcatttcaatatattttattctattccattttaaaaaatgctgatttcgacttactaaattgatctcctatctgctatttcagaaacaatgacatagaaatacctttataacctgactcctgcctagctcttcagccccagctcccactctcccaccagtcaccctaattttcttctcgttccctgaacaagttctgttttctggagcatttcccactgccgagaatacatcttccctatcccaccccactccacccactcctgtattctagaattcagaataaaaaaaattagattggatagaaataagaatctagataatttctattcactcttcatgtctctaaactttctcttatcgtggtgcttaccaagctttatattgtaactacttctttcattgtatgtcttccacaccagactgaacttagtgaaagtacagacgaaacatgtctttttcacaactgtcaataacctaccacaggatctggtgtgtagtaggacttagtaaatatgaaatctgaatcagaaccaccccatccccagtggcatttgtttacattcagaataaaattcaaggagtcattattactatggcctacaaggcacagctgtcattgccccttctttggtctcatttcctgttactgttcacctccggttctgagctccagtcacagggccttccttgctgtttctcagacttgccaaacacatacattcccctcagagaggagtcataggtcccctcagagaggcctgtcctggctacccccatcattctctttctgtaattctgctttttcttcatagcacttactttattgtctcctcacctcctatcaccacttgaccataataagcatttggtttttgtttactgttatgttcccagggctttggacggtgcctgagttctagtaggcactcagtaa

SEQ ID NO: 67453 - DNA, 1100 bp, Homo sapiens
gtgccccaccagagtggtatgtttgttacaatcaatgaacatgcattgacacattatcacccaaagtccatagcttacatttgggttttctctcagtgttacacattctgtgggttttggtaaatgtatagtgacatgtattcaccactataatacatataaaattgtttcactgcccccaaatcctctgtgctctgcctgtttatccatttctccctaaccccctgcaactactgatcctttcactgtctccacaagtttttccttttccagaatgtcatatgggtagaaacatacaggatgcagccttttcagattggtgtttttcaaatagtaatatgcaataaggttcctccatgtctcttcatggcttgagagcccgtttctttttagcactgaataatatttccttgcctggatgtaccaccctttatcctttcacctacggatgacttggttgcttccaaattttgacaattatgaataaagctactgtaacatctttgtgcaggtttttgtgtggacataaatttttaattcatttggttaaacactaaggagcacaattcctggatcatatggtaagagcatggatagttttgtaggaaactgccaaactgtcttccaaagtggctatgctattttgcattcctgccagcaatgagtgagagcttctgctgcgccacatccttgtcagcatttggtggtgtcagcattttggattttggccactctaataggtatatagtgatatttcattgttgttttaatttttaattctctaatgatgtatgaggatgagcatcttttcttatgcttatttgccatctatatatctttgttgaggtgtctcttcaggtctattggtcgtttttaacttcaggttgttttattttcttattgttgagtcactcattacattttaaaacactttttctcattgcttctgagacgccatattctccagttttcctcctgtcctctggaagcaccttctccatcttctctaccagacttatttttctctgctcatcctttagatcttttcatctttacaacatctttctggagccatgttatttactgctgtagcttcactg

SEQ ID NO: 67454 - DNA, 1110 bp, Homo sapiens
aaagggatttaagttgccatttcagcctgcggacaaatgctaaccaactagggtgttgggggttggaaagcaacttaacaaattatattgagagccacttgcgagtggagaaataaatgaccatggccacatgaagagaccaacttcgctccactcatatggcttctgttgtgtaggtgtgcgtatccatcttaaccagcttcttctgtttctccctgttcttccgtaactctttagaatattcatcattttaatgttgactctgtaggtcatacatctttcccattgccagtaaataagcagtaagggatatcaagtattttatcggcatcagtacctgagaattacataaaactaactgctcagtgtttttgttcttattgttcaagatgatgtcttaaagtctttatacttaaaataaaaattttagttatagaataatgtaagcatactatagaaaatttaaacagcaacaaaaccgttttaaatattcaagctgcaatcccacctctgaaaccattgttaacattttgaatgcattttcttttgtctttttactatgcatgtttttcatacttataatcagtgtatttacaattttatatttcccatgttgctccatatagtcatcattttttttttttgagacagagtctggctctgtcttgcccaggctggagttcagtgccaccatctcgggtcactgcagcctccgcctcccgggttcaagcagttctcctgtctcagcctcccaagtagctgggactacaggcatgtgccaccacacccagctaattttgtatttttagtagagatggtgtttcaccgtgttgaccaggctggtctcgaactcctgacctcaggtgatccacctgcctcggcctcccaaagtgctgggattacaggcatgagccactgcacctggcctcatcatttttaatgagtgcacatcaagtagatgtaccataatttacctgatctaccccatattgtttttgttttgttttgttttgttttaaaagacagggtttcgctctgtcacccaggttggagtgcagtggcatgatcatggttcactgcaccttgaactcctgggctccagggatcctc

SEQ ID NO: 67455 - DNA, 1015 bp, Homo sapiens
ttagattgaaatcatttgaatataagatataaggcttaattaatccaattcagtatggagacggcaaaaagctggaagctgagggaagggaagggcctcctggtaataggaaggccagttaaaggctgtgaatggtaaaatcccgcatgagggtgatggtggcagtaaacatgcaaaggaagaaaacggcaacaaattcaagagagaaagcaagcgagaatttctaggaccagataaccaatcatatgtcttgaccaggaagagggaattttgaaagatatgtttagaaataaagaaatgaaattttcttactgatggattatattaagctatcaaaaaaatggtgttttgaaaatggttaatgtattgctattcgaaagtaattttaatgtccttgtccccaaagattaagtagcaaggtgtctatatttaaaatagattgcctgagaaaaaactgaaatgtagctggcttactccctgaagaaaagttctttcaaatgcttagacgttataagaatgttctgaaaattgtggaaacattttttttaaacctaaggaagttggaaacttttgtctttaaatgtcgactcccagaatggtctccatgagatagtttccactctcgtgttattgttttagttggcaatcagtagacagcaaagatcagaaatgcaactatagaaaggccaatatcctggaaagaattttcagagcatggatttaaggtaccatggaaaattttgaccttaatgcagtgagagctagaccattttattattttttagggagaaattaaaacatttcctaactcaattgacctttcacccttagtatgaatatactgagataccatcatatagaaaagaaaggttggaaaccttggatttttgagtacccttccacagtgtgttgactgacagtgcctctgactggtcacaggaagtagttatgcaatactcattatatcaatctaaattgtatttcatgattctaatgccctctttttaggctatca

SEQ ID NO: 67456 - DNA, 1081 bp, Homo sapiens
cagtgacgaatttctgtccaccctttccttaaatgatttaatattggggccttgcttttttacctcctctttaacacaggaaatatttctgatacttatcttcatgtgtgtgtttgctcatgtctgtgcagtcttctgcagtgaggatatgaaaagaaaggtagtgagttctatgacccttgaaaaacaccagaactctcttttcctaatgaaagtacaagtgtgttcttatgcatacttttgtataacaggatttatacttaaaatagtttggatacttattactaatgaattttgatagatgcaaaccaggactatcaatgtgttgttctctcattgctcattttgcctctttaactcactcgagagggccccttgtagccctccttaagtctaccttttgaaattacacaagtgtccaaaatgaaaactgactgtattcttcttcaacacagaccacctggtggcccatggtagaatggcagaaaaggaggcacgtcggaagttcaaacagatcgtcacagctgtctatttttgtcactgtcggaacattgttcatcgtgatttaaaagctgaaaatttacttctggatgccaatctgaatatcaaaatagcaggtgagaactgtactgaggatgtcagatagggacaaaggagcttttccttggggttctataagcaagggattatctgtttccatctcttcagaaagaactattgtgaaagtaaggacaatttaagatgaaaaaaaaaatagcctgaaaattgataaactttaaaagtacttcccctcccctgccctttttttttttttttcgagactgagtctcattgtcgcccaggctggagtgcagtggtgcagtcttgactcactgcagcctccatctcccaggttcaagcgattctcctgcctcagcctcccaagtagctaggattacaggtgcgcatcaccacgcctggctaatttttatacttttagtagagttggggttttgccatgttgggcaggctggtcttgaactcctgacctcaagtgatctgcctgccttggtctcccaaagtgctgggattacaggcgtga

SEQ ID NO: 67457 - DNA, 1400 bp, Homo sapiens
taaagactttcttaataaaagaaatcacttattttggaaattgtgaaattaatcattctgcagcatttaagaagcactttgatgtgttctggtaattagtatttactgccagacaaatgtctcttgggcattttaattaatgggtagcttggccaaatgagcttctgatggtaaaccttcataagggtttatttttatgtttctcaagaatagctgtctcttcaaagctctttaattagacaaggtttagcaactaaaacatattattagaataattaggccttgggttaagagaaatagggggtcagaggagcaggtactgttagaaaatggcctcttaaaacatagcattctacctctgatggatggccagttctttcacagcttctgttaagttactctccctagtttggacttcgtgttgtttaaagttcatagcagacctcaccggaagcctaaacacacccgagtgggagcttacttatccccacctctgacctcccagggaaagcttgattctagtccttttaactgctaagtggaagacttcttattttctcctttttcttctattaaatcgataatcttggctataacaatgacttgtatttttgagggagatgcttcaaaagccttgtgtgtggcgaacaaaaattacaataattcctttgaggatctttcttaatgatttatattatctacatataagatatgttcttaaagtgactacagtatttgcattccagaatgttatatttcttgtggtcagaatgcagtttgaattattttgcaatctgctctgtagatgggctggcatctaactccccttcttcaaccttctcccctaccatttcttgccacaagcgctcagtcttggcagttattgctagtaaatatgtgctaccctgaacttcctctttgtggtgaaggaaagatacacctgactggtcctgtgagggagtgagatgtcaccaaaacaattgtgtattctaccaaaactgttgataaatcacaatatatttatctatattccctcatttttcactttcctactgtctcaggatgcttaggatggcaaatatgtccttttcccagctagatcagttgattaaaggacagtgctcatgagactattagacatttctaacagaacaactgtatcatagctgacatttctaatcccactagctgtcatgacctatatgtgttgttggtttgataaagaactgagtcaaagatatgtatgttgttggtttggtataaacctactgctattattagaaagttcttaaagaacctgctaatccatcaaatcatttttgaatattgaggatagcctgctttatagtattatgattttatcacatgtaaattcttttgatataccttagttaacaaca

SEQ ID NO: 67458 - DNA, 1650 bp, Homo sapiens
actcttattaacctgcttagggggagctgagttatcttggcctcgccctgcttttttggaaagaagcgtttgtttgataaacaggaagtcgtttccatgggtgtaggaagaagaaatgatagaactgagtggcaaagcaaagaactactagctgtggttagtttggaattggcagaagttttttcaggtagtcacctaagatgaagatgagcacacatactgccttttcccttttctaggctgggttcattcttcactgaaatgtggtatttctgcctattgcttgtcctgctgtcagggtatgttcattttcagctagtgttttgcatcaactatgagttgtagacttagcagacaaatggagacactgtctgtttagagtggaaaagtgacttattttaagaaatgttggctccgcaccactatcccattagtggcatacctctgacactccattgaagctggcctagggaaggtaagactggcttctgtgtatttttgctctttgaaaggtcagaacctaaatgtaccacaagatattttcttcctgagtaagattgggacaaaattacaaacagtgaattctgaagcaaacttacgtgctggtgctctaatactttagaaaattcaaaatcgatttcctgtacttctaacaatattactcttcgtcgggtatgtaaatctcttagtgtcacttacttcttttcattttgcaaggaagggcagaccaaaaagattaaagaagaccaatgccaagtcatggtcatgggaaagtgagaaagagaatttaaaagtactttttacttttttttactttgttttactttttacttttgaaaagcacttgaaacaggagaaccattttttttccttttaaccgagagtcacctcatccctgtctgggtacatgtttggagtgaaattgtggtcaaagaaaactttaaatttgtcccagacctataatggcaactaaatagataagtagttgattgatggtgaaaaaagcttagtgtgatggacttgactttatgcagcaggtgtctacttgaggtttgtttagattggtgggggtggggagggggcaggactctagctaggggcatggctgcagtgtggatgattgggatgaggatatgggtagtatttgtgtctcagtatttaggagaggtagttcactgaattgcctggaagaagcagaacaactctggagttccttgcaattggagtttatcctgacaaggttcaacgtacattttactttgcgtattgagtggattcaggagccatttggtttcatttgccttctgaaagtactgcagtatttgtaaaaatgctgtgactatgtgttaagtccaggctggtctacagctctggatttcttcactgaaagttaaatatcacatttgaacttgaagaatgtttgctgcctgcctctagagcatatacgaatataaagcagctatttgtcagcaggcagctgaaaggcgattttcagcagggagtgaaaaccactgcaggctgctggcttcctggcacacccactagacctcgtaggtttacagtgaaagcaaaccaatgggagtaggggttggggggataagatgggcaaaaatcagggcagaggctgaggtctgaatgcgattgagccac

SEQ ID NO: 67459 - DNA, 1022 bp, Homo sapiens
tttgaacactactatgtactggtttgttgtggctttttttttttttttacatgtttttatttaatccgcagcatcctttatgtcttcacaactaaactaccattttcccactagtttatttactcctttgattattaaaaaaggtattttcggccaggcgcggtggctcacgcctgtaatcccagcactttgggaggctgaggcgggcggatcacgaggtcaggagattgagaccatcctggctaacatggtgaaagcccgtctctaccgaaaatacaaaaaattagccgagcatggtggtgggcacctgtggtcccaactacttgggaggctgaggcaggaaaatggcctgaacccaggaggcggagcttgcagtgagccgagattgcgccactgcactccagcctgggggacagagcgaggctccgtctcaaaaaaatcaaaacaaaacaaacaaacaaacaaacaaaaacttagctattttctaagggtctcctaacaagcaagtaaccatgctactgaactttagtcactctgaatcaaaataattgacttgtatttatttccctaattaatttcccatttattattattcattttttgttctgttttcttaatatcagatatgactaacatttattttatttatttatccttttttttttttaatgcccccaccaggagtgtgcaagtggagagatgcatggatgaaggaggggagctggcgggggtgggtctgtgaccagcatttatattgtaactggccaagatgtatgaggaagccacctgtgctttgacctcactttacactaaaacattcatttatagtctgatcatccagtcatttctaccatgacataaaaataagagccccagagaacaaatcaaattatttttgctgtattgagtatatataaatcccaaagggccaggcatggtggctcacttctgtaatcccagcactttgggaggctgagatgggcagatcacttgagatcaggagttcaagaccagcctggcca

SEQ ID NO: 67460 - DNA, 1018 bp, Homo sapiens
aaaacgaaaaatgcccccaaatcttaaactctttgagtgccaacatgacaccatgtggaaaattctatgcataagcacttaatacaaacttgtttttaatgcacaagattatttaaaatattgtgtaaaattaccttcaagctatgtgtataaggtgtatatgaaacataacgttttggataagggatattcaacctgtattgttattcttattatttttattgttttattttttgaaatggggtctccctctcgcccaggctggagtgcagtggcgtgatcacagcccactatagccttgagctcttggactcaaatgatcttcccacctcagtctcctgagtactaggactacaggcatatgccatcatggctggataatttttaaaaaattttttgtagagttgggggtcttgctgtgttgcccaggccggtctcgaactcctgggattacagcatgagccaccaggccggcctattttgtcattatgccactttcttagacagtgttctttggttgccattttgaactattagaactgccttgttaaaccatttagcttttgcccttttcttccccagatccctaatacttttctgcccaatcctttctctctattcagagtgtttcctgtttgtcctacattctctttctgtcctccttctttcctgctcttccctctttttttttttgagacggagtcttgctctgtcacccaggctggcatgtagtggtgtcatctcggctcactgcaacctccacctcccaggttcaggcgattctcctgccttagtctcccaagtagctgggactacaggcatacaccaccatgtttggctaatttatatatatatatatatatatatatatatatatatatatatatatatattttagcagagacgggttttcaccatgttagagaggctggtcttgaactcctgacttcaagtgatctgcccgcctcagcctcccaaagtgctaggattacaggtgtgagccctgcacctggcctct

SEQ ID NO: 67461 - DNA, 1032 bp, Homo sapiens
ggagtgcggtggtgccatctcggctcactgcaagctccgcctcctgggttcacgccattcttctgcctcagcctcccgagtagctgggactacaggcgcctgccactacgcccagctaattttttgtattttcagtagagacgaggtttcaccgtgttagccaggatggtctcaatctcctgaccttgtgatccacccgcctcggcctcccaaaatgctgggattacaggcatgagccaccgcgtcggccgtctgtctatcttaaatgaaactatttctgatatctggagattcttttggatctcattggcaatgaattaggggtcatgttaattggcttaaaagtagtattgtcataagacataaaagaggggctaatagtataatagttgggttttacttaaattgtggatgcttttaatgatttttaaaaacccacaatgttattaactatactcaatactttaatgaattgatacacagttacgacaatttcctttacataaaatccttggttctaccttagcatctttttgaaattctacacttgtactctaatgcaaatttaggaccatcagagaaggtcagtatttaggatgtctgtaatcctgctacaggaaaacacaaagaatcttgttaaatgttaactctgttatattaagcatatacttcatgtagctgtcttttgacatctgttgtggctatgtttaacctatataataattttatatttcagtggaatcattctcagttttttctatggcaatgttgtttatcagttgtccgcttaccacctttaaaataaatatcagaaatttggccaggcacggtggctcacacctgtcatcccagccctttgggaggccaaggtgtgtggatcacaaggttaggagtttgagaccagcctggccagcatggtgaaaccccatctctactaaaaatacaaaaaattagccgggcatggtggtgcgcgcctgtagtcccagctacttgggaggctgaggcaggagaattgcccgaacccaggaggtg

SEQ ID NO: 67462 - DNA, 1254 bp, Homo sapiens
ttgttcttcagagaaaggaggaagagtgggctgaagtaaacgctatatgtctaaaatatcacaattatgttgacttttttttgccaccagaatgattgatgcccttgatgggtcatttcactaaataaagtgagttaccacagcccagtagaaacccagatctggttgtgtgaccttaatagaggtatctgaaattataaattgattttcttccaatagcccgcatctgaaataactggattgaggttcatgtcagtaaattcttcaatttctatgtagggaaaaatgaggacctttttgtttgtaattattctatttattgaacagttattagttgtacttctaatctgtactagaagactatattacaaagtgtttattttccctaaacaatggcttctcttgattcgtgttcattattgccctaaataaattgaaatttagaaaaagaaaaacccagttttcttagtatcatacatgcaagcttaagttttcttatttgtttgtttttatttgacatacatgaaggttatttccaaagatacaaatggaggccaaaacagtttgacataaagcagaccaaaacagattgaattatactgtacctctacactgactagcattttgatgtctagatggataagtaagcatagtgctaatttacaagcgcaaactcaactagtaagattaactaatttctaggctgtaatgaatttatataaatattcttgttattcagatgggaaacctcataactgtgctgtagattagacttgcattgcctaaaactggagaatgtaactttttttgtttttttgacaaacccacagccagcatcatagagaatgtaactttgcctcccaaatctgtgtatgtcagatcacttataattggagctgcacagttccctcttctaggtttgactctttaaacttggtaacatctcattaggctaaatgaattctccatgccctattgtctgtcttgctatgttgcctaacactttgattttaacattaggaaaacaactaccaataaacatgagataaaacacaaaatagatgaataccactagcttggtaatataaaccattatataacagggatttgctgcagactcttttcacacatagaaaacttttccaaaagacatttttgaagtttcgctatgaagaaagtttgccagtgactgaaagaaccttttgtaggtccctatttgggagtgcggtaactggtgcttctggactctataca

SEQ ID NO: 67463 - DNA, 1019 bp, Homo sapiens
gaacactgactgcttttcattgctggcaaatccggacttcatcagtactggctacctgtaaggaatgtgagcatgttggattttagaacaggaaaaacacaacttccacctcatttcacagtagagttcacttagggatacagactttttggtgacagtaactgttactttctgcttattaattcagatacttgcataatgctaacctggtagatattgtcagatgacaagccttcctcctacatgttctctataaaagaactgctagtgacaagcattttattatattaaaaattctacttcatactgttttaagttaaaatgtatttattatgaagccaatattgtgaaatgtttttttctttttccagaatgtggtttttttttcttgtaatggactaagatgcaggcttattgtgtagaatgaggagctattgcccagatggaccttagtgaaagtaacttaaataagcaagtagattttgcttctgtttgggaaaatgatctaagacggatgctggtattttgggcaggtggagactaatgttttatctcaatgtttgcaacttaagttcagcctacttaagggctgtcccttaagggtgtccaattgtttggcttccctggccacactggaagaattgtgttgggccacatataaaaatacactaacactaacaatagctgatgagctaaaaaaaaaaaattgcaaaaaagtgtgataatgttttaagaaagtttatgaatttgtgttgggccacattcaaagccgtcctgggacgcatgtagcccacaggctgggttggacaagcttggtctagaagttttctagattttactacaatgttcaaatggcaaactttaaaagtggggaaaggaattttgggtgagataaaaagacaggtttgaaaaagcatacaagttcagggaactgcaaatggtttcttaagaccaaagcgcaatgtcagtgtgaagaagtggcaggcaatgggaaaggataaatcagtggagcccagaca

SEQ ID NO: 67464 - DNA, 1464 bp, Homo sapiens
tgcagttgtgtcttgcttttttcacaatactcaatatcatgagtatttttatcacttaaaattatccatgaatatagattttaaatggctcataatctttgttgtatggatgtacagtaatttatttaaccattcctttcatatgtttaaagtagttccattttgttgctattgcaaataatgctgtgagaaacatttttgtatgtaaacttctgtcaggatttctgattccttccttacaatacattcttagaggtagaattactgtgtcacgacgtgggcatcttagaggcctttgttaactatacattgccaaaatactttgcagaaatatagtttcgatttatgccccttttatattcttacatttctcctttctctaggaaaataaatgttcatgttactcaccttcactcaaggtttccaaacactttttcttggctctcctcctacaactctgttctcagctttccaaaattgtttctctttactccttagatatctgggtttccttaggttctgtgctctccctcttctctctatgtatattcttctttgagctaatcagaaccagccccttgccttcaactacagtttacatcataatgactcctaaatcccatatctctgctgagttttgggaaccagttctaacaccatactagatatttttaccttatgctacatagccatcacaaatgtaactcccttatccaaaactgaactcattatccaaccacactaacttcatctccactgatggcagtatgacccatccagtggtagaagccagaagtttgggagttagcctagatttctccttgaattttgtgtaccactggtcaatcattacattttaagattctgcttccaaaatagctctctaatttgttacctcccctttccactgccttaatttaggccctcatattttttgtactgctgcattggtgtcttaactgatacgcccatttctgacctagttccatccctcagtttcatccttcacattaaaaccattttgtcttttaatttttaattttatttttgagacagggtctggctctgttgctcaggctagagtgcagtggtgcaatcttggctcactgcagcctctgcctcctgggttcaattcatccttccacctcagcctcctaagtagctgggactataggtgcttgccaccatgcccagctaattttttgtagatccagggtttcaccatgttgcccaggctagtctcaaactcctgagctcaagtgatccacctgcatctgccttccaaagtgctgggataggctgggcacagtgggtcacacctgtaatcccagcactttgggagaccgaggttggcggatcacttgaggtcaagagttcgagaccagcctggccagcatggtgaaaccttgtctccactaaaaataccaaaattagccgggcgtagtggcgggtgcctgtaatttc

SEQ ID NO: 67465 - DNA, 1034 bp, Homo sapiens
ccatagtacacaacaaaaaagaggcattataaaacttttcagaactactaaagtggtatgattttatgatttcttgttgaattcagcatttgaaaacagaagaaatgtgaaaacagaggaaaggtgcttagcataggaattaacttgtttcttggcaaggaaaccagggtcaggtgtttgaatcacttggctttgtggtggttctgttggtttttgtgtgtgtgtttttcttcttctgctggattatcatctctttttttctgccttggaaactgttgctttatctagggcaatcaccccacttacacaggaggcaaattcaaagctggttgccttatgttgttaaaagctgtcagattcacatcctttgccatatccttcttcaggagtcaggacaatgaagacaggagtctaaacatggggccagagtgagctgccccgtcctcagtactaacacctattcctgacagcttaagttgcttctcagccttagtgaagctttctcagctattctggctcatgatgatcattccctcctttgaactgaaatagcctaattgtctctgagtcatgtggcaattagtcttgttttgctttctgatatctcttgtagttgacttttattgttaatgtatgctgcttgaaggcaagggctgttgtgaatttattatattgctatatattttacagagactcttgatttttccctggtttaccttgggaagttttcctgcctcttaaatggcgagaggatcctttagaagatttcctaactctcagaatcttttagatttttcatgtcatgctgtgtttgctatggccttgaaaaagcagtttttcccttttttgcagcagacacaaccaagattctggataaagaccaggcaacacaattttcctagagtaatacttaccttgagtagtttcttatggggaaaaaagcccccaatattcttaggcttaatttctatgatcaaatattttaaagatagaaacaaatgatatatagtagttaggtatgggggcaggcaaac

SEQ ID NO: 67466 - DNA, 2697 bp, Homo sapiens
aaattttagatgtcaacctaagaatattcaaggagacacctttttccccccattaaatttgttttagcaggtatgtgagcaaaacttttgaatagtgccgcaaaggatatagagatcaagaagaaataatttttgccctcaagatgcttgttagttaaatggtgaagcaggggcatagatacatggtttggcttaaataaagccttaattgtgtcatggtattttgctgtttgcttaacatgggcattgtgcctcagtgttgtgtcatgcttgttaaaatgacccttgagtggtagtttagctcatatgtgctgtgttaccacataggctattgtgcagaacagtgaggaattgtatattgtgaaagacagatggataggaacagtgcccactgcacttaccaccaatgaatggtagggctttctctcattgtctagttgatgtgatcataaaaaacattagactggaagtcaggacaccctaattctcatcctgagtctgccacagaacgtatgaccttggctaaatcatttaacgcatttgaactctagtttcctcatataaaaaaagtttaaactggatgattttctacctgtgaagtttagagttcatacatttttacacagtatatgcgttttagaagggataggtgcagcagattttaagaaacagatgccaaaataatggagtagattacttactgtaatatgcggagaagagtagcttactaattatttatctaagtgtgattaggacagtctgttatatggcttgtcgtaagtgttgtgggtctcaccactgccctttttatttaaaaagagaatttcctctacttttgagaattagaacaaatactacacaggattagtaagcgagaataccaatttcagcttcatgccagtgcctctagtgaaaaccacatttttgcagtgttctagcagaatattaaaatggcttatggattacagacagctcaggctttggtctttataggtcagaggtggaaaccaacggagcaattaccgttcactcttatgggcggggcttcttaggttccttatggagctaaagtgaaactctggaacagttccactagaatggctttcctgggagcttatgaggcttacattctgaaactgatactcttgtagtacaagaataactacaaactgatgtggaattaggaggccagagaggggagaagccacatgtagctctcattctcacaagtcctttggctggcgaacagaggtttttcccgtcactaagcagatatttggttatatattgacaaatcctctctaaacaattcttagaatagaagactgattctgtcttgtgctttggaggtgaaggggaagagcaatgttgaaatgagtgaaattagcttgtgatggtttaacatctgcaaatatcatctatctaaccagtctttatctcctatgtgtgttcttaaatatggtccccattgtttgaagccaagaaagataactgaggaaattctatggctgatttgccgatgttattaccaattatttattagccttagtatcggatagtttgactgatttgccatgttgttttttagaaatgggggtcttgctctgttgcccaggctggagtgcagtgacgcaatcctagctcactgcagcctcgaactcctgtgctcaagtgatcctcctgcctcacctgtgagtagctgggacaacaagcgtataccaccacttctggctaatttctttttttactttttataaagacggggtctccctatgttgcccaaaggctgatgatttgccttttttaggtagaaaacctggactgggccctcaagtttttaactttttttttttttcttggtgatacaaaatgtggggtgaagaggtctgttaaagtgaccaggcttggtgctatttaaagccgaggagggaaatactgtttcctggcaggctttattgtgtttttgtattattaaatctcttaagtcagcagtttactttttgtctagttgtatgtcttggcttgtctaaatgaatcataattaaaatttagtcactgggactcttaatcttgtctaagcaggaattatagtttagagatactataccttgctgtgtatagaataagaaaagtataagtctgctatgatcactgagatgggtttttataagtactaaacttttttagaagcatagttttctttatcacctgtcccccagaaagtttagaaagtgaaaattaaaaagtaagtaaaaataatggtattggagttataatttggaaatttgtttcattcacttgcattttaatatttattatgtaaacatgaaatgataaatttgtttcctttgaaaagattcaagaaatagaatagttttaaaagtagtcttttacattcctttgcttattgacaaaatcatcatcaggaacatcgattcagggaatgaggcttctgatccatctcaaaacgaacattactaatatttgctatggtcatttgacataagtttttattgagtcagaactatactggggcagtagccttcaagccagttaaacatgaattaagaacttgtgtgccaggtactgcactaaatgttaatggcataaaggtgaataaaacatcgtttatactgtgttttgtttcacacaggatttgagatggctgacagaaagtaactaaagtgagattgtaaa

SEQ ID NO: 67467 - DNA, 1050 bp, Homo sapiens
atgcctttaatgtccatgttgattacttgtccagcatcttaatctcatctgacttggtctttcttctcccagctatctgttcttccacttctctgtagcaatttatttctgtggccaaacgtccacttctggaattacaaatctgtaaatttttctctttgaacacaatttcctgtcttttcagttcttccatttgctgagtttattttctcatttcactgaggccgccagccccttaaatctccattgtctcccaatttgtgacattcttcctggcatcactttatcccatatggatgccataattggtcactttcaatgagtcatcagtatccgcagttctcctgcatctttgttcttctttcccacatgccatgcagatctccagctgtggattaacagtactgccctttttctgtgttcccgctctagggcctgaagaaatgatttcatcatattaatttgttcttttgctaatccatgggttttagcctcatctgtgcttattattctctttagtagttttctcacttgtttggagttgatttcatttctccttcaccagaatgacagttctttctaaatctttccacattttcctttggttcgtgtcaccttcctccattgcagctgattctacacttcagcagagtgacctttaaaaagagagaaaacaacaaatctattatgttatttcctgtacaatactgttcattataaagatggaggtaatttttttttttttttttgagatggagtctcgctctgttgcccgggctggagtgcagtggtgtgatctcggctcactgcagcttccgcctcctgggttcaagcgattctcctgcctcagcctcctgagtagctgggattacaggtgcatgccaccatgcctcgctactttctgtatttttagcagagatggggtttcaccatgttggtcaggctggtcttgaactcctgacctcatgatctgcctgcctcagcctgccaaagtgctgggattacaggtgtgagccactgcacctggccagaggtaaaattcttaagttt

SEQ ID NO: 67468 - DNA, 1089 bp, Homo sapiens
ctggctaatttttgtatttttagtagagatggggtttcaccatgttggccaggctggtcttgaactcctgacctcaaatgatctgcctacctacgcctcccaaagtgctgggattacaggcgtgaaccactgtgcctggcttgacttttttatttaaaaaaaaaaaatctatacccaattgccctatcagtttatcatttactcacttatttgaaacggtcatattaacatacactctttatttatttatgtgcctatactttgttttaattactgtatctttagaatatgtttcaaaatttcattaactattataattgattctctttttttgtaacgtatcatcagcaaataataatttggactcttctaatatttctgcttatttattgacattttcaaagaatagcttatgattgataataatcataccagcgaatacagtgcttttcaacttaaatatgcacagcaattacctgaggatcttattaaaatgaagactcagtagggctggagtggcctgagagtctgcattttgacaagctcccaggtaatgttgacttatgggttcatagaccttatgttgagttacagggaactaagatttattgagtacttaatttgttctggtcagtgcttttacatctgtgaactcgtttaatctttaaaactccatgatgattattatccccaatttgccagtgaagaaactgacacttagagaagtttataacttacccaaagtgacgcaaccattaagtggaagagccagactgagcccaagcagagtttgcactctgaacctctcgaatatattgctttaccacatgcgtgttcgctcacacacacacacaacagacattatcttctcttgtgtgactcaaatggtaataccttaaaattttttttttaatgaataggctttattttatctattttttgagatggggtcttgctctgttgcccaggagtgcagtggtatgatcgcagcttaccacagccctgaacttctgggctcaagccatcttcctgcctcagcctcctgagtagctgggactaccggtgtgtgccaccatgcccaactaattt

SEQ ID NO: 67469 - DNA, 1252 bp, Homo sapiens
cgaatcacttgagatcaggagttcgagaacagcctggccaaggtgaaaccccgtctctactaaaaatacaaaaaattagccaggcgtagtggtggatgcctgtaattccagctacttgggaggctgaggcccgggagacagaggttgcagtgagccgagatcatgccattacactccagcctgggcaacagggtgagattccatctaaaaaaaaaaaaaaaaaagaaacttcattaagaagttaaagcctgggtatgctctccttgataatttctttttactcacatctttattggtaaatcaggccagaaggattatttaccttttcagaaagggaaactaggttctacggtttggttacagatagcctggcagctgactttacattgggcagaggagactgccgtacttagtggttctgagaaaccaagagagtattgcctgctacagctatgagaaaaggtattgaatcttccccctcctttgtgggggaattccaatctcactaatttatggtttcagtgtagttatggtcatagcttctgagacgtgggtactcattgaagctaacagttttagagaaaggggagggtgtttaattccaataactggtagtttatatcactttaataatttagacccaatgatatgaagattagttagtataaggcagatatacatgtaatacattcttttaaatattgtacaaggagtaagaaacccctttaagtagtcatgtaattcattatagcagctgaacatttctaagtgcaacattataggaaaccagtaaagctgatttctgatttatctgcagcaaaagaatttaatattccaacttcagcaaaaggcaattaaaaacaaacttaaatcacattgtgtgcttttaatacgtatgtttttttccatgctgtctgatgtattttagttcttagtcatttacttccattagtttccaaattggttgagggaattaaattggtagccaagttacctatacaagattttcctactgtgtatgtgaaccactctttctgggaaaatcctcccgttggcacttttcttgaaggcatgcactttttccacacttagtgatttggggactgaagcctgcatttagcctgtatttagtcagaggtgacaaatggctaaattttttttttccagtttagagattgagaaatgattcagaattgaaactaaagtgaatttggacttactgtatttctttgcaattacttttaaacaattg

SEQ ID NO: 67470 - DNA, 1069 bp, Homo sapiens
ggaggattccttgagttctagaccagcctggtcaacatagggagattctctctctcctgaaaaaaaaaaaaaaaaaaaaaaattaaccaagcatggtggcacacatctgtagtcccagctactcaataggcaaagtgagaggattgcttgagcctgggaggttgaggctgcagtgaacatgatcaaaccactgcattccagcctggaggacagagcgagaccctgtcttacaaaacaaaacaacaactcttggaatttctcttttcccctcccttcttcttccccttcttccttctatttatccttctgtttcatctacaaatatttgagtgtcactgtgttctaggcactgtgccagacattgggattcgttggtaagcaagagagagaggcatggcctctgtccttatgagcttgcagtttatcctagtgttacttatctagtctgccctgccttcaaggttcagtggaagcccgatcttcatgtagtcctttgacttctttggcccttgcaaacctatccctttgacctatgctactttaaatctgattcatacaatttagcatttattgatataatttcttatactgtgggctaattgtttaaatatcttgttttactggctagagtatagttccttaaggacagagactgtcatgttattttttttttttttgcaatactgagcccaaaggttttgatttcagtctgccctgctgaatgttgaagttactagtagctcttgggacttagaagtagtgatgagataatgccttgctttttagtttattttctattttgttttattttatgtttcttttttgaaatggtattgggctggccgcagtggctcacgcttgtaatctcagcactttgggaggccgacgtgggtggatcacctggccaacatggtgaaaccccgtctctactaaaaagacaaaaagttagccaggtgtggtggcgggggcctgtaatcccagctactagggaggctgagacaggagaattgctcgaacccgggaggcggaggttgtggtgagctgagatcgcaccattgtactccagtgt

SEQ ID NO: 67471 - DNA, 1095 bp, Homo sapiens
tgtatttttagtagagacagggtttcaccatgttggctagactggtcccaaactcctgacctcagggaatcctcctgcctgggcctcccaaagtgctgggattacaggcgtgagccaccacgcctggccttgagttgtttctaagctgttgctaataaaacaatgctagaggatttaaaaaaatatgttagggttttatattgacaagtaaatattgtcataatagaaacttgctatacttataataataatacatctatagaacatgttcataaatgtctatttgagccttcctgtaaggtaagtacaacattttatcacttcataactagtaaagtggcagaagtagaggtagaaccaaggtcttctgactcctatttgagtatctgtctactttacccaaaatacatatactgttgtggggctgtagggaagtgggggtgggaaaataagaggaagtagacctaggtggggcaagcttgagatagggatgtatctgtcattctagaaattgggatcctgtttgctaggagtaagtggaactggacatcagcctgttacagggacataaaggcacttaggcactggcagagcactatggtttgattgccatcttggagtacagtagtatggtaagccaaagagtggtagttctggagaagctggggactgtcagagctccctagaatagactgagagtgaaacagcattcacgatttgctaaggaggctgggctactaggaaggataaggtaggagcccaggagttcagggctgcagtgaattatgattgtgccactgcattctagccttggcaacagagcaagaccctgtctcttaaaaatattggtcaagaccataaaacaagaacataggccatagtgaaaacataaaattttcttagcagctgtggtagcaaacatgttaatggtaaggagataactgtaatgttagtcaattttggcttaagactgaggactgagaaacagccttcttcctccggaggagcagttaagtcatcttacaactgggagtagagagacaaggacgtgtgaagctgattcatgctttcattatatagttaatactatttgga

SEQ ID NO: 67472 - DNA, 2054 bp, Homo sapiens
ggggcattggttgctttactgagacaaggagaagcattgattattttggcaggttggttgagtgaaggtgggctaagagagcttctgcgttaatttaaaatgataaagaagtcaaagctgttagaaatttgaggacaagttattttatagaatcttttattatttatagtgtgtacttcgaggtggtatttttgtccacttatgttagaatttgtgtgaactgagctgaatttggtaatgagtcagtggtattaaaaacttggtgaagaaactggccaaactctttagtttaagaggtttatatctgttcactgctagtgtagtgttctgtggaacaagttgacattttcttgtagtaagttgttttctgtttctggcggaagcaatcttggttcatatgctgcaagaaacagaactgtttttattgtggaagacaggagcagagctgtgtgtttcttattaggatgagttggacacctgcaggatttcttctctctttctgcttcttgcctcctgttgtcttttccttctgttagaatgttctaatattgcataagcagcattccgacaatagttgaatttttttggtacttcatttttttaaactctcaaaataatgtttttagtgattgtatgttcttggcttactttccatttctacatcaacagggatattgttattctagtcaaatggggtagttgtattctggcaatgatctttgggtccaagtcagctgcagaaacaacactttcatatattatacctaaatatcttacatgtgtatggtaattctgggaggtaattaaatgttgggatggtactttaggatctctttaaaggatttcacagttctcaggaataaaataacttgtttgaagcatgttactcattggcctttgaccatgcaaaagggtagccagtgattttagcctactgcctcttccgatctcattttcctcctttcttttgaggcagcagctgcatccagtgccctgctctaattgagctcttagtaaaaggggtattgttataccaagtcacaacctcgtatagcagtgaggttacatcaatggttgttagatttttaggccacgcatccattttggagtcacattaaattttgaaaaccaaaatttagttgcattacctaaatttctcttccttttcttatcctgataccaggataagaataggttttctgtttttccagctctttgtggaacctttttggcccatcagagttgcttgcgacaatctgtagttaaagaactgagactggtgcgggaatcgggatgtttctggttccagtttttactagccagcagtttgactttgggcaaattacttaacctcagggggcttccagtttctctttaatttataattttttcaactgctttattgaggtacatttcacagaccatacagttcacccaattttttttaagtgtattcatggagctgtgcgaccatcactataatacattttagaacattttcattatccttaaaagaagcatggtacccattagcagtcactgcttatttcttcaacctctcttctcagccctaagcaaccacaaattaatttttatcgatttacgtcatctggacacttcatataaatagaattatgcagtgggtgtcctgttgtattttacttctttcacttggtgtaatgccttcaaggttcatgcatgttcttacatatgttggaatctcattatttttttatggctgaataatattatgttgtatggatacgccacatttttaaaatcaattcatgaattggtgggcattgtttctacttattggcgattatgaataatatggtcttgaacatttgtgtacaaatttctgtgtgatcatgttttcatttttttcttgggcatatacctaggagtggaatcgcttggtcatgtggtgactccttgtttaaggttttgagcaacttccaaactgttttccacagtagctgccccattttatattcttacctgcaatgtatgagggtttctgttctgtctacatccaaaacttattttctttt

SEQ ID NO: 67473 - DNA, 1051 bp, Homo sapiens
catagatctcgctcaagccagaggtgcccagactagttatttctgtgccagaagtgctgttttcatttttcaggcttcagtctggctaatgttttctagttcatcgcgtaaaagagaacaaaatggatgctttgaaaagaaaaagaaatgctttctactcaccagagccactgtaactgtaaaacaacacctaagacatctgcatagagatggaacctttcccttaatcatttattcattcaacacatttattgaatgaaaattttttgtcaggttccattctagggtctggagtgcaccaatgaacaagggagacaaaaagcatctgcctttctggagctttctagtagaaggagacagacaagggacatgtaaaaaaattaaaaatttcatataggaatgaataccaggaagaaaataaacggactagagaatccctggggggggctgctgcctcagatagagtggtcagggaagacctttctttccaagatgatgatatttgagctgagacctgagtgatgagaaaaagccaacctgggaagatttggaagacagaagattccttacagaaggaatggcatgtgcaaaggccatggggcagaagtgagtttggtttggtcaaagattagacacaaggtcatgatgccatggtaccttagcaaacaagtggaaggatgggaaaagatgaggccagacatgtaggaggggccagatcatctgggtcttatggccattttatggaattgggtgtgacacgggggtgacatcagagagtatcaagcagaacactaatatcacctaatttatgtttttaaaacgtggctggatgtggtggctcatgcctgtaattccagtgctttgggggggcatgaggcaggaggatcacttgaggccaggagttcaagaccagcctgggcaacatagtgagatcccatctctacaaacaatttaaaaattagctgggtgtggtggtgcgcacctgtagcctcagctacttgggaggtggaggcgggaggatcacttgatcctgggagtctgaggctgtggt

SEQ ID NO: 67474 - DNA, 1477 bp, Homo sapiens
tctctgaatccactttggaaggggttctcaaatgcggacagcttagatgtgcctaacagctgtcgacatacagtacgatggcctattaaggttatggtttggttatataacaatggtgaaggtgcataggtactagaagttgccgaagctgctgcttcagttaactcaggttgattttttttctccccatgcactgcagcctttatcttacttctgcagaggggtcatttggaaacagagagttatttttttcccccatctgtctccagaatgtgtcatttgttgttttgtcttttagaggtgtgtgatttttttttccccttgtaggaaatggtctgggttttcttataaccatatataacagtcagacagaggtaattcagatgatacttgtgttggctgaaggaggttaggtaataggtattttctgaacattagaaataattatgatccccctcctttttttttttttttttttttttaaacacacatgacccattccaagaactaagagactaaagtaaacctcatttattgagtaggatactgcactccatccaatactgcgtggttaagctggccctttcccaaattctgttaactctcaaaccgtctagagtgggatcctgggatgaataaaatcagtagagaaaagtgaagcttttcctatttggttgttggttacttttgcagcacggcattcatgagctcagacttcatattggcagcactgcagtgcttagagcggcactgcagaacagttaccaggagagaatgttcagctgtgacatactttggttagtagctcaccctggctgtctttgtcctacctgctttgatttccttttctttggaagagccttacttagcctgaggttctctggctctgtttttttttttggtaggaaactataaagtattacagatatttttaaaaaagaatgttttctgctctcaaattgcaggtagtctgttgcctgtgcctaattataccttcactagttggatgattgggaacaaagagtagatagattttgtatgcattttttttccttttttaaaatattggggcagggtcttactctgtcacccaggctagagtgcagtgacactgccagagttcactgtaacctccaactcccaggctcaagagatcctcctgcctcagcttcctaagtagctgggactacaggcttataccaccacaccaggttaatttttaaattttttttgtagagatgggggtctcattatgttgcccaggctggtcttgaacttctggactcaagtgatcctcctgcttcagcctcccaaagtgctgggattacaggcatgagtctgtaacccaaatgcttggcccatatgcattttttaaagtatgcatgactataaaagcctttggccaaatacgtttaaactatatttcaacaaatatatatcacttgcctgttattggtttgtggtaagagttccagct

SEQ ID NO: 67475 - DNA, 1948 bp, Homo sapiens
gatggggaaaaacaagggtgaagtggcagacccgggcttgtaaggggacccaggacggctggggcacggactgggaatgtgcacgtctgcagggcgctgggaggtcccaggatcctggtgccttaagacagagacaggaatccgcatttgatcatctaagactgatagatggtgcgaaggggatcccgaggagacacgattagtggaggaggcaatgaggaaaatggggaaataagggggaaattgctttgcttgtccacaggaaggggcccagggaatgggggagtgaggtgggggtgggggctgtcccaggtttatgatggcactaggtagtcaggggttaaacaatttgggagagctgattgctggttatttttagttgttggagggtcgggaattgtgggctttgtagaacccagggtgggcttttactggttggggggaagcttgtgattgaagaacccagacaccgggagattacactcatcgagcccttagttctcaaagggatttgaggcgctataggagtgaaattggccaaggtcaattaggaagctatatatgtatgcatgtaaaattctttgaggaaatatggtagcactttcatgtagccttcgttgggaggactggaatctaagacatcaggaggaatcttttggttttggtggaacccgcaaagcccatttttactctaaaattttctttgctcaatatcttacttgaatgaatacttttaatgtagtcattcattatgtttagaactgcagcttgtgttttccctcagcctgaggaatgaagaacccttacagctgctgccgcctcctaccaaagccacatcaattcccctcacctcctcagcctagcctctggttgtcatgacctaccttgtttttgcttttttggcagtggcttgttttctgaagccagtgacttatctaggccttctctcctgatcacttgcaacctgaagttccttccccaccatctttctgcctgaggctacaaggggcccttcttaccagggtgtcagggtgggtggctgtggcgaattgattggtcagtttcacttcctctggagggccctcttcagcctttttgtccgtttttatcacagggcctccagtctgcaggtcagagctgaatgagataccaaagtccagggctccctcagaccctgaggggaagtcaggggaagtcgattgagccaagactttggtgtgctcctcacttgccaccccagcccctcaccgtgtttccagtctagttgactattagccaaggcaaacttacatttacaaacaatatgccttgttccttgttttgctatttctttcctttttttctgcctattttctgtgtaatcactttgtgctcctgtggttattttgctctgacctctgggggatagtctccatgaacttaattggttgcctggtttatggtttcatgatttaaagaattttgaatcttccagcccttggatacaccaaaatattgataaaatctgttacagacagggttgaatgttttcgtaaatgtaattgcaaacagttgattcttggctttaatataaaagagacatttctatcttcagtagtcagcaaagccagtgcctaattatggctggtctgcccgctttctaattttcatgtgtgtgtatatgtgcgtgcgtgtgtttttcatagtttttctctgagaccttggtatcctttaggactgcagcattttaaacactggcttgtttacaaacgggtgtcactgtttatgttggtttttatctttgatcatttgtggtatgcagttgtgcaattcctatgtatggaaatattcaaagtcttgaatgagactgaaatggcttggacaatgagttgcatgtgtgaaggagccacaccagcattcatttgtgtttctgtagcagtgtgcaatttcctagttacagttacaagtg

SEQ ID NO: 67476 - DNA, 1862 bp, Homo sapiens
caacctccgtctcccaggttcaggcgattctcctcccttagcctcctgagtagctgggactacaggcacccgccaccacacctggctaatttttgtattattattagaggcggggtttcaccatgttggctgggctggtctcgaactcccaacctcaggtgatctgcccaccctggcctcccaaagtgctgggattaccggcgtgagccaccgcaccatttggttttataagaggatgttcttactcttaggagatgcttgctgattagggtgaagaatcataatgtttgcattctacttcacaagtggtccagcaaacatgcacacatacatagaaacaaagcaaacatgggaaaatactattagttgttgaatacaagaggcagatgtatatgtgttcattgtaatatgtcaactttctgtgtatctacaattttcttaataaaagtttgaggaaaagataaacttctaaacagcatgttacatgtatttttctattctggtttcagtagaattctgggtttcttgagagtactagaatgctctgtatggtaagggtgagaagaaagttcaaacagtaatttatagaatgagaggaataagctttggggatagactaaaaaaaatgttcaacaacagtaactggttgaacagctgttctttctaggccaagaagtctcacagggaaagaaatatcagtttctttttttattaaaaaaatttttttttggctagatgtgtggctcacacctgtaatcccagcactttggaaggctaaggtgggcagattgcttgagctcaggagttcaagaccagcctgggcaacatggtaaaacctcgtctctacaaaaaaatagaaaaaattagccaggcatggtggcatgagcctataatcccagctattcaggtgactgaggtgggaagatgacttgagcccctgaagcagaagttgcagtgagccaagatcacgccactgtactccagcctgggtgagagagccagacgctgtcttagaaaaaaaaaaaaaaagaaagaaaaaagttgtttttgtagagatgggatcttgatatattacccaggctgatctcaaactcctgacctcaagttattctcctgtcctggcctcccaaaatgttgagagttcaagcatgggccaccacacccagccagaagtgccagttaataatttttttttttcttcttcaaaccagcacaacagatttgttttggactgtaaagacaaagagcctgatgtactgttcgtgggagactccatggtgcagttaatgcagcaatatgaggtaaaggtggaagggatgagcgtggttcttggctactcatgtatatccattcattactaacagactttcattctgagctgaacttacttatttgtgactcttagagaagccctaattgaggttataagagaatcaaagctacctaaagggattttcttttctttcttttaacttggccatgttctgatctgaagcattgtttataatgaaacttcctcttctactctggtttccaagaggcttgatgttatatttgtttatatttgctctactcagattgtcaagttattatttgtatcttagtatttcctatttgtatttgctaataacatttatcctagtcatgattcttacttatattttgccattttcctatttcatatatttttgtagtaagctattgccaatcttcttttagggtttaggcattcttccatgggaaatttattagtttttttattttttaatttatttttttgagacagtcccgctccatcgtcgaggctggagtgcagtggcacaatctcaggctcaagagattctcatacctcagcccctgag

SEQ ID NO: 67477 - DNA, 1017 bp, Homo sapiens
taggcatgggccactgtgcccagccccaagggaaatttaaaagatagcttttttttttttttttaagctctagcactctaaatttcttcatctcttgtttctacttcaccctgtttctgtagttcaataagtggaaaggagggtttgttgagttgacagcttaattattaatgttgataccttttagggggcatcagattgagttgtgactcatttcttgagctgagacctaaggctgcattaagaactgagttacacaatggtatcttaaaagcccttaaacagtgtcacaccattacagtgttatctttgaatacagaaaaaggaaattaatgccttgcaacacattgcagtcgaaagattaaactttcccctagttttaggtacactaaatcaagtttttctttttttagatatggcgagagcttttttccccacttcatgcactgaattttggaattgggggagatacaacaagacatgttttgtggagactaaagaatggagaactggagaatattaagcctaaggtgaaatgaaagttacttgtcaatgtcattaatcttaagtctgttttggatagttaaattgtctgaaactgtaaaaaaaaattgcttctttaaagacctatttcactatttttttcgtgcctctttaaggtaaatgatactgtcattgcttgagaatatgccaaaatatataattaagaaactagtgaattgtttgcctattgggttgtatttatagttgttataattactttcttaagttgaaggaagagttttttttttttttgagatggagtcttgctttgtcacccaggctagagtgcagtggtgtgatctcagctcactgcaacctccgcctcctgggttcaagcgattctcctgcctcagcctcccgagtagctgggattacaggcgccgccactgtgcccagctaatttttgtatttttggtagagatggggtttcaccatcttggccaggctggtcttgaactcatgaccttgtgatcc

SEQ ID NO: 67478 - DNA, 1898 bp, Homo sapiens
gaagctctaggaagagatctggctaaagtatttagagtagtgggccagaggacaggtccttgaagaataccaacagttaagggacaggaggaagggaacccatgaaaaaactaagaagaaatggttagctttcattcaaaacagtattttccaatgtttcacaactcaaaggtgtagaaagtgccaaatggagatgttccaggaatatctgaagttataaataataagtagagaaaaataagtgaatcttctaatttaatgttttccactgtgccccagggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattcttttcttggcctttctgtggattatgtcatatataataattatcagaatcattctacttggctttaaaacatgttttctccaatttttttaaggttcataatttagccttttgtttttatgttgcttagattcttatgtatactgaatattttattaacatgtagcatcaggttgaacatgcttgtcattgatatatggaagatgctatagttagaagtgaatttgttctgctttcttaatcttttccatgcttagcagtgaaaaacaggttttgccccagtagagggattctttggagggtattattttttatgctgctgaatatcatgtctataatagacccgtgcatgcagcctttcctccttattccccttcatgcccccctttccccttcattccccccgccaccccgtttttttttttttttttttttttttggttcttgttgacattacaagcttttaacacatttttgacctaggagccctgttgctggaagtatagtctccagccagttactctcatgatagtactgctataaaactcattcttgtgtggtgttctgtgctatagattctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgc

SEQ ID NO: 67479 - DNA, 2110 bp, Homo sapiens
ttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaatttgctggtgtctttctgtctcctttatcatagtttggattctaatgaaaaaaagggatggtttttccctgccttatcataaggaaattggatacttagatgatcctgcttctttactgtggaactgaatgcaccaggctgactcatcacttaccttctcgggcatgtagattggtagggtgggatgagtaggtataaggacccctcagaaagcacaactgccatccttgaagtctactcttttccattagattggaatagttttgcagataggttagtctggattataggctgtggaccacctcatctgaactgggtgaatgtcatcagtcagtataatacagtgttattggccgggctcacgcctgtaatcccagctactcaggaggctgaggtgggagaattgcttgaacccaggaggcggaggttaccgtgagacgagattgcgccattgcactccagcctgggcaacagagcgagactcttgtctcggaaaaaaaaaaaaatacagtgttactacagcatagaggacatgaaccttgagcacggactcatttatcacccttacgtccccagggtaaagcagccgcctccaaatactctatctcagagatagtgagactagaacaagggtcggttaactggtcgatcgggacctatcctgatgacacaccagcaactaccaggccagcaatattacagtgagttggtatgccggtatgatgttccttggcagctaaaagtttctgtgatctttgtatcatttgctttatcactgttcacctcagtggtatactgttggattaaaatgatttgctgctttaggaggaaaaatttggaggtaaattgagacattttgtttttctagctgcccttcccccctccccagtatctcatcacaccaagttcctctccacccacactcctggaggcctttgtcagctgcttgcaggccacacagcagcagtgaaagcagcctggatcttgaagctttgctttactgtatgtggattaccccatgtgaacctcttaaatggcccagaacaagtggaagtg

SEQ ID NO: 67480 - DNA, 1010 bp, Homo sapiens
ccaggctcccggcaaccagccgccctccttctcacggccctggcccggggctccagggtctcaggtcgtactcagcccctcgcgagctgggaccccttcccgtagccagcatcccctccctccccgccccctcccggccgccccctcccctgcggggaccctgggagcctcttcggggctcttgggaggggacatttcctaatctcaggccggggttaaagttctggtcctggtgagatgctggaagctgcggccgcagccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacagggtgagggctgggggcttaggggccagaggcgagtggggaagccgacgagggctaggcgattctgccgccccgctacccttttgggaggccccaggaacgagctgtcctgctaggttcccagttcccagaaccacactggagcctcttgaccagtcctccttcctttgccaccaatgtttctctgaagctccagctgggcagtttttgaagttggctcattcccatcttctcttccgcccccattcttccatcagttgtggtctgagcacacatggcttgctctctaccctaaaccccagaatctgacagctctgtggggtctcggtgggagaggaaacaggcttattactgggcttgcccagaaaacctcaggggaatgagactggcccagaactgaaaagctctgtgcaggcaagttacatctcagactccccagggagatgaatgcagggcttcccagccctcttcctgcctgggagagccagc

SEQ ID NO: 67481 - DNA, 1144 bp, Homo sapiens
ccagccgggagcttgtgcacctcgcagggaggtggtggagaccagacggggcgaggtggggcctcgctcctctggaggggcaggccggctgggacagtgctcacatcctatctccctgcttcgggccataggtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggtctgcagggtagagtgaggggaccacgggggctggttcttccccaggctccgggggtgactggtgggggctcttctctgccctgcaggactggggagcagttcagcttcaataccacagcagcacagccccaggtaacatctccctgttgattgctcgagaggagaaatgggggagcttgaatatgagaatgggagtggccagcggtctttgcttggccttttgaattggctgttttctccatggagggctctctggaaacaggagctctggccctgacatggtgagggacagacagcatgggactgtacagagacatggagtctggttgcctctctggcattctgctgagtgccctgctgaggttgaagggaatggtatacagagaaaggggctgctgtgatcaaggcctgtctcctcggagagcctccactgcccacccctcagaggattctgggtcctcgcttataggggactattcccttctagaggggccaagagagcatcctcatgagatggggctctcccttccttcctgcaccctcagtacttcaagtatgagttccctgaaggcgtggactcggtaattgtcaaggtgacctccaacaaggccttcccctgctcagtcatctccattcaggatgtgctggtgagttgcctgcccttttgctcttccccagcaggcagcagggctgctaaagagaggggcaggccaggttcccatccatctgcctctcccgcccctctgcagtgtcctgtctatgacctggacaacaacgtagccttcatcggcatgtaccagacgatgaccaagaaggcggccatcaccgtacaggtaggaaatgcat

SEQ ID NO: 67482 - DNA, 1047 bp, Homo sapiens
catgagccaccgtgcccagccagagggtgcctctctctctctctcttttttttttttttttccgagatggagtcttgctctgttgcccaggctggagtgcagtggcgcaatctcggcttactgcaagctccacctcccaggttcacgccattctcctgcctcagcctaccgagtagctgggactacaggtgcccgccaccacgcccggctaattttttgtatttttagtagagaaggagtttcaccgtgttagccaggatggtctcaatctcctgacctcgtgatccacctgccccggctcccaaagtgctgagattacaggcgtgagccaccgcgcccggccagggtgcctctcttacatggattatttattcagcaaatatttatggagcacctcctatatgccaggtggtatgctaaggcagcagtccttggtgggggcggggtcctgtctagaggaacaggaggcagttaagagctgtggtgagcaaggaacaggtcactgtggaaatacaggacagagaaagcttcctagaggacacagtccctgagctgtggtttgagggttaagtcaaggtggaatttttgagaggccaggcacggtggctcacgcctataatcccagaactttgggaggctgaggcagggaaattgcttgaagccaggaattcaagaccagcctgagcaacatagcgagacccaatctctataaaaaataaaaaaatgagccaggcgtggtggcacacatctgtagtcccagctactcaggaggctgaggtggaaggatggagcctaggagttggaggctgcagtgagctatgatcgtgccactgcactccagcatgggtaacagagtgagcccgtctcaaaaaaaaaaaaaaaaaaaaaaaagtagaagagaaagttctagcccagggagcaacatgagcaaaaataggagtgtgtcagagtttggtgtattagaggaactgccagttgttcatactggctaggcagggccttacatttgaggggagaagggtgagagattgagctgggtggaggagg

SEQ ID NO: 67483 - DNA, 1364 bp, Homo sapiens
atgcctgtaatctcagctactcagggggctgaggcaggagaattgcttgagcccaggaagcggaggttgcagtgagccgagatcccaccattgcacgccagcctgggcgacagagtgagactccgtctccaaaaaaataaaagggagtccctgatctcagggtgctcacagactaagacacagaccaagttgtccctgttttcaggagatgtcagactctgggtgacagccagtggggtggcagtgtggtgtggcaggtacaactaaggaactgaagttcaagtgccaccctgccaccagctcacaccatggccgtggtggggcaccagggctctctcttcctctgggattgttggggccaggagttctctgctggggcttggtggccatttctgcagctcccttccgtgtccctcatcctagacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtgagggcctgacctgctctgctcagcctgtatgataggaaaggtgcacgtgcgttcagacacgtagtgcacaccctccgccacctcctgcatgagagattcctgctccttccctgagatgccttcctgggcccctctcagagtcccagcctggctgagcagccagccccaggaagggtgggccatccgagccacttccctctccaccctcaccgctgcccttggtggcctcccgacaggtctttggcaaagggaacacggcgttctggatcgtcttctccatcattcacatcatcgccaccctgctcctcagcacgcagctctattacatgggccggtggaaactgggtaagggcacgcccggggcagggcctgggggaggggtctggggggccttgggaacccggacgcacgggagacgctcaggttctgtcttgggggccctggagtcactgggtgaggaattagatcaggcctgggctcctcagctggcacatcccaggggtccagcaaaggagggtgccccgtgcctgtcagcaccactcccttctcttcgcagactcggggatcttccgccgcatcctccacgtgctctacacagactgcatccggcagtgcagcgggccgctctacgtggtacctgcctggttcccctgctccattctccacatctcctttcttccctctgatgggggagtggggctgggctgaggacccaggggagagtggggaccagctggctgggccttcttccaccaccctccctgcccctgccctcagtccctgtgtccctgcttccctcca

SEQ ID NO: 67484 - DNA, 1973 bp, Homo sapiens
tcgggtccttcctggtaagcgggcctcccggccgagccgggtgggtacgtgaaggtagcagctgcctccttctctgtggctgatctggcgtccacaccccaggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagttcttggggcccttgtttgcactccctctgggtggagctgttgaggatgaggggagaggcggaggtcttccatttccccattcttcaagccatggccctactgggaactgcaattccttgattctcccgtttttcctgtccctccagcaacagcattaattcagtaaacatttaccggggcactgtgctggacagaggccagttcctggaaaagcctttcccacgccatcccactgcagacatccctccttacctccccaggaacagcagtctctgcccacctggccccgcccaccagactgaggctcacttcacctctgacctgagcggcccccagctcaccaagccacaggcccaagcagtgctccctgatgcggcgtttataatccgctcagcgtgcaggccgaggcaggagggtgatgaaagctggg

SEQ ID NO: 67485 - DNA, 1021 bp, Homo sapiens
taaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttg

SEQ ID NO: 67486 - DNA, 1040 bp, Homo sapiens
ggagttcaagaccagcctgggcaacaaagtgagaccctgtctctacaaaaaatttaaagattagctgagcatggtggtacatgcctgtagtcccagctactcaggagactgaggtgggaggatcacttgaacccaggaagtcaaggctgcagtgagctgtgatcatgccactgcactccagcttggataacagagtgagaccctgtctccaaaaaaaaaaagaaagaaaaagaaaacaagtcatggagctagtaagtgcccaagagaacaagaataaacctagatccgtgggactccaagcctgtgcgcgctccatgcttgctttttccaccacaccacgttaacacaatttcctccttccatgagaccccaggggaaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggcttgtcatcagggatgtcggtgagtctcgtgccctcacaccaggccctacctttcctgcttgttatctggtccctctgcatctcagagtccccacagaaagtgtcccgtgtgcaatatatagggttgccattggaccaagagagttgatgccaagagtgtgcccatccgtgaaatgggcattgctctctgcaactgttcatttatactacctctcatattccctggaggagtgacccatccatctttcctcaggatagcaacaaaaagtccttgtcgaaaccacatttcaagtccttttacgtataaccatccttcggccagccccggtaggcaggtaagggcaggactcatttcaccattttttttaaactggcccagaggtttgaggtgacttgtggaaggtcaccatatcagtgaaggccacaatatccatgaattgtgaatatcttta

SEQ ID NO: 67487 - DNA, 1013 bp, Homo sapiens
atcgcttgaacccagaaggcagaggttgcagtgagccaagatcatgccactgcactccagcctggcaacagagagagactctgtctcaaaaaaaaaaaaaaaaagaatcgttctcattacagcctaatttcttaatagtccccagttgagtcttcctcttcagtagttttttgtttttgtttttgttttaataattgtagatttacaggaggtttcaaagaaatgtacaagagaagtcccgtgcacccttctcccaatcttaatgtttcacacaattaaagtataatatcaaaaccaagaaattgacattggtacaatccatagagcttatttggagttcaccagatacacatgctgtcaatatttgtgtatgcgcgtgtgtagctgtatgcaattgtatcacatgtagccttgcataactaccaccacaaccaagatccagaacaattccattatcacaagactcctttgtgttacccctttctggccacacccatcccctcccctgtccctggcccctggcacccatttatctgttatgtatcactgcaggtacttcaattaacatcacctaaatggaattgtgtgctacgcatcctttttctttttttttttttctttgagacagggtcttgttctgttgcccaggctggagtgtggtagcatgagcatggctcactgcaatctccacctcccaggctcaagcgatcctcccacctcaccctccccggtagtgggaccacaggtgcacaccaccacacctggctatatgcttcttttgagattgcttttttcactcacataatttgcttgaaatttatccaccagcattttttaaaaattaactgtgcatcatcttcagtgagatgtgtgcatttcgtctttgttcatgccttttccactgcctagaatgccctctaccaaccctgtctaccgatctgtattcatttccttcagtgtgtctcactgctgtgtgcctaaacccatctgacttatttctcttcccttatcaa

SEQ ID NO: 67488 - DNA, 1132 bp, Homo sapiens
cagcttgccttggggaatccattcccagtagccatagtgggagagcgtggactggatcagccagcagggcaagcagggaaaccagagtcagattgttgagactacactggcaatgcaagagactaaccaggacctctgtcctttcagtatgaggatcgccgtgcagagtgggtcaccaacgaggcaggcttcagccatagccaccagcacggtttcggcctcctcaacgcctggaggctcgtgaatgcagccaaggtgaacaggtgttggcagggcagggtgccctgtgtggagtgaccaagggtcggagctgaatgccccaaactgcctgggatatcataggtgcctagtaaatgttcattcagttcattgatttaacaacttcaaccttcatcccagctgatatccattttacaaatgagaaagcaggctcaatgctatcactgaagtttccaaactactaatagagtaaatgggacctgagtatgtgtgggactcaggatgctctggttcccctcctccaccctggacacagctgtttcctctggttccttagctgggggctgtacggagcattccagcgagcaagcaggagctgagggctgaaggaagatgatgaggagtggaaaaataaagacagctaaaccttcaagatcgtattgacaagggcgtgtgtgtttgtgagaatgtgggtgtgatcattcttgtttgttgatttgccatcccctcctttcctttcatagatctggacatctgtcccttacttagcatcctacgtcagtcccgtgttaaaagaaaacaaggcgattccgcagtccccccgttccctggaggtcctgtggaatggtaagtaatcagcacaaagggggttaatcttaggcctgaggtttggggccgggtgacaaggaagttaaactcgtcctccctgccagattctaccccctttcggagctgagctccagccaaacctgtggagttttctttgaccattttaggacatgttactgcttctgagttggctcccccagctgcttaaacaagacctttctcctgggttcctagtagtgaaaaggagcagcagagcaactgaggaggagggcgggtgggaggcatgggactggggcttggggag

SEQ ID NO: 67489 - DNA, 1031 bp, Homo sapiens
tgtcttaaggcatgccacccttggagtagtagactcggggactctgaatacatcttgggaatgcttttatcttagaaatttggatttaggacgaatatacatatttttagaaactaagtgtcacatggggccaaacatggtggctcactcctgtaatcccagcactttgggaggccaaggcggatggatcacttgaggtcaggagttcaagaccagcctggccaacatggtgaaaccctgtctctactaaaaatacaaaaattagcctggtgtggtggcgggcatctgtaatcccagctacttgggaggctgaggcaggagaatcgcttgaaacaaggaggcggaggttacagtgagccaagattgcaccactgtactccagcctgggtgacagaacaagactccttctcaaaaaaaaaaaagaaactaagtgtcacatggattaaacaactttttcacactcaaggaaatgcacaaacaacttctttgcagtgtcttcctttggtaaaatttgggcttttgctaatttctgtggacttaaaaaaaactcctaattccattgcccttcagctcttaggtaaatactgtgagttctggtcatgtgcatcttcaggaggaaagctagtctggttgtcgtttttatgggatgagtgggaagaggagtgggggaatgtctcatgtcaacaccagagagagctctttctctggagctataattggagccatagcaaatgaaattcgagcagggtcatggagcttctctaacctgtggaacccatttaaagaatttgaagacgatcgcctacacccagctgggcttagcgccatcccagcaggtttaaggcaggcctctagaccatcttcctagagctccctgcctgtccctgttgcccgcaaccatatagtgtgggcataggaggctctaggcaggagctgggctggagccaggtggtatcaaatttctccagtggctgagtcgggagatctctctggggccattgggaattaggctgctttgtcttcctgctggg

SEQ ID NO: 67490 - DNA, 1089 bp, Homo sapiens
ctatctgccctatgcgctcttcagtgttccgggggggaatacgtgtgatgctgttaaaataaaagcaagaatgcaaactaacccgatgttcatccccacctcccaagtattttgattttcttttctcctcataaggtcataagtttgctctgcggcataaaagatgaccttttgatttttaaaaaaggcgtccgtcccagttcccttacttgtgttaccatgttttttaccttgactttttcacgctagagaacccaggattcttttttgcaccactagtcactctgaagagtctgttctttgctcagttagtgggtatcaggcctttcccatctgtggggagcacgctgacagtaaaatatgcaccctggattgcccagtattgcattacttgttgacttacaggcagacacctccaaaaacttcccttaaattaatggagaatgctttgaatgtaacagccataaagtgatttaaaaacatgagatctgattgatactaggccgaaaagtacgtcttttattaaaaatgatagcagacaaggtaggcctgggaccacttggaagatcctggcagactaagatgtattgtttgaaatgactacatttctgccaaaagtgaaaataagatctttgcacagactcctagatatttatgtaaatacagtgactcctgaggattgctgcccactaggacactaggactttgcatacaatgtctcttttagtactcttaagtattttctcccggagcccaggtttttgtgtttctttactgcgacagctctgttgtgtggacattctgaggggggagagatacatttgttttaaactttggaaacttgtagcctgtaatttgtttctgaatgtacagagcataatggcagcgtctgaggttgctggtgttgtggccaatgcccccagtcctccggaatcttctagtttatgtgcttccaaatcagacgaaggtctcccagatggtctaaggtaatgtgtggactcctgactgggaagattcatttgggtaaagggtttttgagatggtcttgtgtagctggtctttctttttggctctgatggcactgcacta

SEQ ID NO: 67491 - DNA, 1134 bp, Homo sapiens
tccttgttaattctctgagtcacatcttaagaagtacagtgtatcctgccttctagtgacgggtgtgctttgttgtaggagaaagtatgggcacaacagactgtagagggcagacgtctcatctcagacttgaggctttctctcagtcagtcattgggtcttgtttgggttattttgtgggaccgatgattaatgcagcgtggatgttggtgtccgtttgccagaactacattgcttagcttgcttggaagctggtaaggggaaagagtaaaaagttagttacctgtggcggaattctaggtgttagtgattctgcctcttttaaagtgtctctgaacgattctaaatataacttttttcctttatagactgactttaagacagctgattcagaggtaaacacagatcaagatattgaaaagaatttggtaagtatttaaactgtccttgttatatgaagccattatcaaatagaagatctagaggcatatcatctcagttggaaaaggtgcaggagtccctttcataaaattcctgacagatggtcaggtgacttttccttgatcacttccaaagatgggaagcttactacctcacaaagcaaccagttacgtttaaaaaaaaaaatagctcttattggccaggcacagtggctcacacccataatcctaacattttgggaagccgaagtgggtggatcgcttgagccctggagtttgagaccagcctgggcaacacagtgaaacaccatgtctacaaaaaatacaaaaattagccaggtgtggtggtgcatgcctatagtcctagctactcaggagtcctagctactcaggagacaggtgggaggatcacctgttcacctgagccaaggaggtcgaggctgtgtgagccgtgattgtgcgattgtactgcagcctgggtgacagagtgagaccctgtctcaaaaaaaattaaaaaaaaaaaaaaaaaaaaaggccgggcacagtggctcacgcctgtaatcccagcactttgggaggccaaggcaggtggatcacctgaggttgagagtttgagaccaagctggccaacgtggtgaaaccccatctctactaaaaatacaaaaattagccgggcgtggtggtgtgtgcctgt

SEQ ID NO: 67492 - DNA, 1076 bp, Homo sapiens
ccttttgttttcctgataatggatggtgctgtctttctagagagcctgagtcagttcagcagtaaaaataatcctttttttttttaggaccaatttaatagtcatatccagttagtgaggaacggagccaagctgagcagccttcctcaaatccctactcccactttacctccacccccatcagaggtaagagagtggctttggggggaagttcacctttctgtgttggtagcagcagcagagtcttctgcgtgttctttttatgaagatattgggaccatccctattcagtgcaagagttgttcattgatgtcttctccagtttcctaaactttctttttcttcctttctctctcgtcctctacctcttctcctctgcagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataagtaagtaccttcaaggactgattcagatgtctctatcagagaaatgcttatgggttaaaacagaggaggttacatgggtgttccccgtgggtatagcataggctttctctccctcaacattttttttcctcagggcccagatgaccaacattcttcagcagatcaagacagcacgtaccaccatggcaggcctgaccatggaggaacttatccagttggttgctgcacgactggcagaacatgagcgggtggcagcaagtactcaggtgagaaaagccacttgggagagaacttaggcatgttgagggctggggaaga

SEQ ID NO: 67493 - DNA, 1085 bp, Homo sapiens
ctctgacaatgtttctacctacagccacttggtcgcatccgggccttgttccctgctccactggcccaaatcagtaccccaatgttcttgccttctgcccaagtttcatatcctggaaggtcttcacatgtaagactctttttctttgaacactgtgatatggagaagctggaggtgaggaaggagtgggtttacaggtggagtgcaggaagaaaccatcagttgggttatttgcagccctactgggaaaatgcaaatattttaggcaagaatctatatttggatttttgtttcttttgatataaatctttttgctgcatggaattatgggcataaaaggcaaggagacccagaggttccttaccttttgatcatgccgcctctgttctacaggctccagccacctgtaagctatgtctaatgtgccagaaactcgtccagcccagtgagctgcatccaatggcgtgtacccatgtattgcacaaggaggtaggtgttacagaccttcctcattttctacactttttcttctgacagctaaaataatttttctttctcattttctactcttttttttccctgacagctaaaataacttttcttttactgtgttggtgctcatcattaatatcttttttgttttgttttgttttgttttagacagagtctcgctctgttgcccaggctggagtgcagtggtgtgatctcagctcaccgcaacctccacctctcaggttcaagtgattctcctgcctcagcctcctgagtagctgggactacaggcgcctgccaacatgcctggctaatttttgtatttttagtagagacagggtttcaccatattggccaggctggtctcgaactcctgaccttgtgatccgcccatctcagcctcccaaagtgttgggagtacaggcgtgagccaccgtgcccagccttttttttgttttgttttttgagatagggtttctttctgttgcccagactggaatgcagtggcacgattatagctcactatagcctcaatcccctaggctcaaggtgcttcagtctcttgagtagctgagattacaggcacatgccat

SEQ ID NO: 67494 - DNA, 1270 bp, Homo sapiens
tcttttagggtaagagccattgaatagcccttcttggggccaggcgcggtggctcacacctgtaatcccagcactttgggaggctgaggcaggcagatcacttgaggccaggagttcgagaccagcctggccaacaaagtgaaaccccatccctactaaaaatacaaaaattagccaggaacggtggtgaacgcctgtaatcccagctactcgggaggctgaggcaggagaatagcttgaacccaggaagcagaggttccagtgagctgagatcacaccactgcacgccagcctgggcaatagagtgagactgggtctcaaaaaaagaaaaaagaacagcaacaaaaaaagcccctcttgtacctcagtgtaagaacttttctgacttaggccttgttgaaccttattggcattctctccttccttccctttgtttttccagataaacctgaggtgtgtctttctttctttccagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagtaaccctagtagtttgacttcttattgaatattttactgtgttaacgctcattatttatacagacattaggtttacagaatattctgttttacatcaccaaaattcacagtccgagaataacaacataaccaggtcccaattcctccatgtaccccacaagcttctgtccaccctattttctggacagaaattag

SEQ ID NO: 67495 - DNA, 1377 bp, Homo sapiens
tttttgaagcaagaaagttagggggggacatatttcctgtcctgggaaaaatggagaccaaagtgatattaagaaagtagtttggatttcaaatttataaatcacttgctctgtgggtagctatcaggaactagatcattttccacctctgcttattgtacttcttaattttaggttttatacctgggaaagctgtgactctattagagctttgaatcttttcctatccttttatctttactcctacagggaatggcctcagctcccttctcttttagaattaaacaagtaaaaactaagagttaactttttaaaaaaactgactccagggaaaggacattattatattaccaatagctgatttttttttccattctgggacctaaaatgcttacaggtactagcagtacatgtcggatagcaaagacttttcctttcagacccaactaaatgatctcctttctgcctttgatactcttttccttctttgtctttcatccttgcctatcacctcacagatggattcttcctcatttctcttgcctcacttgcccaggtttattgactagcgtcagtttaaggagctggacttcctgggacctccttggcatcttgtagggtgattggagtggcctgagtactcagctcttcagaggtcaggtgacccactttctttggttaatgaaatgttactgtctccaggttagtagctgtcatgaacaggaaaggtggcaaaatggaagaccagttctattgttctttttgtttaggggattcgttttttatcttgtaatcttaagatttcctctcccctcaactttacagcagccttaggccacctgccgtatttttcagtatcccctgcaaatttagaaattgaaaatgagtgtaaagcatattgtttcttttccaaaatcctttgaagccaaaggagtaaagaaagaaaaaaggaaggggtgaggagggggcttaactgcttcccagtaaagaccctggaaagcccactcttgcaggaggataagtgttttggagagttgtgcatgggagcgagcgcctcagtgttactctttcttgttcaggatcagtcagaaagcaacacaagtgttggcgacccctgttctcccttctccctctgtccactggcctgcaatgataaaagacatgcagaccaatgggaaaggccccaaatgcagtgagtggagaatgggacagtcatttttcaggagcagaatttaaaaatacagatgtataatacatatttttacaagcaagaagctgttgttaagacttttttttacacttagagtttataattttggggcaggaaggaagtaactgtaaaaagaaaaacaagtgcaagttttctttaaaaaaata

SEQ ID NO: 67496 - DNA, 1048 bp, Homo sapiens
aacctctgttggaaacccagagcagcaagagttacctgggtaccttgggaagctcttgatgcaagggtagcagactgagtctatagtgaccctgtcagctgccacatggtgaggctgaatgctacttcagaaaggtggcagggttttgcagttggatttcagcagcagaaagttaagtttactagatttggcttttggtcaagggggtggcttttggtcaactcagaactactgacttttagttatcactcctaccagctgggtatacaaggaagggctgctgctcccagtgacttgggaagggagacaggcctctacctggtgctggcttcccagcctgctcctaaatatctcctgggaaggagattagataacttctgcatgggctaatttcaaggcctcactatcaggaagttctttttgttaactcctctatgacaatgagagctgtccattcacatttgccctctccccagtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggtgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagt

SEQ ID NO: 67497 - DNA, 1005 bp, Homo sapiens
gttgcccaggctggagtgcagtggcgcaatcatggctcaccgcaacctccaccgtcctgagttaaagtgattctcctgtctcagccccctgagtagctaggattacaggcgtgcgccaccacacccagctaatttttgtacttttagtagagatgggatttcaccctgttggtcaggctggtcttgaactcctgacctagtgatctgcccaccttggcctcccaaagtgctgggattacaggcgtgagccaccacgcctggctaggggaagagtgttttaagagctctgagtagaagggtctaagtgcagacatcttggctgttgctgaagaatgtgactctcaccgcctccctctgacactgtaccatctcttttacccccatccttagtccactcacggaggaggctgccttgatggatttgactgcagcttcaaacactttcttgggcaaacgaaggttggtggtgccactgtccacaatgctcttgtcatagttgtactaagagggaaaagagagagttaaaagagtcaaaaggtttttgatgctgggctctgggcagtagggggttactgctggggccccagctgggttggcatcttggctttggcacctcctaagtgtacctgcttggacaagttaacctctgtgcctcagttccttcatctctaaagtgaggataaaaatagcacctacctcaaagggttattgtaaggattaaataaatcagcaatgtaaagcacttagaatcgtgcccagcagagagaaggcacttggtaaatgtttattcttgttaatcttgggtgggcaggtagtctccaaacttgaaaataaaaataccttgtttagtgcttttaacttttcttttcttttttttttttttttttttttttttgagatggagtattagctctgtcacccaggctggagtacagtggcgtgatctcggctcactctaacctctgcctcctggattcaaaccattcttttgcctcagcctcccaa

SEQ ID NO: 67498 - DNA, 1049 bp, Homo sapiens
cagccctccatgtggggtgctgtggctgacctctgtgtgcatctgccgcctctgtggggcagtccgggcccgggcagccctgtggttctgtgtatgctggtgcgtgtcaccttgaatctgatcctgcacatctgtgagccacctccggatctgtgtctgggaagtctgtccttgggagggtctgtgaaggtgggagtgtgtttggggtgggcggaggggacagccacactttcctgaacttctcagacagctggatctgggagaaacacaaacccccacctcccaattactttacagaagccagccttcctaggtgcgtgctccccagccctacctctcagctagtcgaaagcctggtcttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaa

SEQ ID NO: 67499 - DNA, 1461 bp, Homo sapiens
caaaagttcgctggtgagtcagtggatgcctcctcccagagaggccagggctgaaatctggagggatgttgggaacctctaggtgtctgcagctgggaggttgaagacaacagtcagaatatggtaaattcttgatagtatatcatctaaactttgcctgtcttctggttgatttttctttcagcttctggtattctggaagttgttgccatgtctacacatttcctttctccccacttgggaagtgcatgttacctaataggattgatgagagagagtgctcttctgagaatggttttttgcagtagtagtagcagtaatggcatctgctgctctggagagtggggactgaaagcagttggcagaggccagtgagctgagtgaagtgtcctttctctttattcagagtcaggcctccctagtgtgggttccttttttgtcttaaagtggtgtgaattcctagatgtcagatgtagccataatttagttgtcaaaacaccagtgcgttcaagatttgaaagaaaagccttgggctttatctactcatctagattgttgccagtgtcttcagtgagtggtgggtaactgaagtttaactgcaatgtgatttccttgttgttgttttttttgagacagagtctcactctgtcacccaggctggagtacagtggcgtgatctcagctcactgcaaccactgcctttcaggctcaagcaattctcctgcctcagcctcctgagtagttgggattacaggcatccgccaccacgcctggctaatttttgtatttttagtagagttggggtttcaccatgttggccaggctggtctcaaactcctgacctcaagtgatccacccgcctcagcctcccaaagtgctgggattactggtatgagctaccacgcccagcctgatttccttggttataagtagcttttgtatttcagttcaaagtgttcatattaattattgttttatttgtccctttagtacaactgagtctaggaggtggagttattgcccacatgatttaggtggagcaactaagacctggagccataccaaagtgaggcccaggctctcccagaacgctgtggtggtccctttccccaggcctggggcaggtggggcatgctgaagagagggagggacataggaactcagctcagccagtggggagcactgggaacatcgtttcaaccctcttcagttgtccagttgttttgctcttttgtttatagtttttgtttccctccagagccttgtgcttcctcttgtccaagctccacagacacttcttttttccctcccctccctgacatgttactcacggttctgagaaacatggtaacaagcccattcctccagatggagaaaagagggcagataatttccagctaggctggattttccaatgtcatgtgtttgaatggcaaaaggtggccacagggcttttcatgg

SEQ ID NO: 67500 - DNA, 1005 bp, Homo sapiens
cacaatatagtaccccgaggtactgaacttcccaggttccatggagcaaggtttgcaaaccattgatctagtcgaacctcctctttgtagataaggaaactggagcctagaaaacaacatattttcagcccaagggagtttttatcttttcttccctcttcagtttgtgttttacttcattttttagttttttaattttttaaattattatttttttttgctattgattttatttatttatttatttatttatttattatttattatactttaagttttagggtttaaatagagggtgggtttttgctgagggcttgcccagggctgaggtagcaagtgtaaatcagaagtgctttgtcttcgttttctctgcatgtttatatacccatctaggaaacgcagcctgaggagggacttctgcctccttcatcctttctctgcagcttgtctcctccgtcagcacctgggcttgctgatctggacctagatcaagagatgcaggctataagtgagggatcctataacaaaggaaagagcccaggcatgctgggtgacactccctggcgtttcatgggtgcccttcccagaaagctgcagccactctccaaaggccaaccttcccaaatccaccaggtctttgctgacatggagaaaatcttaggcagggccccagcccaatgcaggagagaattaggtgatcagcagggtctggagaaactccagaaggcgacagagaaaatctacctggggttttcagatcctgaaacagaagagctggaaatgagaagcaggcagcagaaactgggcactccagcccctcagaacactgggcttctccaaaatatgcaggatgtggtagaaagcaggaaccaggcctctgtccactcaaagctttctgaagccatcaaaggcctgccactgaaaggggagcagcacagccacagcttagccaaactgagccccactggccctggaggggacaagggccaaagccccattcccatg

SEQ ID NO: 67501 - DNA, 2163 bp, Homo sapiens
ctgcttcagtctcccaaagtcctgggattacaggtgtgaactgccgtgcctgggctgagagctaatattcttatgagagacggaggccagaacctttctctgccatccagtgagctgcttctgctctttgcctcctagggtccccagaaaaccacatggataacctgtgtcaggcttgtgtagaccatatttgtgacgtcactcttgagttcacttcctcctctactgggatttatcaaatggctgaccttgccctatcattctacctttgtccctttaaagagtcactatattcttcattcagaagtcaagttggatcagagaccatggggatcaatctgaatttctccagctattcttttgttgttgcccagctgtggctttatccagttgttccctctgcttcctaattgctggcttgcactggttctctgttagctttaataactactgtagcactataaatatcggataagctgcagattatcctgaaagttttaattagcccagtggcagtaagtctatctgctctgaaggacaactccacgcatagccccatactcagagttaatggccatctatagaagatgatcagctaggagccaggaatgtataatttctccactaatcgctgatttggtcaaggcctgggagaacaaagccctcagcatgcttgtctccctccctcaagcccccagcatgttagcaaattagccagccatgttaggagtctgtatttccataaatacagtgtggggataattttgcttgctgatacataggctggtttgaagggctgaaaccaggaggggcatgcctggtttgcctagttaaccttgaagaagctttcttgggctcttcccctcccccggccttttttttttttttttttaagagaccagagttttgctctgttgtccatgctggagttcaatggtgtgatcgtagctcattgcagccttgagctcctgggcttaagcaatcctcccgagtagctgggactacagatgtgtaccactatacccagctaattaaaaattatttttttgtagacatggggtcttactgtgttgcccagactggtcttgtacccctggcctaaaagtgatcctcctgccttggcttccgaaagtactggggttataggtgtcagggaccatgtatgtcctaggctcttctttctgccacagccagagctggtataaagtactgtcttagagatagccttgggttccaatcccatctctgcccctcactggctctgtgactttgggcagggttcttttttttttttttgagacagggtctcactctgtaacccaggctggagtgaaatggcatgatgtcacctcactgcaacctctatctcccaggttcaagtgattctcctgccttagcctcctcagtagctgggattacaggcacctgccaccatgcccggctaatttttgtattttagtagagacagggttttaccatattggtcaggctggtcttgaattcctgaccttaggtaatccgcctgcctcagcctctcaaagtgctgggattacaggcgtgagccaccacgcccagcctgggcagggttcttgacctcaccaacctccgtttgctcgtatggggactgtggataatggcagagccagtctcaggtggttgtgagagtaaaataagacattgtacggaaggtgtttagccagtgcactgctggctggtgttacgattatcagctcgttttctccttcacaaacatgttctacaacaggccagatgattgtggacctgcagaagctcaggagtgtctctcaccttactttcctgatgagcatctgatgcagaaatgggccctgctgggaacccacccaccggtctggcccctaggctgaggctacaggtgagaagatggatcttctgaacctcagcctgaccgcctctgggtttccttttctctcttcagtctttgtgggattagggaggattggaatttttgtgtcatcttagacattttaagtttgagaaatgaattttgaaggggtctttgtaaattgtcaccagattgccatccttgcttctgataagcctaaattattgtaatgtgaatccctgtgatggtggcaattttataatgctggtgtagccctgggccactcacaaaggccccta

SEQ ID NO: 67502 - DNA, 1041 bp, Homo sapiens
gcgtgcaggatttagatgttttatttttatatctgtctccgacactcccagagccacctggtttcttgagttgtaacaagatgttttctgttgcacaggccttgggttcctcattagccccagttcatgttcctcttgggggcctggctcctttacgaggtcttgtggataccccaccctctgctcttcgtggatctcaaagcgtgagcctggggagctcagtggagtctggacgtcagcttggagaactcatgctggtaagtacgttctcttgcgttcagtgtctgtagttcctgtggggcctcccgtgtgccataccaggaactatggcctaggggtgagaaatagacagaatcggtggagtcctcagagttcgtaatccagttgggaaaatgtaattcgcacctgtatgaatgtggactctgggctgtggaggatagacccatgctgtagggacatcagtgctgatttccaagtctctgcagccaaggcagtaggagtaggcaaagggagtcattgatgtgagctgcagtcgccaggtcagcttcatggacatggtggcacttgatctgggagacattgacatagagagtggggaggagcattctaaaggtcattccaaaggtcttccaagtgagtcctttgactgtccttctctattttgaagccttcacagggtctcaagacctctgcttatacaaagggtctcttgggctccatatatgaggacaagactgctctcagcctcttgggtttaggagaagaaaccaatgaggaggatgaggaggaaagtgacaaccaggtaatgatgaagtcctctccctggcctggaaaccctctgtgccatattttttccttttgaaaatgtttttgctgtgatagaaaaaatatgtaacataaaatttgcccttttaaccattttaaagttaaaattcagtggtattaattaccttcacaatgtgtgcacccaacaccactatccatttctttttttttctgcactcccccgccgccactattcatttctagaacttgttcatc

SEQ ID NO: 67503 - DNA, 1434 bp, Homo sapiens
agttccctgaaatgacaactttattttcttctccaccaccagtaagacctatattgatcaaaggagatgctcaggctttgtgcctagaaggttgaccatgtataggactaggggtgtcagaggacttatttgcttgtggaggaagaagacaatctctatgagaatgagcaagttgaggctggagattctgccctattcatttctgtatggccaggaagcaactagcctgctgcctctgaaacataggaagtgcttgggtatgttttgttcaacaatcgagagagtgaacttgtgaatgagtgaatgagccacctcgggacagagagagtgtccaggcaggttgtgtcatatttttttcttcacttggcttttccagtttctggatagagtgggtacttggtccctgctgtcagctggtggatggaagatcctgatgtggattgatcatgatttactttgaccttgggcttgttaacatttacttcataatggattgtaaatgtcaacaaaaaaggctttttcttctttgaaaggtggatttctttctttctttctttcttttttttagatgaagtctctcactcttgtcccccaggctgtagtgcaatggcatgatcttggctcactgcagcctccacctcctgggctcaagggattctcctgccttagcctcctgagtagctgggattacaggcgcccgccaccatgcctggctaatttttgtatttttagtagatacggggtttcaccatgttggccaggctggtctcgaactcctgacctcaggtgatctgcacgccacggcttcccaaggtgctgggattacaggtgtgagccatcgtgcccagcctgaagggtggatttctaaaagctttccttctgatgactatgtgcttctttggggggagtggggacttttaaacatttttataacctctttaatataaataggcaccccagtgtgatgaggggaaatgtctggagtgggtggtgttaaatacacctcctacccctgtctctagcatccccgcagatttagttctttttgtcacatggagtgttggattcctatgttctaacttaaggcaggaatcagggcttttcctgttgggagtgttagtggtgggggtaaatggggggtttcaggatagccagtgctgcctctgcttggtccctgctctttgaaaatggcttttgtctcagtttacagtctttggattctctgaactgcccacctttccccactcctgagtgtcccagacagcttacgatggagatggacttctgaggttagttctagcctgtctcactgagcagtcactttgctcatgattccatgagagggcagtaggatggcaagaatgcatctcttctcgtctcctccctcctctcctgctttccaacttaaacccacttcaagtctattacagactg

SEQ ID NO: 67504 - DNA, 1020 bp, Homo sapiens
tattcagtctggcagcccaagtgttagcacagatgttttctaggaggaaggcttctcagcccaagcccagcagagattattggctgtatttccaagggagggttttatttttctcttttgactgactctaaggaatttagtggaagcagccttgggtttttactagtctttaaagtgaggtttgtatgtgaggagcagggcttggccactgtagagacgcactgctcagaccctgccaaggggagcttagcagattgacagcctccagcactgacctttctatccaccctgcttcatggaagtgtttcctactggtgatgggcacaacaggggtctgaaagcagagccatttctgcagatatgggactcctctaatggcagcctactaggcgactctgctgggctgaccaagactttcccagaactagagaaagtctggaggctctgctcacttcctttatcctttatagacatctcccttaaatctcttgtacatctaaccctaacttggcatctgcttctcagagggacccaagtcggcagtgctcggtgaggatgctgtctccgaggctgctgctgatcagcatgtacccaggaggctttaggggcgaagaggactctcctgatagtttttcccctgttgcctattaaacatgaaaaatagaaaattgagactttgctgcctttctgtcacatgatgttccatcatcatcttgaataaacactggctttggagtctgcagtcttctgatgtggccaatggggctggagcaagacagatttattacttgaggacatgacaggtggtgacagagttgtatcgtccagtgtagtgacttccaggcccaccagtggatggggatcagcttgggtatatccaaatcactatagaaattctgattctgtagatctggggtggagtcaggaatctgtgttttaaaaagctgggtgggctgggtgtggtggctcacgcctgtaatcccagcactttgggaggctgaggcgggtggattgcttgag

SEQ ID NO: 67505 - DNA, 1051 bp, Homo sapiens
cttcgcagcatgtgtcatggaaagagcttgggctttggagtcagtgcggggccccatctgacccccaggccccttgcttatcagctgtgtgaccctgggcgagttatatgtgctctccaacctgcttccttatctgtgggatgagggaaagagttttagtctcacagggttattttttccccataattttcttatgaaaagtttcaaatatatggaacaattaaaaaaattgtacagtgaatacccacatactcaccatctataggccacaattaacattttaccatacttgcttgacatatctttccattgagtcacagtgtcattttgaagatgaaattagtagatgttgaaatgtttggcacagagctgggcacataatagacatctttctggaaagtggagttggggtagtgaagaggcctggtgggtgttgactgtgacagaggcagagttgacctttgcatctccactgtctccaggacttcggttttcgcagccggatctcggagcacctgctggatgttgatgtgctttccccagtcctgggtggagcttgtcggcaggtgagtttctgtgggtggtgggctgagctggggcctcattttccctcacaactttttcggatgacccagaactgagccctgcccatcacagggtgcatttctgtaagtcctctcccttctaattcattaaggcatggtcctgactgcctttcacggggcttctgaccattcctgcattgttgctataaattaaagccctcttccaccatgtatttatccatttatccactcattcagcagctgaagagtggactgtctgctcatgtgcaaagcgctgtgtagattgtagatttcaaggcacttcccatcctggcccattcatcctctttacatgcccagcccacctgctgctcaccagctggatctgctgctcgctattgctggggcacactccacctccgccacgcctctgcctgccactctgctttcccatttttcccagcaagctcttttttggtcctggaggttcacctctgacacctcct

SEQ ID NO: 67506 - DNA, 1025 bp, Homo sapiens
gcttgcctgtggcccccgattctgccctcgtaatttcagcacgcttgtcattcactggcactgctaatctgggcctctgtggatttggggtactcatggatttctctgctttctctgcacagctcacagtgcaggcttccagcagcaggaggcaggattttctttttcttgtgtgttctccttcagcctctggctcctgactctctgtgtagtggctgtggtcttctgccacatcttccccaggcctcaaggctgacccagggagcagctgtgaacctagccaaagcttggggaagcttcactgtgcagtagatcaaccttctgttctacgtcccgtatggtcccatcttctggagagcaacttctcagtgctttcgtctaagcttgagagccagcaggaggatggagggacccaaatgcagtccctccaacacaaactttttattgcttctctcctacaggcccagcaaccactgggaatagaagacaaggatgacagccagtccagccaagatgagctgcagagcaagcagtccaaaggcctggaggagaggtaccataggtgggaggctatccccagcgctgtgccttcagggtggtgtggacttgggcagaattcttggctttggtggccggcctggctcagtgtacagttgcttggcagcaggtgatgaactggctggatggccttgcagggtctgtgtgtgcacatgcgtgtgtatatgtgtgtgcacgtgtgtgtactggcaatgtgtgtatatgtttgcatgcatgagcagaccctttgtttcttcaccaagatgggaatgtgaagtgccactgggtacaattggcaggactctgggcaccattgtggggccagggctgatgaagctgtgtgtgtgcctggttatgggccagggctgaagaaaccttgtggaggtctggaggagtcgcattggagggttggtactgcagctcaagagttctgagccagggccctgccacatcagaaatggctgtagctatctgtgagagtgcaactg

SEQ ID NO: 67507 - DNA, 1109 bp, Homo sapiens
atgctttatcctgctcatggtttcctcatgctttatcctgctcatgctttatcctgctcagaatgttctcaggattcctctttgggcatttcgttgaagaaccagaaaacaagcaaaataacagtccttattactttatacacatctttttaatggataccattattcctgatctcaccaccctcctatgtatccaggtcagctctgaattccttttattcatttctaaacatttaattaactctaagcagacgaaaacgtgcccccatgggtagacggggaacatggcactcatgtgcatgcttgctacattttttggcttaggggagcatctcctcctggcccccttggtggtgtgataggggagcttcctattcctgggccttcctggactgttgtagttctcagagctgggatacctgctgctgcttctttcatgggcccatatacattggccactactcagtttgggaggcagaaagcaatctctggggactgttcacaaattgctggcatgagccttaagtagcaggcagagctctagcggggaggtggtaacggggctgtgagccattctaggaaggaatccattagggacagagcttcactctctccctgctgctgccagctcttgagccgcagcttcagattttgatcttgggccataacctcgtaagtctgctgagagcctgctatgggctacccttctccctaggctcttggggccttaaacagccacaatggggcttgtcctatggaacaagcattgactgtatctcttggcctgcccttgggtgacctctttgactcctgattgtgggccctccattaggattccatctgtgatgttccgtatccattctaacctggatgcagaggtgggtggacattaaccctgtgatgatatgccattccccacccatggtaggcgatccacagagcctgtggctcccccagagcagctctcagaggctgcactaaaggccatggaagaggcagtggcccaagtactcgagcaagaccagaggcacctgctggaatccaagcaagagaagatgcagcaactgcgggagaagctgtgccaagaggaggaagaggagatcctccgg

SEQ ID NO: 67508 - DNA, 1050 bp, Homo sapiens
acagctgggaccctgcagggtgttaagactactgctccagtaactggaaccagtatcccagactctttctaggatctttcccagggcagaaatagcagtcccatgatgaaatttgccatatcccttcccccaaccaattatgaccttgctgaagaatagtgataatttatcagtgacctctcattccttacagaggaaaagttgtatatggtggagccatagggagagccagaaagggaatctgtcgtggtgtctgaccagcctctgcttcagctctagagggctgcaggcttgctggggccagggccggtgctgtgcttgtaaccctcctcttctccaagagctggctttagggagccgatggtgtccctgatcttactgatgcaaggctgcagggctaggggagctgtgatttttgtggtagaaggggctgccgcagcttcccaccggtgggcccaccctccttgcaggagaggaagcagcgggctgagcttctggggcacctgaccggagagctggagcgcctgcagagggcccatgaacgagaactggagactgtgaggcaggagcaacacaagcgtcttgaggacttgcggcgccggcacagggagcaggtgaggggcctggggcagggtgagcccactgtgacccctccatgcacagtaggaaggtgctgggagcagacgcatggccccagcaggatgcagcctgacagcttctggagtgagagtctctcactggccatctccaagctggggcatccttgttactttgttttctgggccagggaacacactcaggattagaactagaggtcagcccctgtaaggcattggggttggcacctttgcgtctccttgccccagcaggaagtaaacaaggtgtggagccttcctgggaggctgcaggggcacacagcgaggaagcctgagcccagagtggaggttgtggtgtggcatggtgggttctggaaccccctcctgcccctcagctaatgccttacactctttctatgcttatgtgtttccctttctgggcaggaaaggaagc

SEQ ID NO: 67509 - DNA, 1015 bp, Homo sapiens
tagatgtctgaggcttaggtgtagcgggggaggcttaggtggagtaacactgcagggagagcttactgggaagggtggtgggggtctgtgtggacctgatggcactgttgtctctgtctcaggcatttgggacatatgctgagccttgcctccctcccaccctgctgtgaggcagcctgtgtgatttgcttcgcccagggtacctggtggaactctgggccccagaggagtctactcaccaagtcctcagttcccacacatcacaagggcgacagcctacataccaccttgaatttgtagcaacaaaattgctaggagaacaaatggagatggccatatttcatggatttgcgtaagaaaaccagcttaaagacaaaacataaagaagaacctagctcagtgtcccagccacttcctaggaaggaaaaaggaagggtagaaagcacgtgggagaggtgggtcataactgctgactttaccccacaggcctcagatgagggcactctgggaggatcccccaccaagaaggcagtaaccttcgacctcagtgacatggacagcctgagcagtgaaagttctgaatctttttccccgcctcaccgtgagtggtggcggcagcagaggagtgagtgggggagatgcggggtgaggaccatggtatccatggaatgggaggaacttggggaatagaagaagagctctcttccctcagccctgcagagggaggcctctgtgagccggtgtctggactaggtgctcggtcagtgctgggaaggaatcacaccatctaggtttgccagcacgtggggctgaaaggtcagggaagccctctgaatgctgcagagcactctacggtgtgaccactggccttgctggcctcttctcttccagggcctccttgaggaggcttttctctctcagctgccctggcctgtatgtgacagaagggccctctccccttccttctctctggggtcctgggcccttcacccagcaccttgccctggaaacctgt

SEQ ID NO: 67510 - DNA, 1034 bp, Homo sapiens
gccacaggcgaacacacacgcacacaccccatagcacgcttagctccattgtgggttagaaagtccatgtcttacattgagtagaaccccagctcttggttttggggtcatattacactgtccccatcaaacttatcaccctgattgttgtcagtgcttttagaagatgtagtagcatttcttctagagagggtgtaggagtctccttgcccagcagccctcaaagtcctgatcccccttccctatggggccctatgaaggcacactccctggagagttcaatagtttcttctctccctttccagggtctctgaggctagtgtgactgttgagaggctcccagccatgctctctgtgaccctcaggcttgggttgggatcccagcgctccttgaaatagagcaaaaggtgatgggttgcatagtgtctgtggaggtgctggtgcctgagagcataacaatagaacaggctcctgcacataacctttgggatggacccatgaccccagtttggaggcgagggttaggacaagatggccctgaaggaaggattgcctcccatcttccttggttgggtcaaatcagctggttaatgtcctctcccttttgttttttcttgaaagacccatatcactttcatccaaatccatatgtcagttgtttccccctggccctgacctctgatcagatagggggactggatctggatcattgggatgattgatctggaggtgagagacagctgctgtttcattaagtcagctcagccatagcccccaccctggaaaccttactctctctccagcagccttctaactctacagggagggccctttggtctgtgatgaaatggtttgtgggtgggcagcacgcctgggaggggctgcctccatctccaggaagcacagttcctctcccggctcgggcaggatggggtgcaggtagtgctctcctagttttaaaaattctaggataggagacgtcagtctgcctcatggcttttgctctgtggggtagagcagagggcattggagac

SEQ ID NO: 67511 - DNA, 1005 bp, Homo sapiens
ccaccccgtgaggcctccatccggaacctggctcgaacctaccacacccaggctcgccacctgaccctggaccctgccagcaagtccttgggccttccccacccaggggcccccgctgccgcctccacagccaccttacctcagaggactctggccatgccagcccccccagccggcacagcccccccagcccccggccccacccctgctgagccacccaccgcccccagcgctgcccctccggcccccagcaccgagcctccacgagccgggggcccacacaccaaaatggggggctccagggactcgcttctcgagatgagcacatcgggggtagggaggtctcagaagcagggggccggggcctactccaaatcctacaccctggtgtagggcccgcaggaagagcagccacgcctggaccgcgccgcgccgcagccccacacgccagctcggctgtttttctgcattatttatattcaactgacagacaaaaaccaaccaacgacaaaacaaaaacccccaatcatgaacgcctgtacatagaactcttttgtacaaatgaaactattttcttcttctccatgaagccagggcacaaagaatttgacagtacaagtcaaatcccccaccccacaaaatatgtgtggagatatatatacatatatagacagacaggaacgcgtccacgagctatatatctatatatttctctcaccctattttgagacagaggcacaaagactcagcaatttttttccctcctcctcaccttccccccagtctaggtggttttgacaaagaccaaaatcccaactcagagacactgcatgcgattttactgttccaagaaaaccaggagttgcttcaatttgcagatgcttatgtgttaatacctttttctatgaaaaaagacccagcgccgtgtgcaataaaggttatgtttctatgtggtggcttttttcccatctggcgaaggccagcggggagggaggagagagcccg

SEQ ID NO: 67512 - DNA, 1070 bp, Homo sapiens
aacatggttggtctgggcttggaggtgctgttggagctctgccctgcataagcgcctccacatggagcaagctgagggaggaggaaagacgggggaaagccgagagaaggcacaggcgtctctcgaccagggcctgggctcaggcgagaggagaggattgagaggctgcgatatctgccctaaccctgggagcagagggggcagcccccaggcaggacatagggcaaggggctagccgcccttccactgatgctctgaggggccccacagagagggaagggaggatggggatgggtgcagtgggatatgcacctatatcccatcatatgtattttcccctctgcctctttcatcatctccagccagtcaaccaccaagtcctgctgagtgactactatagagaatgcctgttctaggtacgggagcaggagcagatacctgccctcaaggggcttccagtctagtggaggtggatggcagaggggagcacactagaggggcaggagtactgtcaggaagatgtgcccagggctggaagcaaggaacggaagcaaggagcagaagcaggagcaggaggcctgctcctccctccatcaacaactgggcatcagcctgagatctgcagataagcttatggccaccaggaaagctgccctgaaattgctcagtaattgtgtcatcatctcctcctatactctctgctttcctgtggtctttctgaattaccctctgagtggtaggtggcccagctccccgccagtgagaccagagttctattaccagaggggaagcccactgactgcggccccccactccatcctcacggccactacctcacatgcagcaaagtgcacaaacgtcatcactgtagacctccgcgaattttcacaacccacccaagcagcagcgcccagagcacagaacaggacattacaacaccctgaatccccatgcccccttccagctcccgcctgcccctcctcccaggtaaccatcatcctgacctcaatagcatagattagtgctgcttctttttgtactttgtgtaaatggaatcataccatttgtcc

SEQ ID NO: 67513 - DNA, 1042 bp, Homo sapiens
tgaagggaccactatccactcctaagcaaaatttaggattttagattactccatctcagacgccatttactgaacaagggtgggggagacctggcttctgatcttagctccatgttgtgatcccaggcaggtccctgtacgtcgctggtctcagcatcctcatctctttgtgcctcaagctccctaagccagctctataattccacaagtctatacagttctgcaatgtggatttctatccagaaaaatcagactactcgcctgcccatgcctgagtgccccattcatcctccctagacatttatggttcagcagcctggggagatacagcagcggtttaacgctgccttgaggagctcggtcttccaggtgctgactgcccttggaaggggcagtgctgatgggggctgcctctggagagtcacgtggggtggcagagggcaggagggtggggagatggggagactccctttatgacatgctcttctatactttctgaagttttgccaagtccatatgttatctattttatctgttaaaacacttttaaagcttgtattagtattagtatcatcattatttttgagacaagatcttgctctgttgcccaggatggagtacagtagcacaatcatagctcactgcagcctcacatctctggctcaattgatcctcccacctcagcctcctgagtagccaggaccacaggcttgtgccaccacacctggcactatagtcatgtgtgtgtgtatggttttgtttgtttgcttggtagacatgggatctcactgtgttgcccgggctggtctccaactcctgggctcaagtgatcttcccacctcagcctcccaaagtgctgagattacaggcatgagctactatgcctgacctattattaaaacatttattttaaaagaaggggaagttctgagctgggcacggtggctcatgcctgtaatctcagcactttgggaagccgaggcgggtggatcacaaggtcaggagttcaagaccagcctggccaagatggtgaaactccgtc

SEQ ID NO: 67514 - DNA, 1049 bp, Homo sapiens
atctggtatgggtctttaaatataggcagaagtgaattttgaggagataggatgagatcagggacaagaagcatttctggaaatgaaggtagaatctgtgtaaacaattgagtaaatttgctgatattggtttctagaagggcgtgcatggactttgggttagaaactctgagcttaaatcgtggcttcatcacttaccagctgcatgaccttaatcaagttaacatttctaagcctcagttgcttcatctataaaacggggataataatagtccctgactcagaggtgtcttgagaatgagaagagataacatatgcatgtaaaagtaacgcatggatcttacctgtgttcatcacaatgcttaatgttcagatgcattgtactaagtgaaagaagccagacttgaatggctactcactgtatcatttcataaatatagtgttctagaaaagccaaaactgaaggtaaaggaaacagatcagtggttgccaggagctggggttggggagaggggccgacaacagggacacgaaggggtttggcaggggatggaactgttctgtatcttgattgcggtggtggtatgtcagacctttcagaattgtacactaaaatgggtgagatttactatatgcaaattctatctcaataaatctgacccctccataaaaaagacataatacattcatgtaaaagccttaatgcatggtgtttactagataattacactttgatagtgagcaggtgatccatggtaacttatattattatcattaccgtggggagacccttcctgcctcaaagtgcacaggcacggcaatttttcacaggggcaaaagggccacagtgctcctcaaaggaggaggcttcggctcagtgacctgcagcggtcccttccagcctatgacatttgttgaaaacattctacctcgttggctcaccaagtcatttttgcataagaatgactgcgaggttttgttctggcttgaacaccttggcaggctggcagacctgggtcccatcctcagagcttaatagccactttctc

SEQ ID NO: 67515 - DNA, 1034 bp, Homo sapiens
ggtcagaccacgaagcctaaactgtcagatttagacattggctagtgttctataggtgaaggggagctgaggaaggatcttgagcagaggggtacaagccatgtttaagacctgcctggcagaggagtgtgcagggaggacttggaagggggaacaccagaggcaaggggtcttcagtgcaagtggctggtaagggaagctgcactgacaatgggtagggaagaagaggccaggggagagggtcccagacctgtccaggccccgcccatcagcatgcggaggggaaaggccatggtttcttgaactagataaccacctggttactgggtgaccttgcataaatgtcttcacctctctgggcctcaatgttctcatctctaaaatgggaatgctagtgctacaataataataataataataataataatatccctgtctcctatgccacattgtgagaataaaatgggatcatgttatgaaaacactttgaaagcatgaagtgctgttagcattcttttgtcctctttccctcttggaaatcaatactgaaatcattccatgtttctcccactcaggcttcttgtgcttcaactttatttacttcagggcacagcctgagaactgaggggtcaatatccctacgcagacaccacagcccgtggactggggcacacagtaggagcactcaggcccagccttccccggagctggaggggcccggcttcctggcagggccctgcggatattcccctctcccttacagcctggcactctctggtttgcacttggcaggcctgagggtccccttcactgtccatccaagcatgagtaactctctctctttctcccccatgcttacccaggcatccttaggcataagcatttaatttatttatatttatgaaacctccaactaggtcaatgcacttttatgcacatcttgacaattattgatactgtgagcggaagaagaggaccatgtgggctggaggaaccggcttatccctctctcaaccagccaagatccttggaga

SEQ ID NO: 67516 - DNA, 1012 bp, Homo sapiens
aggaaaagtaactataaatatttaaaagtagcccctccttcacccagagagcccccaaatttccccacacccctgccccaccccagcagccagatcaggatacagccgctaggcttcagtggccctccttccagacccctacatttaggcaaggggaggggtggctgggaggctgcttgcagccaagacctctgagctctgcaggggtctgctcccacacccccaaccctgcataccctccctgggctctggcaggaggtagctgggaagagcagcctcagtctccgaccccctggggccagttatatttggatgttaaaagtaatgacacatctcctcaaagtcctgcctccccgcctgcctaacgcggtaaagtctcctggcagggagggggctggcttatatttaggtctggcattccctggtaggcatcctgttctgaaatggaaattcttttaatagctagccagccccgagtatttaatgagctggtgttgactttttgatttcttgttctcggtagaggactgtgagcagcttcagctagttagggggtctcctctcacaaagtgtattgttttttgagcatggagaagaggagagcgcaccctattattcctcaaggccccccttcacctttcccctttaagcttctgcctcacctttgttgtcataattcacctcttccagggagtcttcccagatttatcccacctgcttcctaccatgtctttactattactccaagagcacccttgtgtctttttctggggtgcctggtgtgcgtccccagcaacatcagcagtcctgcaagaacacttgtctcctgtttgtttggagtcacagaatgctcggtctgagttgaccatggtgggggatggacatcaagggtccctttaagaatctgatattaagaaggtggggtggggggagcatggaccctctaccccagaaaaaaatatacatatacacaaaattggaagaaatttcagaggtacatggacactcataa

SEQ ID NO: 67517 - DNA, 1013 bp, Homo sapiens
aacacctggggggtgagagacctgcctgtacctctccctaaaactgcccctgaagaccaacaggctaagaggctagggtcagtgggactccctccctgcacttgcttcttatagtcatgtctgcttccatgaaatcttccccaacttcaagaaaataaactggttctggtcagaagttcatgcagtgagggtcacaagtaggatttgcagccaaaagctacttcctctagcaggcccagcatccaggacctcaggatgtgatagaggctcaggagtgcaaaagaagacagctcaggccaacccctcttcctcaggtaggagggcacacaaagagtgttttcttttattttcaacattattgtcacctccgttttctcatttcaccttcgcagcagccagcgagtagggtactattatcttcattctccagatgggaaaactgagccaccagggactcaactggccctcccagggtcaacagctcttcaattccaagtctattgtttttagaaggacatgtggtccagaggcagcctaagatggactattccactgttagattctttaccggctttttttctgtgcaaaattatctggtgccaaactgtgccctctgattatctattggcatcagaggtccccgccctgccctgggcttgtctgcagcctaactcagcctcaggtcaggctgcctgcaggggcagtgttggccacactgtgagggggcagatgctggatcttgcatagtgaccattacttctcctccctccattcaagaaatgagctgcattgttgcaggtcaacttccctacatgtcaagaccctgctccaggcttcccactgaagcagggaagtcagactgcgttgggcactgtgaggactggaccgttccaatttaactgctgattggctgcatgaccttgggcaagtcgtttaaccacattaagccttggtttcttaagtcccacaggggaccacaggggataatgacccctgccatacttttctcataa

SEQ ID NO: 67518 - DNA, 1101 bp, Homo sapiens
atccaaccctgcctccccaactcttgttctgtctctcctctgccaagccacaaattaatctgtgcccctgccagagaaatctttgctagatgtcttctcttcccaatgggctggctcctgaagcaatgattctagctgggggttgcatttgaccccagggcttaccaggtctctccgtgggagtgaggaaggagcttttgaaggagaataacatctaggagggagaagagtgctcctggggccaggcttaggagtgaacaagttaaagggccaggtgatgacttccaggctctcatctggggccacgagtgcgcatgtgagtgcctatcataataaaggactatctcacccatactcaagccataaaaaaaggccaaaacacaaaacccaaaagggccaaatccaagtgcacctgatgctttaaacttgtaatgcactgactttccaaccttcgccccctcaaagcttatttacagacaggttttgagctcccaagtccccttctatttgcagattaatagtgcctttccattcactactctatcaagagccacaaggtcaggaatgactccagtcattcttaggggcctaaagaataaacacctcctgttgcaggcctcgctgaggtggcccctcctggctctgctccccatccttccccctgatctctgtgaacgcctgtgatgctgtcattccgattcagctgatttcaatcaagttgaagctggtgggtggctttgcaagttggctagacttattttaatttgaaaccaacaaatggtaaaaagaaagttaatcatttagtgaaggtaacctgttctattttttcactgctcctcctgcacagagagctctccctcccacctgtcctttatggtacctgggtgcccattattattctctttgcactaaaggcttgacagctcctgtgaaattgtaactatgtttttatgcaggggaacagcaagccattatcctccaatagtgtcttaacacatgttattcagatgagtcagcattctgtgatggaagtacctaactggtctcagtgtcagaagacttgggttcaagtctcaggtgtgtgatcttgggctacctcgt

SEQ ID NO: 67519 - DNA, 1041 bp, Homo sapiens
acaatctccccactcctaccttccttagattttcctaaggatgaaagcaggtcacataggtcagggtgtcagggttctcccagcacgtcatgaggattaccacagagggctggctcagcgatggaacgggctgccttggcagacacagagcccttggtccatgagagggctgtggggcgggtttgccaggtgggagtggcaagtgggatgaggaagaacggaggaaggaggaaggagagtgctgcttccacagcccaagcactgagacctgagctggggctttgctgtgtatttgggaactgtcactgcagaacaagacggggctgctgcatctgaggaagcttcagttgcagctcccaagctccagaggaccattccacgagcccacccacccaagtcacagcacccacacaagtctgctcacttctcctccatgagagaacattcctggggagttgaaaagtccctcctgtggggcttggatggcaagacagaaacataaaggccaggcattggcgtcatggggaggaagaacagatgggcggtgagccttgcaggaagggagcgggaggcatggggtgggcagggcagggaggccaccagagttcccggggcctctgcagccactaccagttctctcatactgggcagcagcgtgggcccagccaaagcacctgagtccactctgctgcccacacaagcccgtggcagaatggcaacgaagacaagcctaccgtctgcatcctccttccctcctcccctcagttcctcttcactccaaggatgggggacctcttcaggatgtccccccaccctcaagccttcccccaatccacccagccccaagattaggaaggcagagccaaagacttttagatctcttttcatccagcctcctacccatccagcctcccacccatccagcttcccatccattcagcctcccacccatccagcctcccacccatccagcttcccatccattcagcctcctacccatccagcctcccatccatccagcctcctacccatccggcctcc

SEQ ID NO: 67520 - DNA, 1049 bp, Homo sapiens
tggtgaaacctcgtctctactaaaaatacaaaaattagcctggtgtgggggtgcacgcctgtaatcctagctgctggggtggctgaggcaggaggcttgctttaaccctgggaggcggaggttgcagtgagccgagatcatgccattgcactcaagcctgggtgacaagagcgaaattctgtctaaaaatacacacacacacacacacacacacacacacacacacacacacacacatatatatggagagagagagagcgagagggagagagagataagtaaagcattcagaacaatcctggccagagtagatgcttaagatttagttgttatttgctgttctacattaggcctgagctggtgggaatgtcacattcctcatctttggtctgattctctgtggcaggcacttgccttcccaggaagcactaagcatttggctttgcagagattttacctcctatctctggagaaggcgccgccttggattctgggccacctggattgctaaagcctggggttaggtgctggagaggagaataaacatttatggagcagctaccaggaggcagagtgtgcaccaggtgtctggctgtgtgttctttccaactctgcacaaccaaggggtgaggtattaccgctgttcccatcttgcagaggaagtgaattgctctgtgacccatgatgaaagggctgagacagccacacacacaggtcagtctgaccccaaagcctgtgctcttccccttatagggcccactgcttccacgttctagaatcctttctccttttctttgatcacgttttatttcttctgacacacaaggaattgaacttggctgctgcgtgatccaaggggggcagaggtgaactgcgtggaagcgggtcctgcgttgctttcattcaccttcataaagggctttggcgctcaggaaattgttacaactcaaccttgagccggcccctgctggggagacccaggagcaccctggacaccaccctcaccccttcccctgggtttccagagtggaagtaattcaccccatgga

SEQ ID NO: 67521 - DNA, 1070 bp, Homo sapiens
ctgtttctgtttcttgtcccatccctgagctgaggctggagctgcagaccctggtccagtagccatggacagaggcagcagctgtttcaggctgtaagagcaaagcgccctggattgaggcttcggtcaaaatgtgggccttagtctgtgcccacaaatcaggccatgtccatgtcccccatggtcacaggcatgacctccaaggtcccacccagggttgctttccaggctacaaaggcacggaagacaaattaggcacacaggagacatccctgtcctctccctggaggttgccctggaaactcttactacctgtactctcccaggttgatcaactggcagaggcctggggcctgtttgggtgattctgaaccaactcaggcccaggcaccacagggttccctttgggctcagcaccagatctcaccacagtggaaagctgggcaattagctgccgagtcctgagcagccctcaaccacccctgaccatctgaatcatcctagcaagccacccactgggaaccccaatccccaccacacacacacacgcacacacacacacacacacacacacacacacacagatagacacacacactttaaacagaatgactcagatggactccaagggcagcctcagatcaccagctcggtactgtgaccttccaccaagtgtgtgttcagactggcagaggctctgacagcctctttgcacgaggctgcgtgtgatctcttctgactttctacctaattgtcctggaaaagagctggagaggacagtttctcagagaaccgcagctgcatctcttcagggcattcattcattcattcattcatttcttcaactaacatctgtggagtatcttctgaatcccataactggatcctggcaacatgcagaagaaacccgggccctatcctcttcagcctgagggcctgcaaagcctttgacacgaggcagtccatacgtgaagcatctctagctgaggtcctgccaaacctggcagcacctcagaatcatgtggggagtgggcagacacaaattcctgggccgcaccctggagatccag

SEQ ID NO: 67522 - DNA, 1052 bp, Homo sapiens
aatctcagggctaaaagggggccttcaaaggtcactaatccaagtctctcttaatgctataataaaatctccctctgtaatccagcatccatctctaatgtgtgtcctaccagcttccaaaagggagaatttgggctgttgatcattttaaataaagtcagaaaagcagatccccatgtagatgaaagcatgggggtgaggaggagatggtttggccagggacctaggattagatagtcactgacacggagcattaaattcaactctgagctttttgacagcaaaagcaaaaatggaaatatgattgttacatgagtgtctgacaaaaggacttgtggcaggagagacacgctttttcctgattctgaattttgaagcaagccacattcatttactggccagggaaggtggctctggaggctgtggatttgtttctgtttccctgttcttactctgatgctcttctgttccaagagtctgtcttgtggactcaaggctctctctggctggctcatttttctttgtttctttctcaggagcccattgggttatggttttggcctcaagtcctagggagatggggcccttttgcaaatttcaagggctttgcgaatctggaaggaagttacctgatgggatgtggatgttgatggacagggcagaggtgtcaccttccaggactagctgctgttggcctgggagtgtgccatctctgtcacctgtggagcgccctgcagcccacatagaccaccttagagccgatgggttttactagccttcagtaaccagtgtgaagaccccttatataactcaacatgtaagctccttatttttatttctcttagagcaataggtccatttctagttttccatttaagcagtcaatgacatagccagatgacatagcactgccacctcttagtaagcttccagttcctcaggggtgcctgggcatttgagggctacagctaccaagtatgtgtccctaccttccacaggccctggcctgggcatggactggacactgttgctaaacccttcatgtgtgttct

SEQ ID NO: 67523 - DNA, 1062 bp, Homo sapiens
tttcctcatctggatcgtaagctcctatgaggacagagaccacatctgtctcattcctcactgtattcctgctgccttacttggcatatagtagacatttcagaatatttttaaaagagtgaatcaatgaaaaatgaaagaaaatgggaataatagtacccacctcccagggttgttgtaggaataaaggggaccatgtgtataaaaccctcagtgcataataatgcgaatggtgtttggctgttatattgttctcagagtcaggtcaacttgctttctctgacatcgggcacctaatgagcagtagtagatcatctggcactagattccatatccctcccttcttctccactgcaagaattacaaacacaaatctgccttcgatgtgttcggatacagggtggctcatgggacaggaaaaagtactggatactgaatgggaagcagcatttcctcttgggagtaaggatgctgccaagcctccaaccacctttttctgggtgctataatcaacgatcaactctgaaggttggattctgtttcaggtcaggaggtggcttttgaggcacttaaaacagaggaggaagtcaggctgaggggctagtgggaaactgagtcctggatgcaaagaggaaggaagagttgggaagaagcagaaaggagttaactatctggaaccagtctcagtgtctgggctggctcttcagtgcccaaggagatgagcaccgcccccagccccggccaccctggcaagctggcccattagagagtgaggggctagtcagaccccgggcagaaccattaccaatgttgacttatttatttactttttatgagacggagtctctgtcacccaggctggagtgcagtggtgccatcttggctcactacaacctctgcctcccgggttcaagcaattatcgtgcctcaacctcccgagtagctaggattataggcatgcaccaccacgcccagctgatttttgtatttttagtagagacagggtttcaccatgttggccaggctggtctcgaactcctgacctcaagtgatccacccacc

SEQ ID NO: 67524 - DNA, 1038 bp, Homo sapiens
actgcacagccgcagctccgaccgccgcaccagctgcctggttcatgaatcctggtgtctgctaggtctctgcctgggcctctagggcagagaggctctatggttaagccacaagcctgctgggcccaggggatctaagaccactttcagctctccctctgctccgtgcctaacacgcatcgtcccacagtggccagacccaaagtcagcctctggagtggcagtgagccctggcctctgctctggcccaggccgacctgaagtggccttccattcagcggaaggcaatgaggccgctgagcctgggaggagcccctcccccatatgtgtgccatcactttggctgcagatgttctccgcttgaacctgcctctggcactcatttgcagacaatccagtagcatttctgctctctcactctgtagtattgaaaactctttacaatcctattcaaaaccctctcttggctgttgccccattccgagtagaagccaaagtcctcgcctacaaggccctgctcagcctggccctacgccctgctcctctttgtcctcatctcctgccacttctccccatccgccttctggcgcatgccattgtcctgaaagacgccaacctgtgctggcccctggccttggaacttgctatcccccgttctgcttcctggagtgttcttccactaggtacccatgtggcacactcactcactaccttcaggactctcaggaatgtcaccttttcggaaatgctttccctgaccctctctcaaatacagctgccccccaaccttccctgctcaacgccccttccatggtacctaactacttaacaccatttgacctacaaggtattttcttgtttgtttagtttacccctccactgtaaactccaagagggcaaagattttgtccattttattctttgccatatcctcatgtcctaaaacagtttctgcacatagtagacactcagtaaatacttgttcacaaatctaaatcaaaactgcaaaccctcatctatcaaggcttctcctcccgc

SEQ ID NO: 67525 - DNA, 1008 bp, Homo sapiens
aggtgcctcgatgtcacggaaggccttggttactctccaggcctggtccagctctgcccttgggcctcaggcctcctgggacaggggcctcaacaggagacctcctctattgccaagttttcccatgacaggctcagagcaccggctggaccggccctggcatctccactggggcccactttggctacttgaagaagggactttggaaccttcctccctctgtggagcaattagtcaggcaaactccagtctctccctttggctaaagatctgagcactgggcaaagccccagcaatatatgaagaaaggggtcagactccactcaacacctcatgttctatttgttctcaagcacacacaaacacctttcaattttacattcttggcttaaaagtgtttaacattcagcaatacattttacattagacagacacatcagaacagaagaactagcacaaagacaggaggggccacctccatccatatctgtcttttctttttttaatgaaactccgtcatctccttctctctctctctctctgctctttgctaactctgcatctctgtatataattgagttaaatggttttgatatcctagcgtcttcaccccacacaccctcttcctctttttttctttttttttttttttttttttttttagttaatgaaatgtgtgaacagtttgttcccagctaaaaacaagcgctgatgggtttcatacctttctgtgtaggaggaagaggtaggttctgagcaaggcactggctggcagtgggagaggccactggtgggaggtgaggtggggagaaagaaggagaagggaaagatccatacaaaacatcacgtgtgatctgtccctcttttgctctccctgtgcacaaaccctgctggggtccctgtgattggcacatgggcacagggacttgggaaggctccaccctttgggaagtgagtcagtacatccatgggtcaggagaaagggactgatgcttggaatggcagtag

SEQ ID NO: 67526 - DNA, 1667 bp, Homo sapiens
cctctgtctctccgaagtagcctcctgtttgaaaactcgaggcagctgtaccccgtgcgaagcttcttgctcccgtctccccatgtcttccaggattttccttcatagttggggattactcgctaacctttccttcctcacctacttccccttttccttcagctttcaccgtgtttaaatcttctaataattctttttatgacatcttgtttttcaagctcttctccagtgatccctccacttctccaatggcccttttcactaaacctccaaatttgtctttgctgacatttattgagctgctattacatgttctaaatgctttacttgtcgtatttaatcctaacaacaacctacaaggtaggccttgctattatctccattttatagttgaagaaactgaggctgcttgaattaataactcacccagcatcacatggctgtaagtgttggcaccaggatttaaatcgaggctcatggcaagcacccggttttccaaccaggaaagaagtctctccatcgtccccactgactccctcaatgccgcttcttggagtgctcatcctttggatctctctgtacaccctcaaaactgtagcatttggaattcacgttttggggttccatgataccactccgccagctctcctctaacccctcctcaggttgtcttagtgagctcttccctgcatctacctgctgcatgttggcttctcacttgctctggcctgagctctcttgtcttgttctacgtgtgctctctggacaagcttacctgctctgattctaaccacccccggaacactggtgacccaacatacacatctgcagttcctaccatgctcagcatgtcttgaaatgagctcatggccacctttttcatttcaaatctattctgcaggttggttagcaaaaaaaaaaaaaaaaaaagaaaaagaaagaaagaaaagaaaaaaaagatctgccctgttatttaggacagagatcatggaaaacatcatctgtgatgtctttgcctttctcgcatccctaattctcatagataaccaagtcctcttgagtctaccttctcagtagctgtggactctctttctctcccttttttcctactgtcactgcttttctttaggaccttgtaatatctcccttgagcacttattgtgttgcttctgttgtcttccctctaatccatccaccatacggctgccaagcatctttctaaagtcctttctgtcatgctgtgtacatcccctgtcttccagtcacctaaaggctgaaggtcaagtccttagcaggcatccaaagccagcacagcctggctccagtgcacttccggcctcatctttgattacatacttcacttgccacccacctgcaccctgggctttattcatattaactattcacaagtccctggaaggaaatcatacattcatatctgcaccaaagagcaggcagttcaagatctgtctgttccacgatgctttccttaacccccaaccaggatggctccttcccctgggttctcatctaagttagttcaagccaccaacgtgccacttagcacaccatattatggcttaatgtttaagtgtacacctccttggctagatggtccagagacctagcttttctcacctccttggctagatggggcagagacctag

SEQ ID NO: 67527 - DNA, 1023 bp, Homo sapiens
aatgggtacagagtttcatctgcaagatgaagagttctggaaatggataacgatggttattgcacaacaatataaatgtacttaacactgctgaatggtacacttaaaaacgggttggtaaattttatattatgcatattttgccataataaaaaaaatgtggaaaaaaagtcaaggactaccataagagaagaaagagacaaatagatccattccaggtttgcctgagaatctttatgttggatcttcccatcagtgtatgcgacagggcaggaccaatatcctgaacacagaggttagaaaccagaaaactgtcaaagggaacccttacaaaagaaggagctatgtgaggcaggtggccttgtgcaggagtctgagcacaagagtcagccaaatttaagtttgatcctagtgctgctgactcaatgctgtgtgatgttggacaggtgatctaacccctctgagccatggttcccttattgataaaacgagatgacaatactaacactaccagagccgttacaaagctaaaagcaatctgtgatgtgccaaaggaagttcctagcaaatagaaggtccttgttaaatgttagctcccatattagtccctgaagagtctgtggaggaggtggggttttcaggctgcttaaatgccagcagctgcctcagatgacaagggaggttgtactattaatgggcgagcatgggagatgtccttttccaaggtgttgggcagggattgaacatgttggaagtgagctgaatagtgagcactaagctcgtggttgtaactatgggagattagcatttccagcccccatgtgaagccagataatggaagggagagcaattaaatagacgcttgggaaactctccactgtatcaggcaccctgctaagcactggggaagcacagacaaggggagacgggtcctgaccagctgctgctcccaggccaggcagcaagatgagtgtccctgggatctacacccaccctggggggcctgcagggaagagaagtgcg

SEQ ID NO: 67528 - DNA, 1123 bp, Homo sapiens
ctttgccgtctctccgttccttgcaacaccaacccctctgctctggggtgacatcgttaagcccaaagttcctattcacattctcatttctgagccactcgcctggacctaactcctcttcacattcgagacccagccgtgtgctacagccccgtccctgtgtaataattcctcccgggggcagccaccaaggccagagctccccaccacaggctctgcttccctgccaccttgggtagctcctgcctttgtctgctcaaaccctgttggccaaatccatatgcttgctgtctggtcccttctcctcccttcattgctgggtgtcaccagggccagcctctctctcatcaggacctgcctgtcctgtgcctcttttctggagggatgtaacccaggcagctacacagatttaggaattcaagctaaagttctgtgagtcatactgacttgatgaattacctcttccgggtaatattacaggttcacagaggtttgcagtgccgtagccctagagtacggtgttgtgcgtaagtgtcatgtgcgttggcaaaactagttggatggggcagagcaatggaataccttcttctccctcagagcatcccgctgtctgggctgccagtgaactctcctgggaatatgtgtggggctgtggtatacagggcagagggtcagggtttctaaaaacatcatggtttaaaacaaccagattccgaaatggatggaatagacatttctccaaagaagatatacatgtagccgataagcacatgaaaagatgctcagcatcggtcattaggtgatgattacattcaaattaaaatcacgatgagatgccacttcacacccattaaaatgactactatttaaagaaaaaaaaataataataacaagagatcaaacccccaggtggatgtggagaaattgggacccttgtgcactattgatgggaatgtaaaattgtgtagccattctggaaaacagtatgatagttcccaaaaagttttgtttaatatttatagattgaggatgtacaagtgcagtgcagttcttttttacatgtatctgttgcatggcagtgaagtctgggcctttagtggagctgctaaaggcccagacatca

SEQ ID NO: 67529 - DNA, 1125 bp, Homo sapiens
aactgaagctcagagtttaaacttcttgcccaagttaaagagccagtgtgtgcacttggaggcacgttctcagctctgacaggctctgactctggggcaggacccagccttaaatgaacttgagatgatttaatgggcagcatgtaatgggagcctacatctgacatcccaccccccactttgtactctgccatgtgtctggctctctggagtgagaaggagagaacgtttggccataggtccacgcaatggtatcgcttcacttgtgtgtaatgtaccacctcttacacaaaagccctgcctgtgtctccagagctcttggggaacaccctttctcaggacagtttgagtcccgaaaatgaacataccaggaatgccttaggtgtgaaggaagttatctgttcctcaaaacacaaaatattagccactaacatttcttgagggcttgctgtgtgccaagtactgtgtgtttaatgtttcctgtgatcctcacaacagactttgagatgggtattattgttgttatttccactttacaggagagaaaattgaggcttaggttaagaaacttacccaaagtcaaacaatttaattggtttgggaagaccaggaagactttaagttcctaagatcgtttgagattctgcatcagggaacacttgacagcaggtttatacaaagacagatttggtatctttggagggaatgagtttccagtcattgcaggtggtccagcagagagggccactctcctaatggggatgaggatgctgtgacagagctgtagcttcggatggcagggttcaactagacaggtttaaagtcccttcagcccgagtctccttgactccacagaattaatgtgagaagacagagggtcatactgtcctatggtgtgtggggggtacaggaagtatagggcacagagagggaggcaggaggtgttgaagacatggtgttgtcctgagcagctggttgaagctagttgcagctagcttcactttgccattgccctaatgcagtcttcatgtcttggtaagtctagaatgggcatccagtctctgcttcaacctctgagggatagagaggacactcacttctccaagataagaacaaggaccttat

SEQ ID NO: 67530 - DNA, 1033 bp, Homo sapiens
ccagttgctagggggcatttcaaaggggctggtttcagggcatcatcaattacagcaaccccccagatgtgcctcgaggacagctgtgtgccaggcactgggcttggcattgtgggagcgtgagtatggggtgaatgtggccactacctaccagaagcttacagctcaccagggcgtcattactgttcaccagcctagaacacggcatggcgccaggaagtcaggatgcccaggacgggcctttaccctgtcccacgcccagtacagccactgctggttgatcgtcagggtcttttatttctgagctcccaaagagcctcacaatccttatccacacaggaagccaccgccagtcagttggaacctgcctgagatgaaaccaatttgttgtccctggtggaggaaatgatgagtgatacaggaggagttctgatgaagagttgagggagcgtcaaggggagtgggcaccctttgaggcaggggcggggagaggtgaggctccatgaaggaggtggccttcgagggtgggtaggatggaatacttgaggggggcagggcagtgcaggtgcagggaggggaccggtagggtgggcacaggagccccaggcggtgtccttggccgctctcgggccctaccaagtgaccggaggcagcctgatcgaccatcttcggcgtggcactggattctgcctctttggctttgtcccagggtggtttctatagctgatgaaaacctcagatctttcttccccctagaagtctctagaaaggcctgcgccctcccaaacaaaacagaaagcagatgacacagcctggtgctggggtgcatctggggtgcatctgggatgggaatttctggcaacaccaaccatctagcctaagggtcgccagactttctgtaagagaccagagagtaaatatttcaggccgtgcaagccacaaggtctctgtggcaaccacctcagctctgccgtggcagcgcacaagcagctgtggacaatacatgggtgagcgggcatggctgtgttccaaa

SEQ ID NO: 67531 - DNA, 1010 bp, Homo sapiens
aggcagtcaggattggtggggaggcaagggaagtgcttggggaagcaaatccctcctatttttagtgctttccagaaagcatcttagccatttcctttttccagttagtactgggcccacctctgccagtctagcctttgggggtgtccagagaatttatgcattccctctgccctcccatttccttccagtgtcttgccccttggaatgagttcaggtctaacctggggtcctcctgctgcacttctaggcctttcccccatgcctcttgtggagtagtggatgatggttgacatattccaggctccttgtttcctgagcagggctcaagtgcagagagtgtcaggggggtgtggagaagggcaatgattctcagaggcctggcattcaggagaagacagcttaggtgatgcaggaatatctattccaattcactaagggttatctgctctggcaagttataaaataccatttccactgaggctgtagaattacttacaggagccacaatgcaaccagacaacctttcaatcaagctgcctgttgttcccgcttcaaggctggtgaaataaatactgagcaaataaagttagccggcatctgagcattttaatgaataaagagtagcaagagggctggggatctgggagcttctgtacatcccagtggacagaccacaggagactggtgtgctagctccaggcagggtgcctcctacctcccaccctcaccttccacagcccagccccctcttcctggcgggtcttcctcattcttctttcccgctccagtccataattccatcccttgtctcatgtggtgcctggcggtgctgcctatggacgaggacccaatcagaccaggggacccagtgacttctcctatggcctcagcgaagtgcatgctgcccctgagtgattgacattctcaacacactggaaggcctttggggtcagcttattgctctctataaggccagggtcagaaaggctaaactccagatgaggtga

SEQ ID NO: 67532 - DNA, 1041 bp, Homo sapiens
aatctgctgcagtgccaccctggcttactcagcagatggcttgaacactagatcttgcgaagaaagagtggaggtcttgcttggtcttcttccttccggaagcctcttgagtttctcaaatgcatggctctacctccctcatggtcacatacacctggggtagggcagcctttccaaacagagacagcatcctgaagggccctttgcttaggtcaggagttacccactgaccttatatttatataaacattaaagtatactatgaaataaatataaatgttacctaagggattttttcctatactaacaacaacaaattgccccaaggtgatgtccctcctctcccttcccccacacagaatatctggcttaatggtttaaatgccacttcctaaagcatccagtcacatacacacacacacacacacacacacacgcacacacacacacagagatacacacacaacctcattcaatctttacaaagtagcgattattaccctttttctagatgaggaaactgaggctcaaagaagctgagcaatctgcccaagcatttcaggcccagaactagtactcttgattcccacttcgtcctgcttctcgtgggtggtgtcctatggctgcggtgccctctggggatgatccatcagggaggatggccagcctggctgcctgacctgggctgaggatgtcaggcactggtgaacttcttctgtcactcaatatggtggggagtgcatgggacctgtgggtagggcccagctggagaggctgcaggggctcaactggaacaggtggggaatgtggctgcctctgctgggacctgctgcctgctgcctccctacctttttgttttgttttgttttgttttgttttgttttgttttgttttgttttgtgtagcataaccatggcctgtttcctctgcaggggctcccaaagcctccggacaattcccccaacccctggaagatggggttcaggggccagccctgtgtctaggccctgggaggcccggcctccctcctcctgcagacct

SEQ ID NO: 67533 - DNA, 1154 bp, Homo sapiens
tcctctctctcaccactttctccctggcttgtgctcctcgtctgtgctatgtaagaccatgctgtcactgcttattgacttctctgtctcccctatggactagaagtgcctcgagggcaagaaagcatgtcttattttctctgtattctctctcctagcacagaggttggctcaaagcagattctctgtacctgctgaatggattgatggatggacggatgggtggatggatggatggatggatggatgaaagtggagtgagcatctccatagctatactcccagaagggacacatgggagacagggagaggccacctgaggccacaacatcacaagtaacccagcgacctcatgttaatcgccatttcctgacataggtctctgggtatgtcaaggctggattctccatagcccattctcagagacaagaccacaccctccccaaaccctcagcagccttctcctccaaatatttttctctgattcgagtatgttgactctctgaagacagaataggatctgaggagagtaaactggtccaaatgctgtgtgcgtttgttgataaaccaattacctggaactcagtgtgtgcacagtccaaggaccctggatgctgacccggctctccaagtccccagcttgactccctgtatggagctgccctgctttgtctctgccctgggcatgctcctcaccgcccagtcacctccacctcctccaagctcagagtgttaccagatggacttgatcctattattttttagagcatttgagattcctgcattagtgaataggagggtcccacagccagccatggggtggggccccaggacagacccagtaccaccagcgtcccaaaatgggcctctggctcaacctagggatttagctctgtctgtaaattgcaccatgtttgtcctgtcatcactagattgggagttaggagctctgggtttgacctcaggcttcctctctaaggtagcaccgtctacagtcttgggttaagtcatttcaccactatgggcctcctcagtgtctcagtctgtgaagtgagggcctgaactcaggattgggtttcgcaattcctcctccatgcatccctgagactttcctagacccagtttctataggtgagtccctatgagatgatgtg

SEQ ID NO: 67534 - DNA, 1051 bp, Homo sapiens
agcataacgaggcaggcagataagctgttcaagaactggcctgtgaagggagggagccattccggaggaggatggacatgccaggacacctgtctcacatggagtgacatgagtctgtctgggtgctgacatcccatagcccccagccccagtgaacagggcatgctgtaggtcggtgagactaggagggccgggaagaccccagtgctgaccacctgcatgggaagggcagagggccagagggttatgtgctgcccatccctgtcccccgccccaccctgtcttggcctcaaggggagaaaagctcccttggggtggaacagcttcagctccctcggtagcctgccctggttttgtttttgttttgcagtcaggtgttgttttttcttaattgactttttaatgaagtttaacacacatacaggaaagtacactgaccttaagtgaatgtttatgaaatgaacatgctcacgcagccacccccgccccaggtagcctcaccagccctccgtgagcctcccacgtgcccctcccagctgtcatcccccccacccagatgaccaccctcctgaggcctgtcaccatggattagtgttgcctggctttgaacttcatacaaaatggaagcgttctcttatgcctggcttcccccactcaatgttgcatctgtgcggttcgctcaggaggtgtgctggttgtcttggtaatcactgcggctgtcaggtagccccttgtcctggccacctaccctctgggcagcacgtcctctgggttggcccgccctccctgctggggtgagacaggccctggcatgcaggggaaggttggggcccctgtacatctcagagctgacatgcttctttttgtgacttccttcccctttgcctgtagttttgggaaccttctgtgccccctgtggtctcccgtgggtctccaggtctagaatcaaagccaggcatgctggatggagagtccccttcctgccctctggctcaggccagaataggttgcacagacccaggccaaaggcaaggttggtgtggactttgcc

SEQ ID NO: 67535 - DNA, 1060 bp, Homo sapiens
tctgcggtgcttgatttgttatggagagaacaccggttaggggaaaggtcaaggtcagcaggcagaggccgcaagaggaagcatcagtagaagcaataaaggctggggtggtgaagactcaggaagggcaagggagggagagggcggtgaaggccagagggtggcaaggagtctggctgctgggctcaggggtggcagttagatggcaagctcttggtagactggattcattcttcattcattcatctaccacttatggagggctctcggggagccgctgtccagaggcaggacaaatctcgctgacccatactttctaacccagtgttattttgtgctgtgttggaggcatgtccaaagctctaagggagcccaggcttcccagggaggttccatggaagacctgagatttcagccgagtcctgaagcctgagcaggagtttctcaggcgaagagtgggactggagagccattctaagccatgggaacagtgtgttgcaaaggcctggaggagtaacagagccctgtgtgtttggggagcaccctagggtccctgggtcagggcatggcaggaaaggttgtcgtcccaggttgccagtagcacactggaagctgggagtgtcagcagctgctaggggtctgaggaggaggccacgttggcaggtgtgtacaccagaaagatgcccccaatggcagcgcggagggaggcttggatctgaggagactggcccctctcctgagggcttcaagcacttccccaggtaccactggacttctcttggcctcctgggtccaagagaagacgagaggcagagaggaagccacagagcagcgtgccaaggcactgcacctcaaccacactaccagctggggacagctctaccatcaggtctcaggtcccaatctcctaaccctggtctgcttccaaatgcccatatccaaggcacctaacacatttgcaaaatgctggattataataataaaaattcacttatatagcactatgtgccaggcacttttttttttttttttttttttttgagacagagtctcgctctga

SEQ ID NO: 67536 - DNA, 1062 bp, Homo sapiens
tgcgggaccactcagccccaggcctctgctgttttcacaccacctctttctaaaatgatgccgcccatattcctctccttcgtcaccatcatcatttattgaggctttactcaatgcactttctttatgcactgtgctaagtgctctgtagatcatttaatcccaacaacaaccctgggaggtgcattttaaatgtattttcatttccctttcaaggaaacagaggcttagagaggttacattgtctgaagttgagagctaataagcggcttaggcaggactcagccaggtctgtctaccctccaagtccgtgcagttacttgctgtgtccccaccactcccgtgctcccacccctgccaccatcctggggccacagctcccctgggacagccatgggcaaagtgacagggcagacctagagactcgtttttgctggctcactgggcacccctgtgcgcaggctctgtgctgggccctgggagagcctgctcagtggtcctgggtgtcctcgccgcaccacagggccctcgtgctgcagcctcatccctgacactagaatttgcaaggtttcccaacggtgacagaaataggcttcttctccctcattttcagactgggaaactgaagtccagagaagaaacagttcttagcagaatctcacagatcctttagcaaacctcagcatcctgactccagacccattgtttccccggggcaccctgctgaataggcccaagttccaaccaaccaccaaagaagacattctcgggctgcctcaaagatgtcttctttatccagtgacctgctagtgcccctttctgcaaagtgcactggcctggaggagttctggattaagcttcttaggggatctagcatcctctcctgacctccagggctctctcttaactcacctttgagtaaaatgatgtgctgtgagatacacttaaaattgtgtgttccccagcccctccctctctattggtgggattattaatgagaccctaacatgagtcacctgagtaaataaacataaattgtcgttccacccctaggctttggct

SEQ ID NO: 67537 - DNA, 1060 bp, Homo sapiens
aaacaccatattcagggtagcgcttacctctgaggaggaggcgatgggctggtggagggaaatacaactgttttcagaatgtcttctttcttaaaatgttccttctaaaaacgatctgaagaaaatatgccaaaagaaacatgggtctctttccattatttttatgcttttctgtatgcatgatatgttatcattagaaaacaaaccatttcaacaccatgtgcaaagttctaggatggtggaggtggacttcgcatcccactatgataatctagggctgggggaatgggagtgcggagataggaggttgttggtgaaagcgaggtctgggggctgattctggagggctattgttgatggagatgggaggggtcaggtgctcagcagtgccctctttgccctatttatttcctgccccctcttccagggccaccttgagcagggcttggtgctctcaactgttgtaaaataacaattaaaagtggtataaatacaggaggggaagaaatgtgtctgcctcgggatcctgttgtaatctgtttcccagtttaatgagggcctggagactcagcatgaggccactgaaaattaagaatactgggagtatttatggggctgcgaggccttcttttttcactgctccctgtagctgggggtgcaggagtgacccagcagccctctgtcctcccgtccagagagggagtcagtcagtatctgcagcctgtagacaagagagtgggcctgcggggcagggatgggtggcctcaagaggcccggatgatcgccctcatggagaagcctactcccaactccagctcacattacaagagaaagttgggagtcgaggtcatagccaatagggaaacttgagagagaaatgtgatcccctgcttgccttccagccctggggacgaggcccccctcagggtcggagaacagagggtgtcctgggcagagggcggggcagggtcaacagctgctgccttcttgctttagctcttaaaagcacctaggtttgttccaatgtatcctgaaacaatgatctcccctgtcctgcccc

SEQ ID NO: 67538 - DNA, 1030 bp, Homo sapiens
tagtctttgctgtgcggcctgggaggtctctgtgaggaatgagaacataggtgtgatcgtaggtgtgagcatttaggagggcagacactgctgctcttacacagagggtcacaggctcatgggaccttcagggctaaaggcctgagggctagatggggaggatccagaccctcatggtgggacagagaggcagggacgcccttaatgttaccccctaaggccaaagcccaagcctcccattacgctcttggcttttgtggtcctggcatcttgctgtgtgcagaagcctctggaacttaaatacgggtctctgtagctgccaagctcgactttcacagtggaatagcaagccggttggagccaggcacagagcttctgcatcccagtatggagggcaggaggggccctgggcctggacaaaggcctctaaggttgaggtgtttcctctcacacttagtgactcctcctcttcacctttggctcagagcagtttggggctcaaagtatgtctgaatacccaagcctttagggtcacaggatctgccagaatcctgaagagaccgctgagaagcagacaacggaatgggagaagggcctgtcgaagtgggtggccatgaaggcggccgtgcatgtgggtggagtctggggctctgccaggtgtggagtgagcttcattctatgtgagagtctgggggcttctctgagactttgtaacaaaggaatcccttctaagagcgtgtggctggggtccctcttcaccacccctcatagtgggacacagggaaaagacttgcactgagaatgttccagatcctgctgctactgcccaggcctaggaaagccattttgcaaagcctgatggagcatggttgtaccccagggcctgcgcccaggaagggacacaaaaccacagcttctggttccgtcagcctgtagctgtgccagccatgtctgacatcgatgtcatcccctaaatctatctaaatgcctaggttggcataagcaacaatccgttgattggatttttagt

SEQ ID NO: 67539 - DNA, 1502 bp, Homo sapiens
tataaaatgggaatgataaaacctattgcacatagaatccttgaaataaaaattgggcctctgaggagactcaaattcttagatgggaaaggagtcacctaaatgcatcagagaaattgcccatctagcttcatgcagttgtccaaccttagacctcacctccctcgccctgtcttctccatcatctggcatcattactcaccacctgtgctcccctttctgggtgctgggctagaggtggtaagctaggggctgcagccacccaaagaggtggtggtcctggagtcacagatggagagtgaatccacctaactatgatcttgagaaagctacaaaggactgtgcaagatggatcaccaccatcatgtttttatctcaaatattccatgataataactgaatagaatgacagaaacaaagtgcctaggatgtagtattaatctctagattcactagtaccttgcagggtacctgataaacattttctgttgagggaaggaatggaggtgcggttttgtaccaacatagtaaataactccacaaactgcggggtgtctaatttgctccaagtgcttaagccctggttcaataataactattgtctctcaaatgatacagtttataaagtgctttcagatgatgtcactggctcctcaaaacagcccccgttaccttgcccattttacaggtgaggacacagaggcagtgtggcttagtgacttgtgcaggcagaagaggagtgagaggggaggcaatagacatgtatgagtccataagtgtatgtagggtcccgcggcaggcacctgcatgtcatctcatttaatcatgcttggaaccctcggagggaaacatgctacccccattcttagatgtaaagaaaatgagattcagagaggctgagcaatttgctccaggtcacacagattccaagtggcaaggcttgggcatggaccagagcttctgtacccaaagtgcaaccttcttccttgtaacagtgactccaggcagagcgctgtcctaggaactcccagcaattactgtttccctcatcaaggcagtcagagagtggaaaaggcagctggtccttaatttggctgttgtttgtttgttgtttgctttggtgagaaaggaagcctcggactcagacatcttgtattcttccttgaagtgtggagaaaatcctaccttccaaagctgttaagcgtacgttgcaggttagtgattacaagaaagcactcggaggcagcaatgggattctctccctaaactgagatgatactcatagtggcaagaatggtttgtaggaaaataagtgatcagttattgagctcgtccgtgataagtgcttttctccatcattttatttaagcttcacaggtgccctatgtagtccgtattattattattcccattttgcagatgtggggcctgaggcacagagaggtcagccttcccaaggccataccctgaggaaatgacgaggcagaatctgagcccagggc

SEQ ID NO: 67540 - DNA, 1070 bp, Homo sapiens
tctgtatcactacgtgtgatggttaaatgagttggtgctcatttaaatgaggtgctcacttcagcccccttgacttatagaaaacccgcagtgaggtttccttgaagccttttattgaaaaataatatataaaggaaagtgcacacattacaagtatgtagcttgatgaaattttacaaacttcaactaacactgagattgagaaatacaacatcagcaccttagaagcgttcctcaagcttcttttgtgacactattcccctaagagccaccactattctgatttctaacaatgtagatattttgcttatttatgaactttatacaaatggtgtccaacggtgtatattgtctagaccttttgctcaccattctgcttatgggatttacccctgctgctgtgtgtggtgggaggttggttgttctcactgctgcctagtgttctatcatgcaactagaccacactttctttgtccattctactgctgaggggatgtctgaggatgacatatctcatgagaaaaggcaatttggtaaaattcacgatgaaagacttttagcagtgaaggattttggtctttggaagagtaggtggaggcaaggaggtagggtttctcaggtggtctattttaagaaaaaagaaagtcttatttctctggattatgtcgggaggccaaggggacagctaagatcagccattcttcactaggacaccagggtacactggtgtctcacaatcaatggtaaggtgggtctcggatcattataaagcactgacgttttgggaatggttttcaacttagaagagcttttcaacttaaagacccagcccactgcaatggtgccaggcctaggtcacaccatcttttccagggactgtgttgggccaaccagggagagtggttctgggaaaggcctcccaaccagcatgtggtgacagaccctctctgacttcttggggtccttttcccttaggtacacctctcataagagcaaggtttaaagtagctgggaacgggagtgtgtaggggtgaggtggggtgagagctgtccttcattccattggttgg

SEQ ID NO: 67541 - DNA, 1290 bp, Homo sapiens
gaaacggtgccttgcacacagagtttaaaaatgtagccatcaactagctttccctattgcttcctattcatctatctattgatcgatctatcatccatatctatctatctatctatctatctatctatctatctatctatctatctatctctctatttatctatctatccatccatctgttggtgcctccccatgcacctcctcccccccgcagtgggagcccttccatccacactgcagctttgtttgtgaccagggtaaatattacctggcactgttaatgtttaatgcccccacctcatccccagccaccccaccaaggagcaaagacagcaggaagaggcaagtggagacagtccatttgggtggggaaatgactgggttgtcaatggatagatagatagatagacagatagatagatagatagatagatagatagatagatagatagatagacagacagacagacagacagacagatgaatttatttaacttcccacttatttttacatctcttattattcccgaaagactccatggaggcttacaaatacagaccaaatgcaataagataacacaatcctgtataataaagggagcacccttgtcttgtgtggagatggcagtagctttggtagcacatcttggaggatctgggctttctacctccagtttgccattaactgtgtgtttcaggcaagtcccttcaccttcctgccctcgttttttctggtgtacccagtgccctggccacgtccaggggctattgtggaaagcaaatgagcagcctcaagtttctttatctgtaaaacgccattagtaggaattaagtgatgcagtgcattccaagagcctggcacgtggtccatcttcaccaaacgctggctctgctgtgatgtttgcacgaatatatatttcttggctccagaagcagaagggagctgaacgggtattgcagcgcctgatctgcagggccatgccattctctccgtctcactcattcgtgcccattttcattggagggtggctggcttttccatgtccaacagcaaacatttgccaaaggctaatgcttgtcatttcttcaatcaacacacatataacagtaaaaatgatgccactcaccgtgtgccaggccctgggatatgctctttgcatgcattatctcacttcccctcaccaccaccctaggagctgggtactgcgcccattttacagatgaggagactgaggcacagagaggtgaagtcattgactgagaccacaccattagcaagtgagagggcca

SEQ ID NO: 67542 - DNA, 1877 bp, Homo sapiens
agactgagaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagccgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtggctcggaggtgctttcctttctgtgaaagaacttgagtgtttgtagggtctgtggaacttaaagggctagagggagtccgtccatggtcagagggaagaggaaggactggatagccacccaggcaggcacagagccccgtcagctgctgtcactgttgcctcctccccgcttctcttccctcctttccttttcttccttcactttcctctcct

SEQ ID NO: 67543 - DNA, 1189 bp, Homo sapiens
ggcagggagtagtttttaagccccgcaagctcactgcgcctctgtggatttgtggcctgaaccctgggattcagacctgcacatcagtctctagaccatattagcaagtgctggcctcgtgcaagtcatatgtccttccttggtctcggtttctccgtgtgtcacaagaggaaaactgaccctgccttctggggatgatgtaagaatacaaaggggcaatgaatgtgggtgttgcatgactcagagcctcactgagtttcgatgccttcactgacctcggcccttagggttcccctaaccccctaactggcaggcccgccctaccgtgcacctctaggcatctctgtttaatgggccctgctcctctggaattcctttgtggagactgaggtctgtgaggcaaggttagatatttgggaaccagtttgtgtagctttctttctcttgaccaactgtttgtttttgcagcagctgaaaaggagaaggaaatggacccttttcattatggtgagcgatggcaaccctgggtgcaggggtcagggggaatgcagccctgcctggcaggaggggtagggggaacagacaccctctccctggccccttcctctctcacccttggttcctttggcagattaccagaccctgaggattgggggactggtgttcgctgtggtcctcttctcggttgggatcctccttatcctaagtaagtttgttcttttgctcactctgttaagagcaatgactgaggctgctaagcaggtggggacagtgtgagagcctggttggtccctctcctggagaggaaaggaggctgcctgccctccgtgttatcttcacgacccagtagagtgctgggcacatagtaagtgctcagtaaaacagtgacacgggaacaaagaaaatgtcatatgacaatgagcatagataggaacgagcagggtggcttcccagtgctgtgtctatagggcatgaatggggcagtcacggaggaaggagacaggtgctgccctagtgtgcgagggatgtgcctccgagtttgttgttcccacatgagcctgatctgcacagatccctctttactcacatgatcaagagggctgtgggggtgtagccattccagctatagaatgtatttcctttgccccagaagaagctaccccatccgagggccactgtgtgcagctgt

SEQ ID NO: 67544 - DNA, 2141 bp, Homo sapiens
ctattcccagggggcaggaagagccctattgccaacactgcactccctcttccggctagagctggtcaagaggccactgtgggaagcctggtccatttgtccttccctctctcacctcacatccaatattcacaccatggcccctaagatttgaaggccttaatgtgttgtttcatctaccttccacatcttgactccagtctccctcctcactggctaagcaaggagcaggtgtaatttggagatgggacttgggctaggaagcagcagtaaactggagaaagaaagagaaggagagagggagggagggaggtgttttacagatagcagatgctcaaaacttaccttatttcatactttgattgaagatattttaggactgtatgactgcctgaatcataaggggactttccactttaaaataattaatcccaggtttactattacacagcttggtttaaagaaggaatgaaaatcatccaatcttaagtcaccgttactctccccacaccaaacactaccaaaaagacaaaacaaaacaaaaaccccatgagataactgggccaggcatggtggctcatgcctgaaatcccaacacttaaggaggccgagccagaaggatcacttgaggtcaggatttcgagacccagcctggccaacatggtgaaaccctgtctctactaaaaatacaaaaattagctgggcatggtggtgcatgcttgtagttccagctactagggaggctgaggcaggaggatcactcaggaggcagaggttgcaatgagccgagattgtgccactatactccagcctgagtgacacagtgagactctatctcaaacaaaacaaaacaaaacaaaaactagcactggagtatgtgaagcttagccagaacttaagccatagttactcttagaatgcaccctcattgacattactgcattctgtaggctaatcagcattgagtccagcaaggttgggaagccaaacctgagactacctgcatgaagccaagaacccttgagaggggctaaagtgatctcaggttggtatctgctgcccccagcctccatgaaaaagcaaagcaaatgctctctgaaagaaagtgtcccattttaggactaccaatttcccacagattaaaatctagcaaatatgagctcacaatcgaatatattaccaaacacaggaaaaaacaagtcactgtgattgaaaggcacagaaacaaaaagtagattttgacccccaaggatttaagagtttggaattatcagatacagaatataaaataactgtaagaaatgttgaaagaataagagatgagaacacaaaatgagtgaacaacaaagactaacacaaatgcccaggcaatttcaaaaagaaccagatagaacctttagaaattaataatatgaccattgaaacacaaaagtaaatgagtgggttaagcagcaaataaaaacagttaaaaaggaagtcagaaaatggaaaacaaatatgaaataattacctggaatgtagcatagagaaggaagtggaaaatatgaaagagcagttaagcgatatggagaatagaatgaggatgtctaacctgcttctagtcacagtctcagaaagagaaagtggggagaatggaggagaggccatatttgaagagataagaatttttcataacgatgaaaaggatgaacctataggtaaaggactttcaagtctgatgaaactcacgacaatcagttctatgttgtgtttcagacttgtgatgaaacccacaacagcaaacacaaaaagaagaaaataaaaggaggcagagaagaaagataggacatctataaaggaatgatgatataagcagcagacttctcaacagcaatcatggaagccagatagcagtggaataacatcttaaaagtgcagagcaaaaataattatcagcctagaattgtgtacatagccaaactacctttcaaggttaggattgtattagttttctattgctgcataacaaacgatcacagacccagcagcttaaagcaacacatgtttattatgtaatggtttctttaggtcagaggtctggcacagcttagctgaattttctgcttcagcatcataccgaactacagtctaggtgctggcta

SEQ ID NO: 67545 - DNA, 2152 bp, Homo sapiens
atccctcaccttccctgaagccagcactgtcacctcccatctccaatccaaggaggctatcagtggcagtggcttccctcctgccctctcatgtccctggccaccccattcctgcagggcctcgccctcttccctggctccagccaggctaccccccttccctttggcattggggtgggctcagccttccttccctctgttcctcctggccactgctctgccagccctgttctgcccacctcccaatcccagcacatcaaaacagcagtcaagagtgggaaatgcatgttctgagccctgccctgcccctaaataactggatgaatcaggtacctcatctctctttgggccccaattttcacaaataaaaagcaggagcccaatcactgtaaccaactgtgatgaattctgtgatgctaactccatctggtagacctcacatcttggttatactcaatatatacacagtcgaatctttttttaatagacttcttggttgcaaagatctagatacgtcataggctaaatcatatccctttgcatataataatagtctagggtaaccatttagactaaactgtggggcccaggcattctgcggcctcataaaaggccccattccgggacgttctgtatgaagtgagacctcatctttcttagcagggcatcctgctaagacccaggcccggtgacccctcagagcttgtcatccgtgggctgagcctgcaggaaggcaagcaggtgggatgccaggggaggcgagtgaagcttcgggagcagggggagggagggatgaggatgagataatgaagtttcactgtaatttggagcctctgcattttcaagggaggttgtttctgagttattttcacaatggaactgggtattctgatctacctcactgctgcgtggaatcaaaaataatagagcatgttgctatatcatcaactagtggcttctctttctgagcagtttttacccagcaattaagtgaaattatgtgactcagtatgggaagataattgccggagaaactcttctgattgctttctcccgcacatgcagccagcaaccaagcaggaggatcagagaggaaaattaacatggaagtgctgcttccacccagaacctcagctgcttgccaatatggagataaacaagagcacagaaaggagaggaaaaatgagcggaaacagaattcgttctcataatacaccctagaggaggcagcaacgtgtgattggttccattctccagatggggagagtggtccaaatggtctagaggggaagagttggggagcaagagagtgaagcagccagggagtcccccactccagcagtgatgatttctcaggccccctgtgctggcgagccaggtcctcaggcccccaggcaaaggtccagggcccagtgcgcaggtggcggtgcatgccctgttcctgtgccctctccgctcacttcagccttggatctccttcccccagtgactcctccttcctgtcttccatctactccttagaatctctcgcccggaactgagatttttcaccacccagcctcttaccctccccaccccagccagcctccagcagcccagcttcctctctggaaggagggagaaaggaatgtgtggtcactgggagggtgggaggtgcagaggggtggtatatgagatggaagggaagccaagctgggtgcagcagtgagacaaaggcattctgtggcccttcaaaagttctgtgtatgtacttggccactcgactcaggggcagtgccaacgtaccaccgatgagatttttaaaaatgggtttaggcccccctcctccccgctcccgccaccccgaggggcccatgctgaggtgtggttgatgtagcccaggctgggacagcagcttgcaggagtagagaatgggtcacttttcaaatttgtgacagtatttcttttcacactgtcacttgatcagaaatgttttctttagaatacaaaggcaggtcttaactctttagcttggcactcaagagcctctgcaatctgattccaaccatcttatctgagttctcaccacccaccccatcatgctttagtccaactgggttgttcactgttttggaagatatcttacactagaaatggcagctatttggtaggt

SEQ ID NO: 67546 - DNA, 2973 bp, Homo sapiens
ttggggcctccaattttatttcccttagttcctgcccatttccacatgtgccagggaggcagcaagaaagagtggaaggtgcatggcaccagcagaattagtgacagttccaggtatgcttttgttagctgttgggccttgggcaatagcataagcctgagcctctccttttctaatctgtaaaatagcagtaataaccaacatcccatggagttgtgatgtttctttgagctaatgcttgtaatgttatctggtgaataaggtgtcttataaatgactggtgtataacatcatcacatcatcatcatcatcatcatcatcatcccctttgaccaatgtgggcagggaacaggaatatgcaacatgtaagacacagcagctcccctttctcttttgacagtcacagatacactgaagggcccaggcctgagggacaagagttcctatcttgatacatcttgccgtgacctcctcaacccaaggaggagggaggaacagggccatcttaggaacagcaccttggttttgcagaagtccatttggccctgcctgtgtgtctcagggcccaacccttctagagagataccctgaaggggccctttgtgggaggcagtggcttctccttgaatgaccttggtgaaggaagaagattgggcatggtgaccagaggaggtggctgaggaccttgtgggctgggcctcggtctgggatagccgcagctcctggtctctttccagcagagacactgtgtcttctgggcagcggccctgtagccagggaagggcgtgagttgttttctcccaggaacagcagctgtctgttgacttttccttctcataccctgccctggtgcattttcctgtctctgcttttaggtgcatctgtgtgagtggggcacgcagggcatggtggaggcacctagggcatggtggaggcacccagggcagccgaggcctcagaaggaggaggatgacgtgagggcttgcttgatgcttcctctaaagccaattctcttctctcagcagcctccacctctcctggcttcaccacctgtgtccctccttcccattttccagctcagtttctgcggggacttggcccctgggccagcctctcccgtctcgaagcctctttctttctctttcctttgcctgcctctcccacttcctctggggcatcgccttttcagtttctcctcctccgggttttctctcctctcctgctgcctcatgtcctctgtctgtcttgcttctgtgtctctcgtgggggtgccctcagtttgggcctgggaagatgtgtcccttgctttagctgtcccagccagatgtgtcctccctgggccacatatctgcagctctggatgacataggatgtttgtcttgaggcaggaaaaggcagtggccgggagccagtgtcagctgtgggccgaggcccctccacatcctgtgacctcacgaggaccctccacgtcctgtgaccacacgaggaccctggagccttccagtggttggaggacaatgttaaaaggaagggaagggggaggaagtaactgggccctctccctagcccctatctctgtttatctttccattttcctggaaaaggtagaaatgaaggaggaagccaaggacagagttgggcagtgatacagtaatgatactaacaggtgatgcttcaccagcagttactattcgccaggctgcactcagctccgtccacaggccgtctcttttcattgcaaatgacagcaacagaactccatctaatttagttgaagcaggggtatcagtttacagagccagactcgggaagggtggggccctctggtgtgggaacacaggagcctgaggcacagctaggaagctctctgggcccctcctccctgcctctctcccctgccagctctgtacctgtcagctattggccgacttctcccccaacagactcctcctcctttcatccggcaggatgctgaggtctttcctaccatgtcttttagctacagggaaggagctgagattggcaggctcccatagaccagcagggttcgagtggggacagagcaggctcccttccaaaaggggatgtcattcacagaagaggggactgatgtgggcacaaagaccacctcatctgaccctcactgatcccgagatgcatgctgttaggcccatcttgcagttgcagaagccaagactctgagaagccaagtaacgctcccgaggccacagagccactgagtggcagagaggagggagagctgagtgctcagagcaaggaccctggagccaggttgcttgggattgaatctaggctctgctactttctagctctggaatttggggcagcttacttaatctttctcacctcagtctgcccgtctgtgtaaagggaatgatcgtaataatagttgcttcttaggactattgtaagggtagaatgagttatataactatttagaacaacacttggtatggcatgagcaccttacgaatgttacatgttgttatcagggtgttttacagtttacaaagaaccttcacacctattatctcacttgaccttgatcatagccttggaaagtggacaagggaacggactggcagattctgcactgattctgcgctgcccgcaccccatgctctcaccctcggcctaatcagcttcagggttccgtagcctgtttttaaaaatcccccacccgagtaaacagctctctgttcaacaagtgagtatcaatgctttctcaggggtgagctggcaggattgtacattctgctgtctctctagcgcacgaatatgtatgaagctagagatgctggaagcttggtaaatgttcatccagatgcgggagcccctgcattgtggctctctgcgcagagctctctcaggtacctgtatctcgctgcctcagcctgctggactgggatgggaatgagaaaacagggtggcagctacctagaaaaggtgggc

SEQ ID NO: 67547 - DNA, 1266 bp, Homo sapiens
gcctggatttgtgatttgtgaattctgtttctgtttctaaggaagaggccttatttcttttcacagtcagttattttctgtctctctctcttcttcttcttcttcttctttttcctctgtccaagtttctcttccctagaaagaacttcatgttttcatgttaaagataaaggtgcctccaggttaaaaataagtcccctgctatatgacaagagagttttgcctctcccgctccaccctgtgcagccgggctgggttgggtctgggccggttgagtccagggtacctgacgactcagcctccagcaccctcgcagtgggagtgcccctcttccatgaatgagggttggaggggcagcattcgagccgttgggctactgaaggcgcctgacaggagagggaaaggccaccctgggaggtgtcagccacagtgatgcgctgggcggaggtgccctgtcctgctcctagactgtccagctgccttcctggcagcttgggaaattcagcagtgtctgcagcctccttgagccatggactgctggaatttcaccaccctctgctctgtcctttcccttgccagtctctgagtccagtctcctcctcgactcctctctggaacattgctggctgggcggggcgggcaatcatttcaagttaggtgatttaacaataattgatgcttaattgtttatttgatgggcatttaaaatgcaaattgagggaactggttgcattttccactgatggatctgtggcctctggtcgacccaaagcacttgttttaaaaggcagctttaaaagcccttgatggttgtttgtttgctctgaggctctgaaccagagaagcccagctcctgttacagattcatcaaatgccggaaaggtgagcaggagccggagtgctgggatggggttgaggattgcttttaactgaatttttgaatttttattatttttctacgaatagactatctttttagaacagttagatttacagaaaacttgggcagattgtatgagttccaattttctcccctggcatgcagtttctgctattattacgatcttacattagggtggtacatttgttacaattaatgaacaaatattggtacaataatattgactaacattgacactttattaaaatgtcgttcgtttgtaccttatgtcctttttctgttctaggatcccatccaggataccacactccattgagtcgtgcctcttttggtgcctctgggtggtgaccttttctcaggcttcc

SEQ ID NO: 67548 - DNA, 1266 bp, Homo sapiens; identical to SEQ ID NO: 67547

SEQ ID NO: 67549 - DNA, 1266 bp, Homo sapiens; identical to SEQ ID NO: 67547

SEQ ID NO: 67550 - DNA, 1266 bp, Homo sapiens; identical to SEQ ID NO: 67547

SEQ ID NO: 67551 - DNA, 3480 bp, Homo sapiens
cggagctccaggtgttaacgagagccattcccaggtgctgggctccagaagctgggcactgaccagaatttcaatctctccactgccgctgctcttttccctgacccagagaaagcctgaggctctgggagtcatcctcaccagcagaggatcaggccagctctgggaccatcggaggctctgagccctaacaaaggagagaaggaaaagtggttactgtcccaggaaagccaaggaggccaggccagggaggcaggaaggggagggaaaccagaaagagggaaggagaggggccacaggagtcaagaaagcgaaagttagggctacccgccgttgcctggggttcaggccaccctctcttcctggcacgttttcctgcttcccccctggctcctccaaacagatctgtgcatctaggagaggaagcgggtgtgcaaagggctctaggcttgccagggttctcccaagacgtgtggcttctatggttgacagacggtaggcgcctgggggaagcgtttccttcctggcttccatcggatcttcagactgacctgaggaccgatttcattcaatcattcaaagaactgttttaagtgtctactgtgtattaattgctggggacatgaaggtgaggagggagacacaatccctgacatcggaatcctaggtttctcagagccggaagaggccttgagggagcatccagtgggaacacagtgggggaaactgaggctcagcagtcacgtggccagtagtcgctgaggccttctaactcctcggccaggattttggccttcacactgcctgtcctgcaacccttgctttcttttctcagtcaccatcagagatggtgggttgatggaaacctatggagggagagcctttggtcggctggtgactgggacgcccttccaaagtgagggtcccttagtgggcgggtacaaccgaggagcctgcttcactatgttttcttggaaggcgaggctggaagctgtggcaaggagatgggggagaaagggcagtttcctagaccctggaaatttcccgacagcctcgggggagtccacccaccgaaatctcccctaaataagagcacctcctctcttcctcccaaccttgttggacttagtcggccgccatctggatggcagactgtgccaggcagccccccaatattcaccttcgaacaaatcaccttctgagcaccctaagggaagcaaaccagtcaagaaaggcacagccccaaggaggcagggagcctgctgtggaaaggccgggttctagccccagctctccccctgagcttccgtgctaccgaaaggcaaatgcgttcattgcacaaatatccctttggatgcaaactgggcttctggtgaaatccagaaatggcttggactgctcttcagcaactgaaagcctttcggattttagacctttgtttccgcatctgtcaatagtggggtttagactcatgatttccaaggcatgtcttcctctaaatttgtgtggattatacaatcttgaaagagatcccttttctctccaggtaccaaatagtactcattatttcataatacagggctgcagctgagctgagctgagcaggaaggggctgggctctggttaccctggagaaagtttccttttcacccagtgtggcagaaggtgccctagaagctgaaaccaagtttttttctttagggctgagggagccacctcctcctggatgctgtggtctacctggccttttctaccaggctgcacactggaggcgggcggcggttggggggggttctttaaagagttgttctctggaagagacaactggagaggactgggctgtcattttggaggtccatgaaatcttctgcagggagaacccctggccagctggagagttgcaacgagaggggccggtcgggaacacagtgctctgacaccgtccctgatgagaggcaggacatctccggccgaaacaaaagcatggaaccaatttggcagcatcatctctgctccagaatccggggagggagaggtcccgacctgggaagggatgaagccagcttgtaggctgcgcaggaacatgtttgttacaaagatgtgggagggagcacacagcctgggaaaggggctgggcccccacggaccaggctggggccatgggaatggggctgccccagctcagaatatctgatgtgggcagagagggccaaggatgaaggggtgtagttagaataacagtgacccccacgcagctggaggacaaagccaggcccacactgagagaccagaggctaaggtttcaaactccctcgttcatccttttaataaatgttcccctcatatgtcaggcaggccctgtgggcttctgaggtttctcctttgctggagccctcctgctcaggtagatcaatgggcttgtcctgttccttcctctcccctactgtccacctcatgtccacatcctaccaggaggccctgcgactttcttcctccataggaagagcccctccatgcaatcacgggtgcacttacactctcacacacgttcccttcctcacacatatataatctcccacacccgacagggaggcagtggctcacacattctcacacgccctgtcacctctcccgaagagctgcagtctctcagaccatggtgatggcctgtgaacgtccaccctctcagcccattccattttacccactgatgttacagctcaggtccaggtttgccactcctctgctcaaaaacctccccaggctcaccagtgcctattaataagcacaggtacatggtgtaggcactccaggctcagcgtgacctggctgcagccacctctgcaggcaccttctccagatggtcatccgaagcctggtactgtctcaccctctgcctgagctcaagccgttgctggaatgtgccgagtagagggtggcagtctttgtagacacacaaacttggattctaaactgcattctgatgcttcctggatttcttcactttgctaaacctcagtttccttacctgtcaaatgagtgtgaggacagtatgaggcgagctgtgtaaagggctcagcatgctgcctagcatggagtaaacactcaggagatatcagctgctgtaataatgatagtaatgacacattattaggattattagaatggcattattattgttatatcatccttcgtggctcctcccaagtgtttattctttcaagtaattattccatattcccaataaacaggcattaaaattcccaataaacatactcatataccgtgaatgtcctgtcagttcttccttgagagcacacacctgcattttagctgcagagggacacgccccgcctcccaccccgcccgctccactgcaccgcctctcaatggcaggtctgttctccccacggtgcctggcacagtgtcagacacgtggagaaagcccagtgaacagcgtgtgtgctgtgacacgcatgg

SEQ ID NO: 67552 - DNA, 3480 bp, Homo sapiens; identical to SEQ ID NO: 67551

SEQ ID NO: 67553 - DNA, 3480 bp, Homo sapiens; identical to SEQ ID NO: 67551

SEQ ID NO: 67554 - DNA, 3480 bp, Homo sapiens; identical to SEQ ID NO: 67551

SEQ ID NO: 67555 - DNA, 1052 bp, Homo sapiens
ctgtttcctttccggggggccctggggtccgccattgccccctttccccagcagggctggccctggcagagcctcccctattgtgtctcccgggcttccgtggagagttgggtgtgcagcctggagctcccagcgctggcttctggctcttacaagtggtggctggtagaggaggcacccgagggtgggagctgggagcagcctcgctggaaacatgggtctgccgcgtcacctgctgcaagcctgcacgctcgcgggaccgtggctactggaggcttctccccaccagtgtgctctctgccactacttcctttgtctctgtggcttcgtgctgtctggctgggctaagatttccagctttgaagatggatcagtgggcatctcaggccctctctgaaaggagccccctttggggatccagccaccctcatattatggatgtgtatgtctacgtccgcaacttagccttttgcacgtgacttgcctggtcgttgccatggaaactcctccatttctcagcctccctctttctcctgcccattcctcacctccatatctcctcccctccccccagtatggttgcctagatactggttatccctggctaggagacctagatatctggctcctacacccaattgcagtggccccttactcacaccacccacttcacacacactgcacatcaccaacaccacaaacacatacagacatataccacactacgcaatcaacacaccctcacactcacaccacacatacatatacatcatacctatacacacatacacaccaaacacaccgcatatataccgcaccaccacacaccagctacaatgctacactgacaccctacatgcgcactgtgcatgcacacacacacacacagtacatctaaataagtctcaggctgggctgaggcaggggagagagagggcagtttccttccttatccagccacctccctaggggtgtggaggggaagagatggaggctcaggaagcccagaaggaaaaccctaacatctccctgggaaccctgcagaggaaggt

SEQ ID NO: 67556 - DNA, 1052 bp, Homo sapiens; identical to SEQ ID NO: 67555

SEQ ID NO: 67557 - DNA, 1052 bp, Homo sapiens; identical to SEQ ID NO: 67555

SEQ ID NO: 67558 - DNA, 1052 bp, Homo sapiens; identical to SEQ ID NO: 67555

SEQ ID NO: 67559 - DNA, 1094 bp, Homo sapiens
ggggtggtactgctcctggcagggccagaggtggatggggcttgaaaagggggttcaaggcagcagatctatggttcaggtaaggaccatccccccagctccccacctggctctagctgaaaatgacaactacaactggagctggctcctgcgcccacgacacagccattcatgcttttggtgcacattccccttaattaccaaggctcccaattaacgtgggctgctgtgtctggtgctgggttattttctcctatttttccgttcctcggggtttactattgcagagagacaccaggtctgtcattgtgcctgtcttgctcccttcccaccctaaccagagggaaaccgaaaagcaacagctgatggcaaatccgctccggcgcttgcacgcctcctcggcggcagtctcctgttgcttctcggagcttgactgccctttggaaaaatctctccgcccctcgagaggagagaggagcagaggacgcgcgcgagcacagagcgggaggacggacagggagaggaggagagggggtctgcgcgcggccgctacccagaagccagcggacggcagcacggagtgggctgtccccgagcccagccccgagcgagccccccccccgcccccgcaggacgcgcctcccagccagcccgactcctaggaggaggggaggcgggaaagcagctcaagcctcacccaccgccctgcccccagccccgccactcccaggctcctcgggactcggcgggtcctcctgggagtctcggaggggaccggctgtgcaggtaggcggctggggaggtgggcaaagttggctcctttttccgaggaggggcgaggctcggtggggaccgatctctggagcgccgggagcgccgggttttgtgtgttcagtgggtgtgtgcggtcctccgcggtcagctgcgccgcggtccccgcctgggcagcgggaaaccgggctggggatgtaaacaaggagatcggcgtcggaagagagaggagcctctaggggaggcaggctgtggcgctgggggtgacgctggtggctgggaattgctctcggtgctgccttgagcttggggtcagggttttc

SEQ ID NO: 67560 - DNA, 1052 bp, Homo sapiens
aactgggatggcctcgatgaggggcagaggaacaggtctggctagttctgtgttgtttatactggggattacttcacacgtcccaaccggcttccccgccccatttggtgggggctggcccttggccctccaactcctttaccctacatgcctgagaagccagggaccaagatggatcttctcctcgacatcagctaagcctggaggactcttcccctcagagaccatggagagggacagccacggggtgagtgtgacctcaggcctcgggccagattctcccagcgctgaggaagcagggctgaggctgggagacaggtgggacagctacctctgtgtttcaggtttgggggaaactggctgtgcctcttctagtttgaagctacttacgatcaagatctcttggtctccttttaacgtggttctagaaaaagcccctgggaggagaagctgctgggatttggggtctggctggtgagcaccccagggctatgtggctgagtcgtgggtttcctgctctgtggtctgtgagcactcctgccgggcatccatagtgttacagcaccaactttgccgattgggaatccaggctaatctactttaatctcatttttgctggttggaaaatcaaaagcattctaactgcaattcaggggcatcttgtctaaacccctcactacactcctaaaccttcccagaaaactgtgactttctgggtgcattcaagattttcaaggggatgtttcaacctccgttggtcacttctttttggacttaataactttcatgcttgggaagtgcttcttgatgtttaaccacaagtcctgctaccactcaacttcctttcttctgctgctcttggggtaggagaaagcagctggcctgtcctctgtgggaaagccagtcatacacacatgaaggcttccaaagatcttgttctgctgtgcctccactttcttttcctccaggaaatcccttttgtgctctcatttctcctttaggtcttgttttctgccccctccaaattctctgtaccttaccgacatggtaga

SEQ ID NO: 67561 - DNA, 1010 bp, Homo sapiens
tgacccttacagatctagatatacccttaccagagagagaactctgatgaggaaatgctggtaaattaccatttttctaattgctggtgagtctgacacttggtgagttttcagccagtttgttaaacttttaattaagttttgtttataataaaaatataaatggatttgaaagtttccatttttttaagttacctttgttttacaaaggtattttctaaacacatctttaatggactatttaactgaatttaaggaattcacacatgacagctgacaggtcttcatgcaggctgattggtaacgtgctgccagcacagggctgggtgatgcatacaccctaagctgggggtgcctggggagaagggcgctccttggagtgcccctccagctgcagggcagtgaggtgccacttgtgtgagccatcagggaggcagctggccatgggggcagagggtagcaggagcatcatggggcctttccatctgggctggttctctgcgatggtggtgtcatgcttgcctctgctcctttttttcttttttttctttttgcaattgcaagatttaatagagtgaaaacagagctcccatacaaagggaggggacccaaagaaggtagccattgctggctcgaatgcttgggtttatatctcgatcattgtctcttctgctgtgctctcaggcaatagatgattggctatttctttacctcctgtttttgcctaattagcattttagtgagctctccttactggttgggtgtgagctaagttgcaagccccatgtttaaaggtggatgtggtcaccttcccaggtaggcttagggattcttagttggcttaggaaatccagctagtcctgtctctcagtcccccctctcaacaggaaaacccaagtgctgttggggaggttggccagcgaccactctaactgcttcctgctgaactggggtgtagtagcggttgtgcagttgagattttctcaggaggatgccttcgatgtcattaa

SEQ ID NO: 67562 - DNA, 1050 bp, Homo sapiens
agggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtca

SEQ ID NO: 67563 - DNA, 1132 bp, Homo sapiens
aaagggtattattaggagatcaggggaaatggatgttgagctggcaacaaacaaatgtttaccgcattcgatttgaggtcctgtgggggtgatattcaagagagtatatccggtaacacttgaacactcagaggcagatcatggctagtaatatagattgggaaatcattatcctgttagtggttgttaaatctacaagtgaataggattgtccaaggaaaacatgttgaatgactgtatattcaggctggagctctgaggaacaccagtgtttaaagaatggttaagaaaagaatagcattagatatttgatacatactgtcagagatgtggggagacagagatagagtgagtatgtgtgtgtgtatgtgtaacacagtcagtggtggagttggttggagggaaactaaagagattctaatcttaaattgtaacccatatctctttgttctaaaccaagggttgacaaacattttctgtaaagggccagagagtattttagactttgtgggctacatggtctctgggggcaactattcaattctgcaaaaaatgcagccacagataatacatcaacaaatgaacatggctgtgttctaataaaactttgttttaaaagacattgtaaatgttttttagctgtttaccaaaagaccactggatgtcataattgatttaggccaatctggtcacacccagagctagcggcaaggtcagttgctagttgtttttagtttgttccctttccactagatccatttgcttccatttagctcatgggccataatttgctcacctttgccctaaaccaactgctcccttgacattatcccttgggtatctcagaagcaccttaaatgcatccagaatcaaactcctgttcccctgccaagcctagtacttttctagtcttcctgtctcagtgaatgacatcagcaagtcggaaacctgacagtcatccttgatacctccctttccctaacattccacagccatacttagttcaaacttcccttctttcttaatggactatcgtagtagcctcctcagtaatttccccatattcactcattcactttttcttttttttctttaagagatgaagtcttgctctattgcccaagctggagtg

SEQ ID NO: 67564 - DNA, 1092 bp, Homo sapiens
aagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatacatatctagaagttctacattgcaggaaaaacagatggatatatatttaatctttaccaaaaagttttcttagtagagacaacctgcaagtcaataatggatacagttagtttctaatgggtaaacagaagtatacggatttccacagaattttcacactgttttggatagctgggaattgggcataacaacactacttagtttgagggctctttcaaagaaaagtatcaaagattctatttagtactttgcattacacttttaatagggaaaactactggctttcaagtctagtaaaggaatggaaattgaaaaatggaaacttattaattcttccccaaagcgaaagcatacttttattctcctcctgctttcattgacatgtggcaatttccagggaagaggcttactgattattaaagcagtgtacttatt

SEQ ID NO: 67565 - DNA, 1010 bp, Homo sapiens
cacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaagggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgttgttttgttaattaatccaagatttacaatagcacaacgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaaaattgtgaaacagcatattacaagtttgaaaattcagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaacttta

SEQ ID NO: 67566 - DNA, 1050 bp, Homo sapiens
ttctttttcattgcagctctttggcctatagcagctgtggaaatttatacctcccgggtgctggaggctgttaatgggacagatgctcggttaaaatgcactttctccagctttgcccctgtgggtgatgctctaacagtgacctggaattttcgtcctctagacgggggacctgagcagtttgtaagtagattatcatcattttccagggtactcttgtttagggaaataataagccagtccatttctcctttcccttccagtatttttcttagcagcaagcacaaggttaagctcggaaacaattcttgggacagagactgagaggccgttgaaggggaaagcaagtgacagagctgcagacaggacagttgggtttgctggtgtttcacttccgctcccaccatcttggcctccttgcctgggtgctgagtaagaagaccttttgccatttcccctctctaggtattctactaccacatagatcccttccaacccatgagtgggcggtttaaggaccgggtgtcttgggatgggaatcctgagcggtacgatgcctccatccttctctggaaactgcagttcgacgacaatgggacatacacctgccaggtgaagaacccacctgatgttgatggggtgataggggagatccggctcagcgtcgtgcacactggtaggttatgcagggaacagtggttttggaaaggatgagagcttgtagaaaagaaaggggcaatctttgttaaggctgagagagagggacaatcttttgtgatggatagagagagggactagcccttcagaactgggagcctcagagggagaccgaagagttctggggtaaaaagagaaaggctttgtttggctgtggaaagaaacagaaagtaaagcaaaggaactcagagaatccgttacaaaaatggcattgagattgtgaaagggagagggagcaattctttgatgaaaggcttacaacaggtctgttcactcactcatttattcgagatacttattgagtacctactctaatgctaggcaccgtcaaaa

SEQ ID NO: 67567 - DNA, 1051 bp, Homo sapiens
gctcgttcgtgtagagggcgggagagaggaaaggaaggagggcattgggagctgaggccccacctttcatttcagaaaagtgcacaggcagagcgggctgagtcacaggcacaggtgaggaactcaactcaaactcctctctctgggaaaacgcggtgcttgctcctcccggagtggccttggcagggtgttggagccctcggtctgccccgtccggtctctggggccaaggctgggtttccctcatgtatggcaagagctctactcgtgcggtgcttcttctccttggcatacagctcacaggtaagagccggcgggcttctctcagagtttcctccttcactgctcactctataaagttagctaattgtcttagaagttgcaagacttttgtttgggagcctgagccacagatacagtttgttttactttgggttttactgaaaccaaagttggtggactgtttttggagaactgctctcggacaaacaggtttaggtgtgttcagctgccagtgattcaggcacagagagggctttctaatctcaggttacatgccatttttttgtgtgtggctgttctcaacctcccactgctggcaggacttggcatttggatttctgtgtgtgggtcttgtctgtgactctcagcaacaccaggaaagtggagattgttagagagagacctactgtgattttgaaagtgccccaacacacacattctaaatgtaaatatcaagtttaaaaaaatgccacgtggtacaaaggttctaggggtgcaggcaaacataagctgtctggagttgattaattcagtttctgcaatagactagtaacagtatgaaatccacctaaggacccatctggaaaacttacctgctaggagaccactttacatacaacacataatgcttaaccttaatacataatgtaatgtctaatcaatgttatgattcattttaattttttgtttatgctttcaattctatttgcggatgtttgtagtttgttataacagttttgaagtcagtaccacgaggcgaggctttaat

SEQ ID NO: 67568 - DNA, 1031 bp, Homo sapiens
cactctgcttcatgtttccttgggtttagaagacacttctaaaattgagtgaccatgcctcatgaccttatatttgatgagccttccttttaggatcagttttatgccctgacagcaagcatgtgtttagtctcgctgtcatttactgttttggtctcacgtggaagcccacctgcgataaaatgggatccaagaaggactgctgtctgctttttgacttgagatccttctaggctgcagatagatgtgttgatggaatttgttgccacattagcatggcctgatagtgttaggtgaaacatacgacaacgaaaattgtttcttaatttctattttaaattgatattttaatttctattttatattgatatatgtattatttgccaggacacagaccttatgggagtatgatttgatagagcttgattttgacgatcccagttttacaaagtgttccagatatttctgttgaaaaacaataccaagtctgatgttaacacacttgtgtgttcatgagagctgacagtggtcttaaaggattagtggtactattcataaacaaaagcttgtattaggaggaagtgacagaattttgtaggacagctattatagatatagatctttgcagcaagtgtatcagagtgaaacttgttttcaaggaggatatattttaaaagaatcaaatccaaaagcttctaaggttggtagctgtaccatcccaaagtgtctgacaacaggatagtgttgtatctctgtatggcagttgaaaataggaaaaaaaatacatacatatatgtatgtatatatgtgtgtgtgtgtgtgtgtgtatttttttttttttttttttgagacagagtctggctctgtcacccaggctctgctctggagtgcagtggcacgatctcagctcacggcaacctccatctcccagtttaaaagtgattctcctgcctcagcctcccaagtagtgggattacagcctggctaaggtgtggtggtatgcgcctgtaatcgcttttagtggagacggg

SEQ ID NO: 67569 - DNA, 1027 bp, Homo sapiens
acctactgcgcccggcgctgaaaataggagattataaatcccgaatgacattattgaatattaaacaaaatatttaggtttcattttatcggacctttagagtgggtgattatctgggtactcttactttggtaagtccattgaacaaatctaaactggcatctccacaaaggttctcatcaagtgatcagtcctcctttttcctgtaaaatttttctataagtgactacacagttttagcccttttttaatgaaaaaaagtttgtgcacagatttgacatacgtgtgaaaaagatgagcttagtgaaagataggtgagaacctttttgttttttacagatagtagagatgacaacagagacttatttccatccaccattctacacatgccaagataccaaagaaccagtgtctagcctggtagcttgaccttccactgcaacctaagacaagtagtaaagcccttaccttgaagtagggtcatgggtgatgctgttgattacaaggagttcagaaagaactacatgtaagattgaagccattcaataactacttatttaggattttgtgattgtgatgtataatgccagacacagaagaaagaataatcagatatgaacatgtaatcagaagagcttacagcctagcaatgtagaagatctgcttagaaatacaatgcagaaagtttaaaatcctagtaaaaatagaggtaaaatgtagaaagctagtttctttatacagtgcaacagtatagtattgagaaagaaggaagtaatgcagtttatggtgataaattctttttgtttctcttgatagtctttttgtttgtttgtttgtttgagacagtttccctctgttgcccaggctggagtgcagtggcaacgatcttgtctcactgcaacctccgcctcccaggttcaagcaattctcctgcctcagcctcctgagtagctgagattccaggtgcacgccaccatgcctggctaattttttgtgtgttttaagtagagatggggtttctccatgt

SEQ ID NO: 67570 - DNA, 1021 bp, Homo sapiens
ataaaagtatatcaacagattaatgcattccagctgaacgttttagcctttttagtttcagctatccacaaatcaagccaccgagtccagctggtaggtttgtaaccattttgccaaaaatgtcttgagtttggggacaggaattggaaaatcttaacccaaagtattttaaaatgtattgtatttgagaaatgggaaaagaaacaaccacaggtatattacagctattgtgtcatctgccctcttgtgtctaatacctgtcctttgaacagcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctggtaagtggaggagccaatagcagcaaataagatgacctagaatggggtcttcccaaattaagtattctttgagtccttaattgcaattggaatttaagtttggaacaaaagttggtttttgtttgtttgttgagagcagaaattggggttttttgtttgtttgcttttattgttggttttgttgtgagtccctcccctccgctgtcctctccactgtacaaaaagagaccaggtaacaggtggttccatagtaacagatgccagtcgtgatcccaaagctgtcaggctgttttctttaaaagaaaaaaaaaatcacctagtaaaagctatttaaataaatgtttttaacatgggacacagaggtggtaagtgtaggtgtagaaagcaagtcatgtgcagctatagaaagcagatgtaaaaggaagaactataaaagctttttgacctgtaggcaaatgagacttgttcttaagctcagcacttcaaaggccctcccaagcaaagtgcttcttctgttccgatgagtggcatcatttgtagcttagtcctgttaggacagacttttttaaaaaatctgatccttagcc

SEQ ID NO: 67571 - DNA, 1094 bp, Homo sapiens
gagcaactcaacatcaatcacatgatccaaaggatcttccttattactctggacaacagtgagttacaaacttatagcattattctacccttcctatttgagcttgggctaggggcttgctctttgaaactggttacagctaatggttagatacaaacctactcactgcactccctggaactcagggtttatatttcagtgaaccttttggtatgacctaaaaacagtatttagatgcagatctaacttttgttcccatttcaatactgactgcactatatagctacttgcctttactaccttaaaaaggaaatgggaagggtagccaaacccattttcttctcagaggtaacctaaatattcagatggaagccttcagaggcatcagagagtgtttgccctctgtgccctgtctgtgtttaaaccccaaggttggtactaatgtctgggatttactctttaaatgtcatgatgctaggtttataacaaatcccattctctgtgactagagggggaaaaaaaaagatttgaatctttagatgttgctttgtgtatcaggatcattctggtattacttgagtcagatttgcagttcaagagtgatgctgtcaagatcagttgtctgtataaaacagaagcattatccttaacctatcatattaaaaccatttcccaggtgatcccagcttgaaaagcgggaatggcatccctagccgttgtgtgtatttggaagaaatggcagtagagctagaagatcaagactggcttgatatgagcaatgttgagcaggtaatattcttacgttcctaatgtgtgcccttagcaaaaattagctatgcggctgaattctgctcactgttctccaacttatgcttgtgtccatatgtccatccctctctctttttttttttttttttttaccagtagaaggccaagtaacctggatgtgcatctctaacattgtggtgttcctcttttggaatcttttcatctaccatggccacatgcccaaatctacccatcctctaagaaccagttaaaatgccttcttaattacaaagccttggccaggcacattgactcacgcctgtaat

SEQ ID NO: 67572 - DNA, 1050 bp, Homo sapiens
tctaataccgtgtaatgccatctgcagttgggcagctgatcagaaaatctcttataagtgcccagaaatatattttaaaatcaaattaggggatgaggcacagagagtgaggggaaagattaggattagcatatttttggaaactgccagttgctaaggtttgggaataaaaactattaggattgtgaaacgttctgtggttgtgttttctggttgaacagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtaggagagaaccaggcttctcaaaactgtgtgtgtgtgtgtgtgtaacgtgtaaagcattcactcccttatcctttttcacagagttcctttctcaaaaaaagatgaggcagaaacgagctatttcgatttttttttctttttttttgagatggagtcttactctgtcactcaggctgtagtgcagtgacgctatcttggctcaccgcaatctctgcctcccgtgttccagcgattctcctgcctcagcctcccgagtagctgggactacaggcacgcgccaccacgcccagctaattttgtgtatttttaatagagacggagtttcaccatgttggccaggatagtctcgatctcttgacctcatgatccatccgcctcagcctctcaaagtgctgggattacaggcgtgagccaccacgcccagccagaatttttaaaagacagatgtttgagagaaaaaaaaaaacacctggtagcttttaaatgttgtac

SEQ ID NO: 67573 - DNA, 1049 bp, Homo sapiens
caaagtatgatcattgcccttgtgtgatgtaaaactatcctgctggccttcttgtactttgcctaataattattttatgtaataacaacccattctacaccctactcaaccaagctgcctttctttggatagtgcatttcaactgaaggctgctatttgcaattagcttcaattatgttgaatacttggcagcattttcccattgctgtgcaccctgcctgtgtcctgtcaaaaacttttgtgagtgccttctgtgtcattgcaactgcaactccctactatccttaaagagaaggctagataaataattgaggatttgtttttttgtgactttctgttttccctgacccagtctcttctgctttcttgggggcaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccaggtaagcaggctctcccttgggaatgtcctgtttatagccttctgagtttaagtgggtcactttggaagtttaatcctcaaaataccctttcttcgttatcattcagttgtttttggagaaacaactcaaacttagataatatctactggtcaaagtattaggggactaacagtttgttccctcaaccttgtgtccccctgctatgcatatcagaaaatcatcttcaaaggattaagtgtaatcagagttttcagagctgttagtttctatcattaatatttgttcaacttacacattcatctaactttccctgtcctttttgtagaaaaaaaattagctcctgctggttaactcagaagggaaagagt

SEQ ID NO: 67574 - DNA, 1011 bp, Homo sapiens
ctgttttttgtttggttttggttttttgcttgtctatattttctgcagtgaaaatgaattacttagttttttaaaaaagtagttccttcaaaatgtttagaaataaaataacagtagttcccagaggtctccaaataaactatacctaataaggaaaagagtgctaatggattgagttttcagagactttggattcttttccagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttgggtacctgagattgaaatctgtcaagccagaggggatgctgttttgatttagggttttgatagtagaatgactggttggtaattatgtgaaaatagaaaagaaatggttaattcctagttgcttgatgaaggaatcttctgtagttttaaataaggagattttatctgggcaaggtgtcgtgtgcctgtggtccaagctacttgggaggctgaagtgggaggattgcttaaggccaggagtttgagaccagcctgggcaacacagcaggactctgtctctaaaaactagtaagattttgtgtgacccatgggacattgagatttccagtattctgctttgatctgtgcaaagagaaactttactggttgtaccactgtttagaaaagtagcattcttttaaggtcacatgatacttgatagacttcctagaaagtctttctgtatcaaaaagtatatatattaaatatataatatatttaatatatattatttataatttattattatattttatataatataattttatataattataataaaatatatattatattttattattataaataataaataataaaataatatttatatattataaataatatatattgaaataagtc

SEQ ID NO: 67575 - DNA, 3269 bp, Homo sapiens
ctggtggatcacttgaggccaggagtttgagagcagcctggccaacatggtgaaactctgtttctactgaaaatacaaaaattagctgagtgtcatggtgcaggcctgtaatcccagctacttgggaggctgaggtcagagaatagctttcacccaggaggcagaggttgcagtgagcagagataacgccactgcactccatcctgggtgccactgcaccagcctgggcgacagggcaagactgtctccaaaaaaaaaaaaaaaagaaagaaagaaatagacaaagtagctacaaaaactcctgaatcatcttgttctcactctttctaaccccaactcggcatttgactcaaagttataatgcactctggcttcattcttaagatgcgacgcccaggtgttctgtttttggcttagaatgttagaacttatggaaataaccctatttccctttctctctttgtcccagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgac

SEQ ID NO: 67576 - DNA, 1001 bp, Homo sapiens
agcacatattgatgaggataccaaaatgggtaccagttgttttaattccatctggatttgtggataatattatgataacttttcatcttgttcttaagagtgccattctaaatccttcatccctttcttcacctctttcttcaaatttgctggtctctctccaagaaaatatgaataaattgactgttctcttgtttttaaatccaattcctagcatctttacagttagctagatttgccattcataaatgaagtacagtactagctggccactagtgaagtactggcataattgaatgtgcttatagcatcctgcctgattgaacatccctgtggcacaggtgttctgcatctttaaaagcctcttgttaccagggagcagctttgacttttcacaccgggtgcacatttggtacaagcagtgaatgaaggtgatgcatgaataaatatttgtgtccagcccacacatctgcttctttcggtctctagtgagttcatcctggttttttgttttgttttgttttgttttccagctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggtaaccacgggctaaatgaaaacggatgtgcataacagaaaatgtcttcccttgggatttttctgattgttttgattaatatatatgtttccaatgaggctgaatccagcataatgaggaaaaaaattttgactgctgaggaagatacttacttttctaattttgtcacctgggtagaaataattagcccattttatgtcttagtttcctaagagtcttaaacctagcaaaaaagtgaccatttttattgggaaattttttttcctttcctatattagatagtatactaaaatatgatggcttgctt

SEQ ID NO: 67577 - DNA, 1143 bp, Homo sapiens
tacagcagtctcttcccccccccgccccgtcttacagggctacagtttctagcctattggtagccgggaattactctaccttcactccaccctttccctcctttagaatgaaggattagtggcatcttggaggggaaaatagtccactgtcccctaggcttagagaagagcagctttccaccactccccttggagaggaggcaggctttccctccagctctggggaagggggcccctgtgaggggaggtgtttgttgggggactgaggcagcatcctcccaggggaagcagctgctctcctaccccacccactgcgcctgagagcacgcagtctccaacccgagctccctcccgcccttctcttctcgtcatttcattattgatccaccttttcctaggccaatcctggggcttggaaggggtgggggaagccaggttggggtgaggagagtagataagggacagttatactttagtgtggtggcggtggttgctttgggatgggagaaaaaggattatcaagcaaagttattccttagaaaggacttggggttgtctctgattcttgtaaggggacccaaggtggatgaagggtcagagcgttgccccttccccattagtactggggcaagaacggagttgcttctataaacattattcggcccccttcagcaaaaaggaaagttgcccaaggaagggaagttgagttcaggttcagccagtggcgttgcgcatttgttttccattggatgcagaaggggggagttcgaattgtagaggggggaggatggcatgggggatgctaggaggaggaagagcagctgctaggggctgaagcgaaggggggtagggggttgctgctctggagtgctcttgattgaaacagaaagggaaagataacaaccagccgtttcctgcgtgctctgccgttggtgcacacaaaatatcctgggcaaaccccttgtcccctattgtgccccgcacccctttagatttacggaaagatcctgggaagaaggggagggaggagatcccaaggaccctggcccctcctttcaaggagctggcattttttagttgttagtcttcctgcctccttttttttaatcgtttctaaggcagcctgatcaggagactgacaac

SEQ ID NO: 67578 - DNA, 1540 bp, Homo sapiens
cgaagcctccgagtagaagtcagtggatgtgggctctcatctccgttactgaacagttatgagaccctgggcaaattcacttttaaccttaaatttctgatctgtaaaatgaaaagtttggactaaatagctcatgaatctgttctgtgtcagtattatgattcctttctgttgtattaaacttttggtcaaatcagaatttcttattctgagtttatttcaaaagtcagagtcaagtgagacgatttgataatttttgttttttttttgagtcagggtctcactatgttgcccaggtgcatcttgaactcctgatcctcctgccttagcctcctgagtagctgggattctgtttggtaatttttaatatcagattatacatttgcctatataactggcattattattaggaggagaaatttcaacttggaaagttttcgttgtgtggaaaaaacataaggactttggggaagttgaccagtttcatttataagaaaaatgaggataaagtttttacacatagttctgagaacctacagaatcccaggcattatctggtgtttagaggccctcttgtttggctaaatgtgttgtcattgttgtgaattccagactatccaaaagagaagttattttcagtctaggtggtatattcctgtaggtgtatgaattttgaatgaaaagaaaaatccaatacatcaatgtatttataaatctgaagtgatagtacctacttcataggatgtagttattaatatgttctgaaatggtttatactgagcattagaaattcagtctttagaacttttcttcctctgtgactgaaaaccagatgacatgtccccatctttcacttccatttaattatcttaaggcacatactcctggaggaaatcatcattcacacaatagtgatccatcttcttattggaagttgagagaaactattcccatcttgacttaattctcatctctttgctcaccttagagctgtccttccgtggggcagctgtgcagactctataccaattgcctcccttaccctgtggctagagggggtggcaacagtgctttgcttgctcagaggcataacagactgcagtgcctctctcttttggaaactcgctgtgttttaattgtaggtctcctaattaagatctctttgtgcctgcccacattccactagtgttggcacagagcttcagcttccttctagcacttaactgaaggccttcaatcgggccttttgtgaatatcttgtctctttccattcttcctctgccaaggtggagagcccagtggcatagacctttgagaagggggaagctttgtgactatcactactttgggaggaatttattcgaggattgctgggatgggaccttcctttgtttgcatatgttattttcagggattaagaaaggttaaattactaatgagtctggcatgatgtacctacattttaatcagattcttaaccctgtaggcactagtaggaaagaggatgccacagagttcactgttacaaagtatttccttg

SEQ ID NO: 67579 - DNA, 1800 bp, Homo sapiens
tgaaatgtgtctgtctttgtcccattagatagtgactcccttaagacacgggccatttctaagtcatcatttatgttttatgttttttataatggtgactttttatatagtatttgttgaattgaaaatttgatgtccatacaacttttaggaatactttgctgggacacattacataaactaggagaacttaagactacgaacagaatatttggactaatcattaagaaatactaatttaagtatggcaaaggaaagcacaggtgccatgatgcgacatttttgtaaaggtattgattggggttttgaaagcgatgttagggtatcctgatgggatggcattatcttttatgtagataatacttagcactgatcatccccttacttgagtgttgtttccatttctaggttcctcaacttaaaagggatgaggagaccttggagacggttctgaggagactcaaaagatgattatatgattggaagtcagtcctatgaggaaaggttgagagaatgaaaggttaagaggcaacttaataactcttcaaaaaacatgaatggatccattattaggaatggtaaccagcggtttcccagctccactgacagcagaataagagaaaataggtttaaaccgaaatcaggagtagttgtgtaaagaacttattggtaatgatggttgtcattacagtcatggtaaaaaggttaccaaaataattttattatcttctctggaagtatattttaaaagtacagtcctgcctacatatgtataaaatgacctcttaagctaccttttccttctgtgaatcagtaaataaattcttattcagctcctcgaagcaataattactttccagtaggaagcttccagagatatttctttaggaagtaatggtttttgtagtggctttataggagaatacaaatttttaagtggagctaagagagaaatcttaaacatcaagagaaaccaaggaaaacagtaggtgtggtatcaatataggaaacaaataagtatttgtagcttttatgtccattttcagttgtcatttaaagaggtatagttcagaatagctcttgttaaggctgtcactgcttgtggatacattgtaacaaatgcttataaatcatttccaaactaatagaagtttgcttcatgttagttagtattataaaagcctctgacccttggcttttgaggctgtgtagagggcttgcatcactcagaatgaaacctttttagatatgttgggttgcagaaagcatttcctgtacagtcagaatgaaaacttgaattgggattattcatatagattaccaaaagtctgggcagagctgatattaccaccagccagttttcctactaactcttaactccaaaaccttcattgggttattgaagctttaggacttttgaatttcctactggaattgtgtatgaattccttctttcaagtgaactgatactagatttatttaagattagttatacatcttaagtattttttaagtggcatataatgaatggtctctacttttaaccagtctcataaaatgcctggggttcataggtgaagctggattgttgcaggaattctgcaattgttggcaaagcgaagggcagtttgactccttaattataaagttggatgtcatttgagaaactctgggaattggaagtagaacaaattcatactttccctataacttttaatttcttgtcatacattcagaaaacaagagatgtaaaattcataaaactgcttgtataaattcagaaaacgggattataaaagc

SEQ ID NO: 67580 - DNA, 1161 bp, Homo sapiens
aaatttcttataataaaaagaactatatctgaaaataaagttggtgtttgtttaatttttctagcctattcaaatcaatctggtcatttatggtactttcctattagagaaaaataaaccctgtgattgtgatgcttaacttaattttctacagtgaatcagttaagtgggcttattttttctgctttagcaagtagataaaccagttcagacttggaacctgaggattctggaaatacacctttcttgagtttttggtttttttttttaaagattctgcagaataatttgggacattgccaggaatcagaatagtttactatctgaagtagtgcattcattttgctgttttttgtttttttgtttttaagacagataagctactttatgactacctctttttctgaagcagggtgggtggaggtcacctgtctcatttgctttgctgttttcagcatctttgctgcttattcttgttgacatggagtggggatgaggggtactacctatttctctagttacaaagtgagtagcatttgtgtttcttaggtgacagttgctaggtagaattgaattaaatatttgaaaactggacttcattcttgtgtgggtgaaatttttaccttctgttgttattgaagaacagagaattattgtcttagcgctctttaatcccaagtgacctttttgtgttaacatttctcaatatcaggcagagatcatatttaaacagtttcaatctcttcctatctgttatgcattcaaataatcattgttctcttgatgcaccaataaccagagagaatctgcccttgttcctgcccctgacaatctgttcacaagagaatatgatgtcagttcaataacagcatacatttcttgactggttgaatttcattaactatttggcttaagaagtttgccccttgatgtctgtgtatttgactgtgcttgggtatattatacttttcttactgattgagcagcattatttttatattctgcttttggaaatgatttacaggtgtcactacattttttttctactacaaataatgaaaaagtacctgcaaagaggctcatcttcctaaaaatggctatcataaatattgcattacaaagtaagaaatagaaattgaaaaatcgaattcatttatcaaa

SEQ ID NO: 67581 - DNA, 1163 bp, Homo sapiens
gtttattgtgggccaggctatattctgagcacttcacatgaattatctcacctaaccttcatgaccattgtctgaagtatcactagtattcccatttcataggcaaggaaacacatatacattgaagcacttggatacctaataggtatctcttacttaccatatctaaaaagtcttgactttcttcctcaaaccttttccattcccagtctctttgtttcttaattattccaccaaaaatccagttgctcaggcctaacatgtaagatttatcgtcgatttatctcttttattcacatctcacatctatcccatcagcaaattctgtctgtattacatccaaaataagccctaaattcaactacctctcaacaactttgctaccaaaacctcagactctcccattatagtctcttggttggagttgcttatgttattacctcactaaagtttgtttctcacatagcaacagtaaactctggtatcaaatcctattccttcactttaaacctatctgtgtctccccacactgctaggataaatccagattccttactatggccaacaaagccacacgtaagctggcctctggtcaagcctacttctcgagcattgtctcttctcatctcatccattctgctatatagccacactagcctttttctgtctgtcatgcatgctgtgcctgttgctgtcttggggcctttgcacttgctctcaggctagaacactactccaccaaggtctttatatgtctgactttttctcatttaggcctaaccaggtttggcaagtttttttctgcaaagggccagatggcctctgttgaaactactccactctgttgttgtaagtgcaaaagcaaccataggcaatacagatgctccccaacttacgaaggggctacatcctgaaaaacccatacatcaaaaatgtcataagtcaaagatacgtttaatacacttacaagctcgtcgtaaagtcaaaaattgtaagtcagaccattgtaagtcagggactgtctgtccattaacaactgaacgtggccatgttccaatacaattttatttatgaacactgaaatttgaatttcatatagttttcatgtacacaaaatattcttttgactttaaaaaaatggttaattttttttttttttaatt

SEQ ID NO: 67582 - DNA, 2756 bp, Homo sapiens
tgtctttgaagaggagaatttcagccttttcttaaatagtccaatactttaatcttagcaatctcagagcaaaagcctttttagatgccagtaagacttttctctcagttgcctagtatgcaaaggctgggccttaaatgttttgctcctctaaagcatttaaatttaagagatgaacctgctaatttgtcctaaaagttatatatgtcttttaatatagtcatggctgaaaaatggctaagacagttagcacctgactctagttttaaattaactgagaaaataatccttcagaaaatcattgatgttgtccacatacatgtgttcttacctctcgagaggaaaatgttaatgcttttgtcattggaactcagtttgggacttaccactataaattggaggttccagaatgtctgttcttcattccttattttgttcttgttttatgtggattttgtttctggaatctgaaattctatcattctgtgtctgtctctggaaagaactcaatctctgaatcattgaatttctattaatcagtttgtttaaatagaccatctttcttgagaacttgtgcaaaataggttaaacaaatcctttttttttttatagagcaggttaaaattagaggtaagcagaagcttttgctttttgtcctttccaactataactgaaaataggatgcttccctaagttttagtaaaggatttcatcctatatgcagtcaattcatgatccctttcacaaacgctgctgcccaccattaagtctcttatcacaggcatttttaaaattataccataaaatgcatgttgagactctctggatctcaaatgtacagaaatcacatctaaatgtcaattcctgagttaaggaactgacaattatggcactttcagtctctattaatatttagaaggcaagagattattatattgtttatattactccttatgtgtctgtagacttaaatactttttgaaaagcatttgtttgttgtattggggctgtatgtttctgccattatacttatttgcttacctgatttaaagttgtcctttaattgttttgggctgtatctatagtttgaaattaggactatcctctgtgtactatgcaccaaagatgacatttcaatgcattgttcagttactacacagctcctatttgtctgtaataaagctgtatggctgggtccatttatttcaatattagttattttatagtatccattggaatgatgataattaatatataaaggcaacttttccaaattcatttgtgtctcctctgggcatttctttgggatgtgtttgtatgcacgtttttgcttctgattttaaaataattttcctttgttgtaggatgagcaattcttaggttttggctcagatgaagaagtcagagtgcgaagtcccacaaggtctccttcaggtacggccaattaagtgcatggtgccttttaagttttgtttgttaggagattgtggcttcctcttgccttctttacatgtaaaggatgctctaccatacttgggttaggaaatggctgatgagctagacttctttttatttatttatttatttattattgttatactttaagttttagggtacatgtgcacaatgtgcaagttagttacatatgtatacatgtgccatgctggtgcgctgcacccactaactcgtcatctagcattaggtatatctcccaatgctatccctcccccctccccccagctagacttctttatgggactcttatctatcaggccacattgggtttattctttctctctgggaactacttggggcatgggaagtaggtttccacagaattactgggaaatctggtaggcaaagtgaaggtaacctagtaagagtatcctcagatttacacattttgtgttatgtggtagtgtatatgtctttgggaataatttggccattattttttttggatgaaatttggtccactattgtcaaagaaccaaaaacaaaatattggcattatgtgaaacatttttacctgattcttgaaaggctgtattaaaataaaaaaatggaaaattagcaatatttgtcattattctcaccaacaaaatatctagaatatcttgaaattctagacttacaagcagtttcctaagagaagaccctcaatggaaataacatttaatggcttgcctaattcagttctgtataggagaaagctatgtatcttttgatgaaaatgcattccccatctgtgctgccattctgacttcatatatggttttctttgattttatgtggatagacactccagctaaatatgatattgttagctgtttctgctttttgacattgacttagcttgtgatgtgtgctagcattagggtctcacttaagagtcatcatatattatcatctaattcaaacatccaagttgacagtttttcttttcttaaagaggagtggtattgtcattctagttgggggcagttggccagtagtgtcccagtatctgtgctattcagacagtagcagtgttctctttaacatgtgatgaagtcttaaaacttcatataggaaaggaattagagagatcatctgggatttttgtttgtttgtttatagatgaaaaaatgaggtccatgaaatacatgagtaatgatttataaccagtttgagagttctttggatatgttgtggatcagggaagttagcagcagtgctgggactcttctctgttctgctgcttctacttatctacc

SEQ ID NO: 67583 - DNA, 1006 bp, Homo sapiens
ggcgaggaagttcagatgttttttctttacaattcctttgaattcagaaaaaaccttcttgctcatctaaaattgtaagaaaatcagttttgtggattaattgttcaactgaaaactttttattatctttttgtatcaaaaaagtaattaaatgttctttcaggtggaatgttatttgctgacttctttgaggcaaattttgggtgaaaagaaactaagcacaattaagatgtttgattgactcattagactcaagttgaactcagtacaaaatggccagtgctaagttatattcagcttagttaaaacctaaactacacagctaaatatatgctcttcattgtttaatttctatacacagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaaggggg

SEQ ID NO: 67584 - DNA, 2253 bp, Homo sapiens
agattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacaggtactcttttccaccttgcctattaaaactaacagtttattgagccctttctatgggcaagttttaggctaagtggttcaattacatccagttatgagaaccaagaaaagtatggtggaggcagtggtatttgcagtagtccttcaaggaccagtaggattttgataggtagaaagtggcaggacataacattctaagtagagggaacagtgtgggtagaaatggaaaagtaagaaatatatttgaggaatactggatagctggattggcatctgtggaaaactggtgaactaaggctgaatgaactaaggttgggactatatcacagaggatgctgagttgtttgtaccttataagtttgatgtaattaaaccagggacttaattgtaaaggtacattttaatagtcaaattgttttactatccccgatagaatagaaaaccg

SEQ ID NO: 67585 - DNA, 1064 bp, Homo sapiens
gttttgttttaatttttatgggtacatagtaggtatatatatttatggtatacataagatgttttgatacaggcatgcaatgcatcataatcatatcatgcagagtggggtatccattcccttaagcatttatcctttgtattacaaacaatccaattatactctttcagtcatttttaaatgtacaattaaattattatttactacaatcaccctgttgtgctatcaaatgctaagtcttattcattctttctgattatttttttgtacccattagccatcccctaatatggaattttttatgtggaaatttttattactctactttttctcctcttttttagtcagtttgtggaggtactttctgccatctggcatactttatttaaaatagatcgagatagtagcataaacagaaattttggtgattaagcatcttgtaaactactggcacaaataataggtgtcaatagatatttgctgaatgagtgagtcacatgcaagtgattaatataaagaacagttgggagaaatgctacattatttacttcaggggagataatttctaggagacaagaagtagttctgtgctttggtttggtctgaccttaaacaagaatcttgtctcagtcctgttagtggaaagaagtaaactaattcacagatcacaaaaaagtacatgatagcaagataaagttgcattaaatttaagagttaaagtggattcagtgcaattgtagacttcagattacatttgaattttattaaatctaaatttaggggtgaagtatatatcaaagccaccagatttaattatagcattatagtggtagacaaaggagttgtttgataattttagtctgttttgtgttaagattacttgatggatattaacatcgtaagagagtaggactgatgcgactacaagaaatactgactgatcattttctgtgtggtgctagtcagtgttggattacaagaaatttgagtcccatttcaaaaataatttgatatttgctccttttagatcctaaaggtaggtgaaattgctgatccagggattc

SEQ ID NO: 67586 - DNA, 1021 bp, Homo sapiens
tcccagccagcactggtcatcccgcctcagccacctactacaggaccgccaagaaaagaagttcccaaaaccactcctagtgagcccaagaaaaagcagcctccaccaccagaatcaggtgagtgaggagggcaagaaggaattgctgaaccacaagtactaacaaaaaagcactgatgtctcaaacagcatttgaaagcaggaaatgtatgatttgaagtcttcagttcaagaaaatcagctctctttctaactattatgtttaataataaagaaacagaaacaaaaaaaacagttaaattggaggtattgttttaatttcctgttcgaagcctagagtttaaatagttttttttttttttttctaatggccctttcttcacaggtcagtcagtactaaagtagtcgttgccagcatctgactgcaatttattctgaattttttaggtccagagcagagcaaacagaaaaaagtggctccccgcccaagtatccctgtaaaacaaaaaccaaaagaaaaggtgaggagagatttgtttctctgccatttctcagggatgtattctattttgtagggaaaagccttatccttgacttctatgtagatggcagtggaatttcttaaaattaagaaacttcaagtttaggcttttagctgggcacggtggctcacgctggtaatcccaacacttagtgaggctgaggtgggaggattgcttgaggccagcagttcaagaccagcctgggcaacatagcaagaccctgtctttatttaaacaaaaaaaaaaaaaagaagaagaagaagaagttagccaggcatggtggcagttgcgtgtagtcccaggtactcaggaggctgagatagaaggattgtcttgagcccaggaattcaaggctgtagtgagctatgattgtaccactgcagtccagcctgggtgacaaagcaaaacactgtctccaaaaaaaatttaggcttggcaaggcgcagcggctcacgcctgtgatcccagcactttgggaa

SEQ ID NO: 67587 - DNA, 1117 bp, Homo sapiens
ttagcaattatttgtctgtaaaaatcacccttccctgtattcactatttttatttattatggataaagagatagtgtggtggctcacatctataatcccagcactttggggggccaaggcgggaggatcacttgagggcaggagctggagaccagcctgggcagcacagtgacacacagttgctataaaaaatttaaaaatcaactaggcatggtggcatgcacctgtagtcccagctactcttgagaagctgaggcaggaggatcacgagcccacaaggtctaggctgcagtgagctgtgactgtgccactgtattgcagcctaggcaacaaagcaagacccagtctcttttaaaaaaaaattcaaagattatttgtttatgttggaaacatgttttttagatctattaataaaatttgtcatttgcattattatctgttgcaaatgtgaaggcaaatagggtgtgattttgttctatattcatcttttgtctccttaggaaaaaccacctccggtcaataagcaggagaatgcaggcactttgaacatcctcagcactctctccaatggcaatagttctaagcaaaaaattccagcagatggagtccacaggatcagagtggactttaaggtaaaggtgttcagtgatcataaagtatattgagtgtcaaagactttaaataaagaaaatgctactaccaaaggtgttgaaagaggaaatcagcaccaactgggggaatgaataagaactcccattagcaggtgggtttagcgctgggagagctttggtcagtgttgttaggtcactgtttgtgaactgactgcagaacatacataatgaaacattcctatccatcctgagcagtatcagaggaagtaattccttcacatggaaagtatcaaaccatgatgattccttgagtcagcaaaactgtaagagaaattcaatcccagtgtattttcgcaatatattcaatatgaattgaacaactaggtgagccttttaatagtccgtgtctgagattaaaactttttaaagcagcagttatttttggactcattgaaatgaaatactctgacattgtgatgtcacactaattttatgcttttcatcct

SEQ ID NO: 67588 - DNA, 1737 bp, Homo sapiens
tgggaggctgagggaggaaaatcgcttgaactttggaggcagaggttgcagtgagccactccagcctgtggtgcagtctgtcactccagcctgggtgacacagtgagactccatctcaaaaaaaaaaaaaaaaaaaaactatatgggaggatgtgcattttgttatatgcaaatgctgcaccattttgtctagggacttgggcatccatggactttggtatcctctgggggtcctggaaccaatcccccatggaaaccaaggatgactgtgcttagagtattgctttctttcttgatttgtatttctgtcttccagttaagattttgtatctatattatttctctttttacttagtctgtctttagcatttaattgggtgtaatcagttgcctattttgtgttttaattttgggactatagcagaaaacatgatgttgaataaaattccaaaaataagtcaaatctacctaatatgaatactcatcactgagtgcctttggcaggaaataaatctatctcaatgctttaattgggagtaaataatgtatgaggaaatttaaactcataattgtgtgctgtacttacttgccagtaaatgtgaaatggggtactaagtaataggtgttgggtgaaggtaatatgatgcttatctttttgccattatattttcttacagcagctgctggagtgtaataagtgccgaaacagctatcaccctgagtgcctgggaccaaactaccccaccaaacccacaaagaagaagaaagtctgggtgagttatacacatgatgctcttttatagagaaccaccatgtgactattggacttatgtaacttgtattacaaatatctatgcttgaggatgtcagtatgacaatctttttgcctcattactaggaaatcatctcagcagagaaattaaatctataaatggatgcatttaagatctttttagttaagtaaagatattaaaaacaagaaattcctattgaatttcttttcttcttttctagatctgtaccaagtgtgttcgctgtaagagctgtggatccacaactccaggcaaagggtgggatgcacagtggtctcatgatttctcactgtgtcatgattgcgccaagctctttgctaaaggtacccaaaaaagccagttttgccagctttcggaggttgtacttggtgttctggaggtgaactagactctagtgaaatgaaataaaaagtctcacacattatgtcaaggataccatttagacacatttcctaagttcctgtttagaacttagcaactagaaatgtcttgttagtttatacgggaagtgttaaggggacttttcattataactaaccacaaagaaatcctctaagctagtatttcccaaagtgtgatatatatattatatatttgattatttcagacattattttagttgctacccaaacattttctttcagtagttatattagaaaaaaatattaatataactaatacattaaacctgttatattactgacttaggataatcatataaagttcactgttttaagtaagataagcagatcagtttgaagaagttcattaagtaaaaaataatataggagatctctgtatataaagaaaatttatgaaggttatacagagtactgaatcttaggaagtgctcctctaagctctaatgtaaatgccctagaaataaggaaaaagcttacatgtactgtttctgacttccatattg

SEQ ID NO: 67589 - DNA, 1022 bp, Homo sapiens
ctacatttattagcctctagagcactttaaacctaaaattatggttgtgttgttatttgaaatctctaaatttattttttagtctctagaataagcagcattgtattatttgtgctcacttatcttgaatatatgcctttaaagtatttatttgctgtcctttgtgtgttccataacctgattctcaataaccaaattcaggattagtgttaattaataatgccactttttgagatcaatatgtgtcatatccatgaggacattaaaatcttaatgtggttcccaacatatggctttatagtaagttcagtggaatagtttcctcttcttcctctctctcattcttcagaggacctcatcatggtaggtttttgttttcttagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggtaggccaagtctcatttttttctgagagcttgttcttaggtagtctttacctagtgtttttcttttgttttacttcattctcctcacttaatttttagttacttgttttggctataaccattaggaaaatatttagagccaagaataggaccttctttagcgtaagaaataggaaggagctgtatcttcaaaggtcttgctgttacaatgagaaatttggactttatactctgaaggtgatagggagccagtgaagcacttcacccaagacagtaacctgatcagagttgcttcttagaaaaaatattgttctgactgagtggagaggaaggactggagacacctgagcctagaggcaggattcgtagttaggggacagttatagtaatcaactggaaaaacactttctgtttatgtaagttgtgaactttacacatttataaagtagtcatt

SEQ ID NO: 67590 - DNA, 1085 bp, Homo sapiens
tttttggcggagattgggtttcaccatgttggctaggctggtcatgaactcctgaccttaagtgatccacccacatcagcctcccaaagtgctgggattacaggcgtgagccactgtttatttattttaatccaaaataaaaactgtggacctgcttggataatttatcatgatacagccaatttgtttgcattcttacctcattagcctggcatctcttaattgccacaggttaatcgtgaattgaatctcaaaggtctcagccaaagagtattataccacattaaaatagggtgtgagttttctgttggatctctgtgctggatgattaaggagggaagaggaaatggttttcagagcacactgttttaagaataattaacattttgtttttgtatacagttggagttcagtgatgatattgtgaagatcattcaagcagccattaattcagatggaggacagccagaaattaaaaaagccaacagcatggtcaagtccttcttcattcgggtgaatgatattactaattcatgtttttaatgcttacctataagtaattaccctgtgaatacaatgaacttgttctcttctactttttgctttgtggtgtgtataaaacatctttggtttaatttgatcccctgattctttgagaggaacttggtgaggttgccagagtggatggatctttctcttggtggcctgaaattatcctcgtattaacagagaagctggtttgaagatttttcatgtggtatctaaatgagtgtttacatatttacattttgtttgtgttttcttttagcaaatggaacgtgtttttccatggttcagtgtcaaaaagtccaggttttgggagccaaataaagtatcaagcaagtaagtgaatttagcataacttttttttctcctcatcggctagaaatctgagagttctcatatttctagattgcagttttccaaaaggttttaatactagaaatgaattggttgaaatgccttttcggtgtggttttgaggactacatttaatgtttgttataagcaattgcctttttgttctttacttttatatttgtttta

SEQ ID NO: 67591 - DNA, 2382 bp, Homo sapiens
tgtttgaagatgatgacggatcactaaagaatgtgcatatggctgtgatcaggggcaagcagctggtaagaccttatgggtaaattttatgaaagagattccctctcagtttccagatattcttcctgtgggtgaatatggcctccctgatatttttcacagtgccatcagggtagttagccaacaagtattgatatacataattcaacagataaaatgataaattttatctgttttcaatttatcaatagataaaatgaattgtaggaactgtagaatgggatgagtctatagaggagacggtaaacgtcttaaaacatatgaaagtctgaataggactctgttctttttggatttttagagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtgagagagctttagttgctttaaaaaaaaaaaaaaagacttttttagagcagttttaggttcacagcaaaattgactggaaggtacagagatttcccatatgccccctgcacccacatatgcacagcctcccccatgatcagcatcccccaccagagtggtgcatttgttacagtggataaacctacactggacacatggttatcaccctgactcctgtagtttacatcagcattcactcttggtgttgtacattctgtgggtttggacaaatgtataatgatgtatatccaccattataccatcatatggagtattttcgctgccttaaacatcctctgtgctctgcctattcatccctgcctctccccaaccctgggcaaccactgatgtttttactatctccatagtcttgccatttgcagagtttcacatagttggaatcatatagtacatagccttttcagactggcttcttctgcatagcatttaagtttccttcaagtcttttcatggcttatttagttgctttttgaattatttcgaaatgcaaaagaaaaacaaaaatacagcaagatgataaactgttttgcttttctacttggtgttcctagaggcaccacctcttttgggaaatacagaagtgtcctgctaagtgaaacagaaggatgcttttgagatatgctatgtgccttccactctgagacagtcaggatcataagtataatgtgcaaagggacagcctattaacagctaccatgggttttatttaaggtggttcctgagaatggatttgaagttttcagaagagtgtttgtggactttgaaggaatcagcttgagaaggaagtttctcaatggcttggaaccagaaaatatccacatgatgattggtatgacctagccttggttattggggaaggctgtatatatcattggggaaatttctggtcctcagttataaaatgaccctcagccaggtgtggtgtctcacgcctgtaatcccagcactttgggaggctgaggcgggcagatcactggaggttcaggagttggagaacagcctggccaatgtggtgaaaccctgtctctactaaaaaaaattagctgggagtggtggtacatccctataatcccagctacttgggaggctgaggcacaggaatcacttgaaccccggaggcagaggctgcagtgagctgagattgcgccactgcattccagcctgggcgacagagtgagactctctcaaaaaaataaaatgacgctcataatcttctctaatcggttcttctttccttggtcagggtctatgacaatcgactgcttaggaattctaaatgatctctccgactgtgaagataagctctttcctattggatatcagtaagtagcactataaagagaagagagcagccccacaacctgaacacactgaagccatgtgcaggtcattaaatgtagaggcatacctgttagctactttaaactgctactaaaaattaatcacttattttgctagttctcggattcgtctgcttgtagattgggactatgttagcggaatccagttatagaaggaaagtattattgacataatttcagaattacttaaaaataaaaccttagtagaaaacacaaggtcagtctcttaagattcctccaaattccattcatctccatgcagaagtgcagattgtttttatggataaaacagctcatgccctgttcccaactttacagtttataagtccttctaaaactataaatccacacaataatgatcaaatttttcaataagaatttataatcttacctatatgaagtaagttgttaaaatgtctaacaagctaacaatataag

SEQ ID NO: 67592 - DNA, 1156 bp, Homo sapiens
acttgaggctgggcacagtggctcacgcctgtaatcgcagcactttgggaggctgaggcaggtgaatcacttgaggccaggagttcaagaacagcctggccaacatggtgaaaccccatctctactaaaaatacaaaaaaattagccaggcatggtggcaggcacctgtaatcccagtaatcccagccactcaggaggcagaggcacaagaatcacttgaaccagggaggcagatgttgcagtcagccaagatcacgccactgccctccagcctgggtgacagagtgagactgtgtctcaaagaaaaaaaaaaaaagatgtgatggaacttgaattcgattcagggagtactatgattgaaagctgggggaaaagtcatttacttgggaagtctcatttgcttctagttttacatttacctgatagctgactttttattggttaatttgtttgatattttaattgggcctttttagttaagagtttttatttcctgccacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggtaaaagactttattgacctacttgacctaagaagatcagcccaaagactaatttgtaattctttcaggcaactttatcttggtgacttttactgattgaaaatgtagattccgggtgggtgaggtggctcatgcctgtaatcctagcactttgggaggccagggcaggtggatcacctgaggtcaggagttcaagaccagcctggccaacatggtgaaaccctatctctactaaaaattcaaaaattagccaggtgtggcggtgcatgcctgtaatcccagctacccaggaggctaaggcaggagaatcgctggaacccaggaggtggaggttgcagtaagccgagatcgcaccactgcactccagcttgggtgacagagtgagacactgtctcaaaaaagtaataataaataaatagaaaatgtagatttccagttacctataaatatatatatatatagtcaaat

SEQ ID NO: 67593 - DNA, 4634 bp, Homo sapiens
acccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggtgagagatccaaatactagctaggctgggtctgtgggatttcatgttgtaaattaggggctgttgatgtggtagtccgggagagacactcttctgttcaagttgcattacctgggagttttccgggttttgactttttttctctctgagtggtgatttatgtaacaaaatgtagttccatccatgggcagtttgtctcttgaatagaaccacatctaatcactttttgctctgatttcaaacagtgttgctgtttgttcctgtttcttttttactgaggcttatactagaatgattattcttatcttgagggcaaagctccctcttgtagatccacagagtcctttttttaaaactttatcattgaaagccaagcacagtggctcatgtctgtaatcccagcactttggaaggctgaggcagaaggattgctggagctcaggagttcaagatcagtctgtgcaacatagtaagaccctgtctctacaaaaaattttttaaaacagctgggtgtggtgttgcacacctgtagccccagctattcaggaggctgaggtgggaggattgcttgagcccaagagttagaggctaaatgatccatggtcatgtcactgcactccagcctaggtggagtgcacctatgtagccaccactcggatcaagatacagaacatttctagcaacccacaagggtgtcttctcttataaggtcagtgccccctcaaagtaaccattattctaacctttatgaccttaggtcagttttgctggcttatagactttatcagatcctgatagagccatttctttcgactcacctccacattcagtacatatttactggtggtttgtcttgaaaagatacaaatgcctgtgttccaggactccaggagcagaggctgagcagcaggatacagctagcgtggagcagtcctcccagaaggagtgtgggcaacctgcagggtaagctgaagaattcgtcttttaagactaagctctcagttttgtccacctcatttaaaaaatagttcttccaggccgggcgcagtggctcacgcctgtaatcctagtagtctgggaggccgaggcaggtggatcacgaggttagatcgagaccatcctggctaacatggtgaaaccccgtctctactaaaaatacaaaaagaattagccgggcgtgatggcgggcgcctgtagtcccagccactcaggaggctgaggcaggagaagggcgtgaacccaggaggcggagcttgcagtgagctgagatcgcgccactgcactccagcctgggcgatagagcaagactccgtttccaaaaaaaaggtaaaaaatagttcttcctgattcacattgatttttgttttcttgccaaagttttttaaatgaga

SEQ ID NO: 67594 - DNA, 3151 bp, Homo sapiens
tttgattaggaaacaaatggtcacttcaagattagagagttctgggtataactctattgaggacagttgcttattgaaaaactatcagatcgtcatactagaaattctaccacagagagcataacttcatgtaaaaaaaaatctggttttagtcaccactttctagcaatgacctaggcaagctctttgagtcttgggtttgttatctataaatgggaataataaaccaactgtggaatgttgttaggcttagagatcatttatgtaaagtactctacatgtagtcagtgctcagtgagcatttgttactgcaaccactatctattttctccctattagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaaggtgagtggattaaatcaggttgacccatcagcagaagccctgtttcagctagagcttcattttctgagtattagcaccatttaggtggctgttttatgctagatggtagggggatacctggaggcatcatacattttccttgtccttgagaagtttgtcttattggagaaatagccatattttacatgaaaagttaatgatacagattatgttttcaacattgcacacaccttagcggagcccctgagaactctgcttccccctccagccttgttttttgccattccctcatgcgccttctgtgcccttctctctcccttgtgtgccttcacacgtgctttctcctctgcctggagttctctccctgccctcaatcacctggtgagctccagctcacccttcaagatccagctcagacggtcttccctgaccttctgaggtagctaagccctccctctccctccttttgaatcttacatgttcttctctcatagcttacattttgttttgtccgtgtttgtttacttttatcactcactcaacagcgagctctccataagggctggaattttattttcttattcatctttgtatcgcaagcatctaagtgttcatccacctttgaaggactagtaaatgttctctaggctgtaagtactagaagagttcaaagaagagaaaggtcaccatgggtgagttagggttatcaaaaacccatgaagataaatagaagattctattaaaggagaaaatggaatttgggttaggcaaagaagaatgcagggctctctaggaagaagaagggaggtaagcaaagttagaaaggcaggactgcatttggtgggtttagagtagtgtcaggtgagatggcattgaaatccatgtgaggtaatagtgaaagagaaaattgggaaggtggatagggcacaggttttagagggctttcagtgccaaaccttgaggactttgaaaacttgagggagtgaatagaagcagaatttcaggaaacataatgtgataagctctctatatgagacagattgagcatgaactggagatgctcaaagacgagagtttactaatgagagtattgctagagtagagatgtctggtaataaagcccacattcggtgggaaaagaaaggaaaggaaagaagaatgagtacacttggtggaatatggagaggggagagtcaaagatgaccctaaagattcaggcctgggtgactaaaacaaaagataatgcatggagaacaaaggagataagtaaggagtatgggggttccacagaagacattgatgtggagtgatgtaagaaatccatgtggaaatgcctagcagacaggaaaagatcacagaatcttgggttagagctggaaggaactgtaaggattttctagttctgcctcttaactttaaggaacagagaggttatgatcttcccacagtcctgcttaaatcattattactagtgctgttttgattaggggtacagggaacataaaaataccaaacattcaggtgtgagacccagacttccatcaagggatgtgaatgcgttggggattcagagttcatttcagaaggtctgactttccttagtgcttctgtgtcctccaacagaaagaagccctgctggggagtgtaccttttcggctcctttcacatgtaatgaactgacttaaactctaagaaaaataacaaaacactgctctaggagggcaagtgttcacactgtagggattctaagcagtgcttgtgcacatcattggtattaagaagggtttacgtgcatattttctggcttacgggttttctttatttcctttcagatgcctggaagtcattgacagataaagtccaggaagctcgatcaaatgcccgcctaaagcagctctcatttgcaggtaatggctggaggtgttattccactcctgtctcagaatattatggtaaattgttcgcctaaggcagagttgattctgtgaaaaaaaaatcagttaaaaatttttttcacagctttattgagatttaattcatataccatacagttcacccatctaaagcatacaattcagtggtttttaatatattcagagttgtataaccaccactactctataattctagaacattctcatcatccctaaaagaaaccccctattcattagcagtcattcctcagcccctggccaccacaaatctactttctgtctctatgtatttgattattctggacatttcatataaatgaaatcagacaatatgtagccttttgtgaccgtcttctttcactcaacagaatactttccaggttcttcccttctgttacatcttcccttccacatcagtacttcattcctttttattgccaaatattccattgtgtagatataccatatgttgcttatccattcattagtcagtggacatttgggttttttctattttctgctacgaataatgttgccacaaatattcatgttcaagttattgtgtagacatgtttttattttttttcagtatatacctcagagtggaatggctgggtcatatggtaactctttaactttttgaagtactgccaggttttttttccaaagtggctataccattttacatttccacctgcaatgcacga

SEQ ID NO: 67595 - DNA, 2071 bp, Homo sapiens
aatagtccatagtttggtggcatgcttttttcacttagccgtctatcacaaacattttccatattgatagatctgtatcagcatcattttaatggctatctgatgctaatttcgagctaatatgtactataattcaccctggagcagcctctggcagagtgactatagcataggcatttctgtaggaccatgctgtttcctgttgactgcgctcctcacttccctggtgcttctgattcttctaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggcaagttcccttcttttctgtcagcagttttgggtctcgattttcttatctcatgacactgtcatcttcccacataccctttgagatttccagttttaatgccatcatcctttactgctttattaaagcatttctctaaatatgttttaatcttttggccccaggaagtcagcatttgacatgtttaacttcctggcttctaaacatcgtcagcctcctgaatacaaccccaatgatgaagaagaggaggaggtacagctgaagtcagctcggtaagtcttgagtggggagcagtcattagaaactgctttccctctcctccagctggtcagggcactacgtaggaatttgtttgcatcagaatttcctggataagatttaaaaggactgaaaaccatttgtgttgaagtagcagtaggtgcctggtaaggagtgaggaatataaggtacagaggagaaattcaaagaactgtaagatgcctgttttctttaatgatagtatactctgtcagctttggttgtaccaccatagttgtcatggtcagaaagtactatatatactaaaaatgggactcattggccaggcacagtggctcatgcctgtaattccagcactttggaagtccgaggcggacagatcatgaggtcaggagttcgagaccagcctgaccaacatagtgaaaccctatctctactaaaaatacaaaaattagcccggcgtggtggcgcgcgcctgtagtcccacctactcagcaggctgaggcaagagaatcgcttgaacccaggaggcggaggttacagtgagccgagatcgcaccactggactccagcctgggcgacagagcgaaactccatctcaaaaaaaaaaggggggcgctcattttataaggcactcgttcagtttggcattaaacaaagagtgtactaattgtctctaggaaccttcgattcaagactcaaaacattatttcctgaaaaaaattcgttaatagtatgtcttatctcttaggagggcaactagcatggatctgccaatgcccatgcgcttccggcacttaaaaaagacttctaaggaggcagttggtgtctacaggtatgactaaaattctagaaagaattacagaaaacgaatgcagtttttcaaaatcaaagcagaccaaatgctggagtgaccttcctcactcagtaagtgaggattttacggacactatttattgaccctcatatcctgggatcctgcacctccttgtgttgaacaaggactttaacataataagcattaaaatattactgcttccagcgggtcacagaatggaaataactttcatctttggccatgtgttagatggccaaatcaagtgggtccaaatttttattttctcaagtatatgtccctcctggggaactaacagaccaggagaacttattcatgtattcacgcacttaaccttacttgcaaaatttgtgtctgacctcttttccatctttgtcctaggtctcccatccatggccggggtcttttctgtaagagaaacattgatgcaggtgagatggtgattgagtatgccggcaacgtcatccgctccatccagactgacaagcgggaaaagtattacgacagcaaggtaagtctcccacttgcactcacaca

SEQ ID NO: 67596 - DNA, 2617 bp, Homo sapiens
tcttaaaaaaataaactctgaaatttgtgaggggcccagtaaaaatacagaatccactctgaggattagtacagaaagttgctcttagaaggtttgtctgagtggctcctagtatcagaagcaaatagctatacaagttttaggtttctctctcctgcagagacattagaaacctctagactagtggcctgtaatctaggaaatcctcgtggaagcatcttgaaagatagtactgggagaaatctggaaattttactagaagaaactttctcagccgctataggtaacatcaagagaagattgggacatgttcttaaagctgagtttataagaaatgacaagttcttctcccttcttctgcatgtgcagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcata

SEQ ID NO: 67597 - DNA, 2885 bp, Homo sapiens
tgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtttactgtttctcctgggggcaggggcagttgagaaataaccaagtagtctgccaagccagggtcaaccctccaggccacaggttgagcaaatgctacagccatggacagggagacactcctcacgaaggggtggtcctcatcctttcagatcaacttcctgctggaggctccaccctcaccacgtccctccctcttctctcatctggagtcaccttttgggattttggagttgagcaccatggggactccaaatgatcaggcagtgctgcaggccatcttcaaccctgacaccccatttggagacattgttggattggacctcggagaggaagcagaaaaggaagaacgagaagaaggtgggcatttgatctggagt

SEQ ID NO: 67598 - DNA, 1036 bp, Homo sapiens
gcagggccctccctgtcccccacacaggcacgcccccatgcctactgtacaaggtgctgtggagtactggggtggggtatacagcaggccatgccacacttggatgctggatgacatctgaacacccctggccaaagagctccctctggaagggcccagtcatcacatgcagggcccaccctgagtcagcatgaggggcttacgtccaactggtagccttgccaaagatacctgtgcccctgcgggttacagcccagtgaaatgcatcacgtgcatgacatggagggcaccccagccaggagggcaagcaaaagtggcagtggcataacttcttcacgttggtgacctagctaggtagaggatgccttggaggaacgggagggtgtccagaggccaagagaatactcctgtctcgccctcggctcagagccagatctcatcactgctcacgctggacactcgatagatatagcccagcactgggaggcggatgaaacctgcgggatcaaagaagcccgcggggactcagtaacgcttgttccttggaatttggagagctctctctgcctcctgggcacttggaggcctctggcataagcacagggctggggggcagaggaggagggtggcaggccccttccccagtaccttggctggtgaggaggccgccgggctccgggtccagaagctctggccggctgttgttctgagccatctgccggtctgctggtttcactgctggttgacaaagagggcagtgttcaggacgaggagtgtgcctgatgaggcctcgcccctcccaagcaccaagttctttttctcagaagcacttctggagattaagcaggggcaaagagcagggccctagatatacctctggaatctggagtgaggtcattgagctgaaggttggacgggagggacatgttctcccgtggcaggcgcacgttgttgagttttaggttgttggagtcactacagggaggacaaagttcgggatggatatgagtcccggcacaggcactcatggctgcct

SEQ ID NO: 67599 - DNA, 2002 bp, Homo sapiens
gctgaaattaaggaactcttccagtacatcagtaggtgagtactaggacctcccaccataccccactatccctaccttgccccaaacctttcctatctctagtctgaaacagggccattccccttagatttttttttagcctgaatagtaaagtaactttttctgactgtctccaccttcccttggcaatatctcctaggtacacacctcagttgattgacctggaccacaaactgaagcctttcattcctgattttatcccagctgtcggggatattgatgcattcttaaaggtatagtcagtacatcctgaaaatgactccttaagtgtttcttctgatgcccctgttactcttaacagtttccctaatttctttgactagcattggctagtcatgttcatttcattggagttcttaaccttgctctcaactccaaattacactcattgctcttaagtaatacttaatatctcattacacattaacagtttgtcatgtatttgcttcctaattatctatgacaacaggttcatatttaagctgctatggataatattttttttctggatagtattgcgtacagcatgataagcatgcttttaatactagtaataatgatgaaccagaagtgttcttcctcttaacttattggaaacattttcctttctgctttcttacctttttcttaaccaggtcccacgtcctgatggaaagcctgacaaccttggcctattggtattggatgaaccttctacaaagcagtcagaccctacggtgctctcactctggttaacagagaattctaagcagcacaacatcacagtaagatactagcttagtataggccccagctggagagggccaagagtggaggaggccttgctggcactcatacagttgacttactgcctgtcaaaagagatgggcctgggtgcggtggctcacgcctgtaatcccagcactttgggaggccgaggcgggtggatcatgaggtcaggagatcgagaccatcctggcttaacatggtgaaaccccgtctctactaaaaatacaaaaaaaaaaattagcagggtgtagtggcgggcgcctgtagtcccagctactcaggaggctgagacaggagaatggtgtgaacccgggaggcggagcttgcagtgagtcgagatcatgccactgcactccagcctgggcaacagagctagactccatctcaaaaaaaaaaaaaaaagagatggttattgctttgggccagctctatttttaaatgacagctttatttatatataacttaaataccagcaagtttagccttttaaattgtacaacttattagttttaatataatcacagttttgtagccatcaccactacctaatttagaatatttcatcacctcaaaaagaaacttcatacccattactattcactcctcattctcccacttcctcctagaccctggtaattatttcattcctttgttatggctgaataatatccactgtatggatttaccagatttgctttattcattctctagttctgtccactcttattaataatggtgctttgaatatttgtatacaagtttttgtgtaggtatatattgttattctgttgggtatatacataggagtagaattgctgggccatatggaaactctatgtttagccatttgaagaactaccaaactgttttccaaagtggctgtaccattttacattcccaccagcaatgaatgagagttccagtttctctacatcctcatcaatactttttgtttgtatttttcattctaaccatcctagtaggtgtgaaatggtatttctttttttttttttttgagacagttttactcttgttgcccaggctggagtgcaatggcgtgatcttggctcaccacaacctccacctcccgggttcaagcgattttcctgcctcagcctcccgagtagctgggattacaggcatgcaccaccacgcccagctgattttgtatttt

SEQ ID NO: 67600 - DNA, 1040 bp, Homo sapiens
aatatactttatgtataataaatttgttattcttagagcaaaatgtgactaaaagcagtttttggtgtcctgtaacgtgtcacaattttgtgtgccaatagctgctttaccataaaaacaaattaattttaaacaactggaatcaaacgtgttaacctcagtataagccatacggtatatagaaaccaagttttgaaaacctacttttaaagggggccaattggtcatccttcaggtcctaagggagggcatgccacaggctccaggccacagaggcaaagacatggaccctgttccacctgcccctgcaagtctcaagtgccaccagaccccttctcatgtacttgagagggtgggatggtacagagagagccagaagcacagaaaggtaggttataatgtcaagaacaaaagagctgtttatcttgagagagaatgtgtagtcattttatgtaatttatggggtaagggaagggaaatacagataggtcagatactccatgaagagaaatatcactgaacaaaaatggaaagtccatagtccctgggactgctggtttgatgggcacaaggttgattttgaactttcttcttttgatagtttcaagcagcttatgctgggcagtcttgcaaattaagtattagatttcctctctatggtctttgtgagtattaagacccctaaaatttctattcccacttcatattccctgattttcttccaaaataactagagttgccatcctcttctttgaaagtccatagcttttcgggccgaagctgtctaaagtgtacacagggccctgaagatctaagtaatatgtacaatagataaaattagaatttataccccagcctcaagtagagaaatggaatagggttctagaaagtggagtccccatttgtagctgagcaggggcagaagaaggctctcaagccccttctgggaagtgcccccttctctttctggtgacgaggtgccaggtggttggtgtattggttagagcaatagagaactgggcataggtacatttgatttt

SEQ ID NO: 67601 - DNA, 1044 bp, Homo sapiens
ccacacccagctaattttagtatttttagtagagacggggtttcaccatgttggccaggctggtctcgaactcctgaccccaactgatccacctgcctcggcctcccaaagtgctgggattacaggtatgagccaccgtacctggccagaaacccacttttgatagggtggtcagggaagacctaaaggggtgacatgtaagactgatagatggcagggatccagacactgaggaaaagtagaccaggaagaggaaacagtatgtgagatgtgaaaaaccttgaagcctgaaagaacttggcttagtttgaggacctgaaagagaccagcttatggtagaggggacactaccgtatgatatggtcagatcagagaggtagggcaggaagcacaataagcagagctttggaggctgtgttgctgtcgtgtgtggaatggactgttgtgatggctgagttgagatgatagtggcttggcctctggtgaggaagctgagaataaagaaaagaggcaaatacggtataagacattgtcgcagaatcactaagacttggtgatggattggatttgactcgagttaggaatcaaggatgacatccagggtttctgtttgtttattgtggtaaaatatacataacataaaatttgccattttaacaatttttaagtgtgcaattaaataacattaagtacattcacaatgttgtttaaccatcgccactatttccagatcatcctgaacagaaaatccatacccttcaaaacaatagttccctattgcttgcttccactcctccctggtaaccactattctactgtctgtatgagtttgcttattctgggaaccacataagtgaaatcatactgtatttatccttttgtggctgacttacttcacttattgtgatgttcttaaggttcatctgtgttgttgaatgtagactttctttttaaggctgagtaatattccattgcatgtatattgcacttttttttttttttgagactgaatttcgctctgtcacccaggctggagtgcagtgg

SEQ ID NO: 67602 - DNA, 1056 bp, Homo sapiens
cccaaggaataatttattgctataagtatgttccattccatggcaccctgtggaggggaaagactatagtgtaatatagtgctagaaaaggacttacagagtgctgcgaaatttcccctggaatgtgtctacatcctggtaagactgatctgggagcaactgcatccccagagattgttgtcctaggggaacaaacgcacaccttgtttccagattgaagggctaactctacaccagcccgaaatttatcagccgcgttgccacccatagccgctagatgccgcaacagacgtatttactgaaaccatagacaaacaggcgacttggccgcccagagaggctttatccgtgactccttgatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacaggtaattagtactcatcccagcaaaaagggaactgtctttctagagaggcttaagaggactcccctttaccccattcccggttacctcttccaatctccgtggtaactgttccttcgtcacctcaccaccaaccgtcctgcttcctttattcccccaagaaacttaggtgggatcctatctgcaagataagggtgaaagtggaggtgatgattttgggattatcggatgggactgagagactggagtttcccctctcttcggggaccctcccaccctaccccgcctcagcccaccccaccccaccccaccccaccccaccccaccccaccccagaggtgactccagagacagaactctttctagaacctctacagccttccctgagaaacctcaacagccttggccatctacatacaaatagtgttctgcccttgcgcgtggtcgtacagctttgggaagctg

SEQ ID NO: 67603 - DNA, 1317 bp, Homo sapiens
tacattttctgtcactgtagttgtttttttttttttctgttactgtagttttcaaatgcttagacttacagaactttaaagacacagagcactttggatttcatgtaaactaacctcctatgttagggatatttcaataatcaattaagtgacttatccaaggtcacataattagtggcaaaggcagaacagaaacctaattctccaggtttttttacttgaggcacttaacaattcatgtagttaagtctgtgtaggagagagttgttatttagtccaaagatagtgtactcaaaccatgtaagaattattaaaagttgtttggcaaagctcaactttatgagggaattttttttttttttaaccgtcctggagagatcatctaacttatgggccctcagttttcacatctgtaagacaatcaagggctcttgcaagttccttttagatctggaatgttttttccaaaaatgttaaaaaaaaaaaaaaaaaaaaaaaccaaaaactttgtaatcatatttattaattcttcctcagagaaaatcagatcaaatttcaatagggaaaattgttaacttaccttttagtatatgctatattttaataattgttaaaccagtaaacattaatgtaaagaggtttattatttcaagaactttaagaagacaaatgttaatttaggataggataaatttatcatgtttagaggtgaccataccttctagccatattagtagctgtaacagagagacctgtgtcaactgcctggaacctgtaatttgtggtgtcctgggtgttcggagatttatgctatacttagtatggggaactatggtcctattttggaagccttgttttgcttgtatctggataatggaatgactcaaagagagacatatgattttaccctacttctttcttcatcttgacgtactgaaagcctggaattctggccaggtgtggcggctcatgcctgtaatcccagcactttgggaggctcaggcgggcagatcacttgaggttgggagtttgagaccagcctgggcaacatggcaaaaccctgtctctacagaaaaatacaaaaaattagccaggtgtggtggcctgtgcctgtagtcccagatacttgggaggctgaggtgggagaatcacctgagcccagaaggttgaggctgcactgagccaagatcacgccactgcactacagcttgggcaatagagcaagactctgtttcaaaacaaacaaatcctggaattcatcaaagcatgatctaaattctgtttctttctttctttctttcttttttttttttgagg

SEQ ID NO: 67604 - DNA, 1381 bp, Homo sapiens
tggtctcgaactcctgacctcaagtaatccactcgctttggcctcccaaagtgctgagtttacaggtgtgagccactgtgcccgtgaaagtcagtattctattacttgtcatgtcagctggtcgtggtagttcacgcctataatcccagcactttgggaggccaaggcaggaggatcgcttgaacccaggagttcaagaccagcctgggaaacatagcgagatactgtctctactaaaagctttttaaaaattagcgaggcttggtggcacacacttgtagtcccagccactcaggatttcttgagcccaggagtttgaggttgtagtgagctgtggtcttgccattgcactccggcatgggtgacagagtgagaccctgtcttaaaaataatactactactagtcatgtcactaaataaatatgtcattctatggaacatttcctgagatgctgagaaaacagatgtgaagaaataattagtacttacttatgcatatgttcctggcaggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcctatggagaaactgtatatggtactgatcactaccaaaaacagcaacattttagaagatttggagaccctaaggctcttctcaagagtggtaagagtactgctataatactgggttccactttttgttttacattttatgtgaaactagtttttcctccaaagcagctgatgctaaccagtttgcaggttcctactccgcaccccagcgacttattgctgcagcaccttgtttattcagcagacatttattgggtgtcctcttagactatagatgtctcaaaagaatatgggaactactgtttcatttcccagttcttaagcagttgttctaatctgccgttctagttctgacacttgtttggctatgctttttaggtaatgttttttaggtaagacttactgatccagagacagacacacacacacacacccctcttctaagactttatgccaaagtcttgcttaaaatgaagacttaggtaagacttactgatccagagacagacagacagacagacacacacacacacacacacacacacacaccttttaagactttatgccaaagtcttgcttaaaatgaaggctaaggccaggtgcggtagcatgtgcctgtagtccaagctactcaggaggctgaggcagaaggattgcttgaggccaggagttcaagtgcacaggcattatactttagt

SEQ ID NO: 67605 - DNA, 1798 bp, Homo sapiens
gagatcgtgccactgcactccagaccgggtgacagagttagactttgtcttaaaaaaaaaaaaaaaaaaaaaatcagggagttaggctgggcgcagtggctcacgcctgtaatcccagcagtttgggagactgaggcaagcggatcacctgaggtcaggagttcaacaccagcctggccaacatggtgaaaccccgtctctactaaaaatacaaaaattagctgggcgtggtggtacacacctgtagtcccagctactccggaagctgaggcaggagaatcacttaaacccaggagatggaggttgcagtgagccgagatggcaccactgcactccagcgtgggcagcagagcgagactctgtcccaaaaaataaaataaagactagaagtagctaataaagggatttaggttattgaaatttatgtactctaaaggataagacttggaaatatagctgctgataaattctaaatctttcttttttattggtgtccacgcttagatccctgaatattgccgagccttagaagagaatgaaatatctgagcactgttttgatttgatttttgcttttgatgaaattgtcgcactgggataccgggagaatgttaacttggcacagatcagaaccttcacagaaatggattctcatgaggagaaggtgttcagagccgtcagagaggtaaataggatcttctctgggactacctgtttgtatgtctttctcttaggcttcactaatctcattttcctatttttacttactaatgtagactgtattcaaaactatgtccaggctaggcacagtggctcatgtctgtaatctcagcactttgggaggcggaagtgggagtatcacttgagtccaggagttcaagaccagactggacagcgtagtgagaccctgtctctataaaaagtaaaaaaaaaattagccaggcatggtagcacgtgcatgtgggtcccagctacttgggaggctgagatgggaggatcacttgagcccaggaagttgaggctgcagtgagctgtgattgtgccacttgcactccagcctgggtcacagagtgagaccctgtctcaacaaaaacccaaaaaaaaaagctacattaatgtatgtctttttctgtagactcaagaacgtgaagctaaggctgagatgcgtcgtaaagcaaaggaattacaacaggcccgaagagatgcagagagacagggcaaaaaagcaccaggatttggcggatttggcagctctgcagtatctggaggcagcacagctgccatgatcacagagaccatcattgaaactgataaaccaaaagtggcacctgcaccagccaggtataatccagtgtactttagaataccaggtgaagggtgtatatgtgtctatctttgaagtcataatctgatttcttggaaagctgtaaataaagaaggacttgatgaagtaagatatgatgttacatttggccacatacaatatgaggataaagaagaaatctgaatgtggtgtttttccttttgtataaaagagagttataaattatgtcatgacctcagtttcctatgagagttgccttattgtggggaggaaagggctatttaatgctttatggaatgtagatttttaatcttgatgttcattgattgattttaggggaaatctgtgaattacccaaaattatatacaaaattttgtgcacaggtgtatttctctggacgggagatacaaaattttcatcagatcatgtgtgcttgtaaaaataaacctttgggtaatgaatttcaaattcttc

SEQ ID NO: 67606 - DNA, 1112 bp, Homo sapiens
gttctgtatgaaatgaacagggttacattgggataaatttcttgattcactaaagccgctgtgctcttcctagtggttgctttgagtgagacagaggcttcacacttttaaaaagatattcctgagtgcagtggcccacacctgtaatcttagcactttgggaggctgaggtgggcggattgcctgagctcaggagttcaagaccaccctgggcaacatggtgaaactccatctccactaaaatacaaaaaattaaccccttctccactaaaatacaaaaaattagatgggcgtggtggcacacacctgtagtcccagctactcaggaggctgaggcaggagaattgcttgaacccgggaagcagaggttgcagtgagccaagatggtgccactgcactccagcctgggcgacagagtgagactctatctccaaaaaaaaaaaaaaaaaaaaaatgttggagatcatcacatattaaagagaatttgagacactgtttttttctaaatgataaattgcctcttgagcacagagcaaacttttgtgaaggtaaaatggtaccatgcattgtcttaagatgcactcctttatggtcttgactctgatgcctttgtttctaggaagacctaagaggttggaacaaagaacatggtaggataacaaaatattttttgtagcctctgtagttcatccagccaaacgtatgtctattactgaatatgaatagattgtacttaatacttgcctctagcagcagcagtttttaatcttttaaaaattggattatacattcatatagtacaaaattcaaaagttgttaacagtcagaagtcttcctctcactcagccatgccagtttctcattttggagacaactagtattaacagagttttttgtgtatccttctaagggggatggtctgtgatatacagatgaataaaaaacatgtatacagtgtgtctatttttcccccttttatgcaaagcagtaaaactagacacgtcttccaattgcatttttcatttaattattttggagataagaatctccttatttgaaactgcagagatatgacatctaaatgcgcaataccttaccctagactggatcct

SEQ ID NO: 67607 - DNA, 1081 bp, Homo sapiens
ccttcagtattgggtacctactgtgtgccaggcacatagttgtttgtgttgggggaggtagaccatggaatggataaaggaggattcagattcagcataagttctatacagaggagcatctgtgctttgggaacacaggagagcacaactgtgcactgtcgtggtgacattttgcaatgggtcttgaagatcatttaggagtttgctaaggaaatgggctggaggagatagttccagcatacagggtgtattattaagggaacagtgagaagctcagataggacttgggactcatgcaggggaaggttatgatacaaggctggagggacatgttggcagcagtccgtaagttgcctttaccaagctgcagaggtcggggagaggaggagcactcgggaaggaacttacttccagccggcaccattgaatttagtgattcgcgtgacctctcctgtaggacgcaggctcactgttaaggatgtcagctgtagcatctgagcagtgccacagacaagttggcccaggccctgtgctttcccttgacagggatcctgccccttctcactgaatggtcacctctgctcaggtagtttgcccctttcctgccacctctgacctccagaggctatatgctatatgtatatgctaactgctctgtacacatcaagggagtgtgcttcctatctttttttttaaaaaataggtaaaagtattcatatagttcaaaaataaaaaatatataaaaaggtttaaattgagaattatgccccacccactacagtaactaattttataaatctcttgtgtatccttatagagtttctataggagaatataaacaaatactttttcttgcacaaaaggtggcatacagtacattctttttacctcctaatgtgtcttagagatcattttatatcaaatttatctatatctagacattatatctcgatataaattatagacttatttctgagtctgtatctgtatcagatatttctttctttctcttttttttttttttttttttttttttgagacagagttttgctctttttgcccaggctgaagtgcagtggcg

SEQ ID NO: 67608 - DNA, 4839 bp, Homo sapiens
aggcacagggttagtagaaactactagaaaagagcatttgggatgaggattgtgaaaacctatgtatcctagtttgtgttgctttcagaatgttaattttgtattctcttcttctgtaggctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagcttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccagaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgtgggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactccaaatgtgtgtgtggtatgtccttagtagcagctgtgtgcataggaatctgagcattttgctcaggtaattcatactgtgaaacagacatttctcaacccatcattcctgtgaagcccagttgaattcagagccccttcatctgttgtagatactgttccaccatgctgtcagatttcacagcctaaatggagaaccaagataatcggttgggaagaggggagatgtggtccataatatgtccaaatacatcagtaattaccacctcctacaattgttctcaaatgtaaagctgaacatacccccaaaaccaaggcatactacatcttaacagtatgaatggaattcatatgctgagaactacaaaccactgatgaaataaaagattgg

SEQ ID NO: 67609 - DNA, 1041 bp, Homo sapiens
tgctactggatagtgtattggaattggaagtacagacacaaatatttcctttattatagaagttttactggacagcactgctctggatttttaaatatggcccctcagctggctgatttttctttttttctttactgtttgcctttagaaaaagatacaatatctaaatttcagaatttgatttagcaaaaaataatttaaaactgtaacaaaaatgacttttttgttaactacattatgaaatttcgtaagtaaacagtttctgtagacgaagatatcaagaacttaactcatttggttttgaaagcagcttaatatcatggatcacttataaacagattttgggtagaactgatcgtctgggagaaataattatgggaaatttggggctgtatatgagtgttaatcaaatggaatacattgctttctcctaggaacatcgaaatcgtgtatttcatgatttccgaaatggcttatgccgcaatcttgtttgcactggtaagtatttttgtatttcctttacccagtgtttttctcccaagttgttttttgctttctctgttcatattacatagtgcaacctgtgacatagtccgacacaccctaccactacttctaggatttctgaagttgaaaatgaactcttgtcagctcctgatactgggttccatatctgaaactttagaagacttactctggcactcatacctcatctctgtcttttttttgggggggggggggagggggatggaatctttgtcacccaggctggagtgcagtggtgcgatcttggctctctgaaacctccacctcctgggttcaagtgattctcctgcctcagcctcccaagtagctgggattgtgggcgcctgctaccgcttagcccggctaatttttgtatttttggtagagacagggatttcaccatgttggccaggctggtctcgaactcctgacctcaggtgatcttcctgctttggtctcccaaagtgctgggattacaggcttgagtgcacccagcctcttttagacacatttttt

SEQ ID NO: 67610 - DNA, 1053 bp, Homo sapiens
tgagccactgcatcataaggcgcagtatttctatagcttcttaaattttgtaaataatgatgtatagcatgttctcccacctcaccccatattttcttatatattccttgatactgtttcagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacaggtaagaaatgattactaaaaggtagtgtagctctctgttattttagtcacaagtatttcagtaaattattaaaaattgtttttaagaattaaggaacagaaatactgcagtaagaaaaggaaatgaccactgcattcaagcgaaaaagacaaattaccataattgaaaacgatatttgactttattagtaattgtaaaacagcaagtttataataattttacctgtttaattggtaaagctaaaagtattagtagacgataatgtgagtttgtggacaaataggctacattgtaaatgtgggggtgtaaacttacatctctatcatgggcaatttgggagtatattttaaaattataaatgtatatataatgtgtgtgtgtgtgtgtatattttttttttttttggagatggagtcttgctctgttgcccaggctggagtgcagaggcgcaatcttgactcactgcaatctccgcctcccaggttcaggccattctcctgtctcagtctcctgaatagctgggattacaggctcccgctaccacgccaggctaaatttttgtgtttttagtagagacggggtttcaccgtattagccaggatggtctcgatctcctgacctcgtgatccacctgcctcagcctcccaaagtgctgggattacaggcgtgagccaccgtgcccggccataaatgtatatttttaagaatctttcctgaagaaaaaagttgggtaaatgcagggctgtaggtacaaagttgtttgctatggggtggtattgtcgtg

SEQ ID NO: 67611 - DNA, 1219 bp, Homo sapiens
atttttgtcatccctcccccattcctaaaagtatctcttctatcatgcttggttttacagttttatccaggcattttttttcccctaaatattaaaactgccttgattagatgggtgagtcttctgcatttgaatatttgtttgagatggaatttagttgcagtttggctgtgagatttggagaattggctgggtgcagtggctcatgcctataatcccagcactttgggaagccaaggtgggtggattgcttgagtccaggggttcaaaaccagcctaaacaacatgacaaaaccctgactgtacaaaaattagctgggcatgggggacatgtagtcttagatgttcaggaggttgaggctgtaagtgagccaggattgtgtcactgcactccatcctgggcaacagagcaagaccctgtctcacaaaaaaaaaaaaaaaaaaaagactgttagagaattaggcacttaaaattatatgctctcaaaagagcttttacattgacaggctggaaccagatatactacagattgctcccacaacgtatttctagagccatctgtgaccagttctaggtctggatgctgtggccagtagaataattgccattctaaaggtatagctttataggaacctagacttctttggaaggcttaagaatatactgtttttgtctgcttagcattatttgaaactttatattaactttggggttatgattgagaaagatggcctctctcgttgcttctaaaccctgggaacacctcttgaagactttttcgaaactctaagaaggtgaagaaatgagaagtagttgattattgagggaaacatggaagctccgtactgttggcaacaaaattttgtgccaggtcagctaaggtctaatgaggattaatagtttactatttatagttaggaattatagcattctgaatcctgtaaataagtcattcttcctgctaacaatcggtttatcatgattgaaaaaaatatttcctaaaaactcaaaggttttttttgtttgtttgttttgtttttttttttggtgtgtgttttgttttgttttctttttgggtggggtcggggagacagagtctcagtttgtcacactggctggtcttgaactcctggcctcaagcagttctcctgcctcagccttgcagagggttgagattacaggtgtgagccaccatccccagcctaaattagagatata

SEQ ID NO: 67612 - DNA, 2022 bp, Homo sapiens
aaagactttaaaactccctccaaaggatctaagaatcaaaacttcggtaagttggttgtaaaatacaagtagaataatggtggggaactagaagtgaggtatagctgtccctcggtatctggagggaattggtttcaggaccataacaccactgccaccctcctcctccaacccagtaagatagatattcaggctatatattcccattttgtggatgagaaaacaaatgctcagcagttagttctcttagcctattgttttcaaccgggagaatttttgtctcccgggggcatttagcaatttgtagaaacatttttgcttatcatcaataggggggaagctaaaggacagccctttacaacaaagaattttgtggcccaaagtgtcagtagtgctgagcttgagaaatttgacttagccaaagatatttgtagctcatgagtggtagaggtgggatttaacttcatatcttgtgatttgcaattcatggcatgatatttgtgtaaaaaaataacactattccaccagtccttaggagactgtgaccaagggccgggcacagtggctcttgcctgtattcccagcactttgggaggccgaggcaggcggatcacctgaggtcaggagttcaagaccagcctggccaacatgttgaaaccctgtctctactaaaaatacaaaaattagtcgggtgtggtggcgtgcgcctgtaatccagctgctcaggaggctgagacaggagaattacttgaacttgggaggcagaggttgcagtgagccgagatcacgccactgcactgcagcctgggtgacagagcgagactccatctctcgaagaaaaaaagaaggctatgaccaagtgctctttccccaaaacatagttttttaaaaagcttgtgtgtcaaagcagggacagtggtttttcttcaggaaaagttgaaatacagattaaaacaagtaatctgcatatatttatatttaagattgggcaggtaaagtactaaagtcagagaagttttctttcctttttttttttttttttttttttttttgagatagagtctggctctgtccccccaggctgtgcagtgagtgcgatctcacctcactgcaacctccgtctcctgggttcaagcgattctcctgcctcagcctcccaagtagctgcgactacaggcgtgcaccaccaccctggctaattttttgtatttttcgtggagttggagtttcaccatgttggctaggctggtcttgaacttctgacctcaggtgatctgcccgccttggcctcccaaagtgctgggattacaggcatgagccaccatgcctggcccagataaattttcttaaacacagataaatttaccaaaggacaccaaatttaccaacagtgttatttattcttttattgttcctttttgtttgactaggatgtgacctccacaaaaggaaatgagtttgaagattactgtttgaaacgggagttactgatgggaatttttgaaatgggctgggaaaagccatctcctattcaggtatgttaaccctttttatcacatatgtaaggttatgtgtcaaccattaaacagttttctttttgctctgcagaagtgatacagtgaactaacatttctctctcacgtatacacactttttctgaaatttttaagggtaaattagaaaatcatggcttttacaactctaaatatttcggtgtgtatttctttaggatattctcttacgtaaccacagtacagttaccttcagttaacattgataaaatacttctatctcatctgtcattctaattattaatggacccaaacatgtcctttatagcagtttttttcttctatacaggatccagtctagggtcaggtattatttgtaattatgtcttttttagtcattagcgtttccctagtgtttgttcttctttttatgacatcagcatattaaaaatacagcctacaaccccttcccccatccctcttttttttttttttttttggcaactgggtc

SEQ ID NO: 67613 - DNA, 1030 bp, Homo sapiens
gttgtccaggctggtctctaactcctgacctcaagagatcgcccgcattggcctctcaaagtgctgcgattacaggcctgagccaccagcacccagcccataaagtttaatagttgaaatttgtaagggcacaaaggtgtttttttctggaagtgtgaagttcaagtcaaaagctcacttaaatctataaggactctcggttgctattacaagtagaagaaaattaatgaattgtcttgtttaaattgtgtgatacttcagtgagttgtaatgcaattaagtataatgaatcactgacttttagagatgtcagagacttagagaattcatggggaggaaactgaagagaagagattatcattgacgagtagtgctaatttactagtctctttctacttaatctctggattgctttgaattaacaattttaaatgtttgatattggcctcattgtgtttttgagatagttcaaagttgtgtctatcctagcttggctcgtgatttggtctaagtgtagctgtattattaattctttaatataaaagatgagaattcttttaaaggggttcttttaaaagggaaacaaagtttttctgttgtgtttgctaatttaattttgtttgtttgtttcagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaacc

SEQ ID NO: 67614 - DNA, 1030 bp, Homo sapiens
ggagcgtccgccattttgggagcttcgagtcaacaataaaggaccgagggtgccgagcgggagtggcctcgttggtaggacacgggcccgagtcgcgaggcttggggtgaggtggtggggtcgaggtcagcggtgctttgggggctgtggggagccccccgggccggctctgggggactctcgggcggaggcctaaggcctggccgggcctggggaggaaggcggtcggcagctgtgtggggtgggagcgcctgagaggaggcgaatataggaatgtggtgcgcagcagggtcggcaggaggaacaggctaagtactcggagtagctttatcgaagatgagggaatatgaggccgaagggggcggcaaggacttagggggatgatggtggaggttatagggtacgaggcggccctatagggggcggcagggacatgctgtattggagggctcggtttagaagcaaaccggccgctgcttgattgcagtaggccttgcgggtcaataacaagagggtatttatggagcccccgactcttggaggaaaggagggggatttctggtttagggggtccatttggggcctccttgggggagtccctattgtttgctactaatggagcggttgctggctcatattgcgcagataagattgcagagccccaaccttttgtgtttatggtcagaagtgtgtgtgtttggggcgtggggcggggtgcggggggacaagaaatttcctttcagttacggggttccagtcattagtcaatgactctttcccgtatctctctcctttctcttcctcagcccccatttcccttcagaataaaacccagtcactccaacttgcaggcaaagctagaaaaactgcgctgcatttgcaaacaaaagctcttgttggcgatgacgatactgttttgggtgtgaaactgtcaattgctaactacgatctgtgaagtgctgtaattaactccgctaggggctcctcccaactagtctacgtttcttgttgtttgttttttgtttttttg

SEQ ID NO: 67615 - DNA, 1306 bp, Homo sapiens
ggtcatgtcccctccacaaggcctcatgacccagcagaatttcatgctgatgaagcagcggggcgtggggggcgaggtctacagccagccgccccacatgctctccccgcagggctccctcatgggccccccgccccagcagaacctcatggtgtcccacccccttcggcagcgcagtgtgtccctggacagccagatgggctacctcccggcaccaggcggcatggccaacctgcccttctagaagtcgctgccagggctggagccggggcaatgttgcaaatacgataaccttaacaaagttcttcccctcaatgttgggatggcctgggtcgcggggtggggtggagggggtgggagggggcttgtgtagggagtggcatttgtggaaaccagatgtgctggcagcttagggggaagtggcagtgtggggtgggggattttgcattggggttggttccatttcggccaccaggactgcccctcccccactcctcccaattcctatggagcctctctattttacctctttccgtgcatccctgcacccgccacacccccttcagctatgcttttggagtcctggatgggaatctggggggagagaggaaggacaggtcaggtctcccccagccccttctgctcctgtctcctcgtgtccgcattgctggagctccacctccctcttggtttctccgcacccgcccattttccttctgtctttacctgcttcgtatcctttccctgctgatgtggctgacccctctcccacccctccctgcaggcggctggccaggtgggcaggtgccagccggagctgtaaatagagcgctgcgcttttgtgctggtttgtgcgtgtgctgtatttctgtgttttgatagaagtcacacaaaaaaaaaaggataaaagaaacccttccccccttcttcaagttattgctccctccattcccctggacccagggacatgcagccctacatggccacccactgtttgcagtgtctctgggtccctaagggataccattcctgtctcgtccccaaatggtaagatgacgtaaatgacccactcctaaactgaggtcagaccacctaggcttccacctggtgagccctagcagggctgagacccccagggcggcagcctgtctgctgctgagtgattcagggagaacatgtgtgcacgtgcatgtgtgtttgcccacaccggtgacacggggccctggctttccactttggatgcccgggcatccgctgctgctacatcttagccagaacttgaagtcttttgtcccagtttgggatg

SEQ ID NO: 67616 - DNA, 1037 bp, Homo sapiens
ggggctatagagagaaatcagaaacaaatggtggcgtggtgggggccacgggctggcgaagtgcccaccatggcctgggcagtgccctctagggtggggcatcttagagaatggatctgggagggaccctgggtgtgggagaataatggggcctctaggcactcactctttcctccgtcctgcctgggcagaggtggcgccgcggagtaagcggcgctgtgtgctggagcggaagcagccgtacagtggggacgaatggtgctctggaccggacagtgaggaggacgacaagcccattggggccacccacagtgagtgcctgtcgatgccagggtgctgtagcccgtgatgttcctgggggatggacttgagaggactgagcctgggaaagaagtgaggactgggagtcctggatttttctctcccatcctacctctcagactctgtccctccctacactgcaactgcctcgcctctgccttccaggtgctcagtgaccccctctccctagggaccctaggtggggcagagtggagtggcctccttcttggtcacgtcacctgcacctctacctgtgaattcctggcctatgctgccacctactggttagtggagggagggcggtgaagcgtccagggacactgggagccgggcagttggctctgctgtgcaaagccctgctaagcctgggtgtgagttgccacttggccgtgtctctagtgcccttccctaacctctaattgactcctggcaagtacccagggtgtgtcaccaggacaagaagtgggtgtggagggatgcccactcctcctctgattcttttatggattcgcctatatcttgtccttccatgagtgatgggggagagccagatgtaacccctgcccctgggaagcttgtacatattttttttccctcaaagtttacgtttacatctttttgaggagagagacataagaaactagccagagaggctgggtgtggtggctgtcacctgtaatccccagaatttggggagctgaaaccggagaattgct

SEQ ID NO: 67617 - DNA, 1090 bp, Homo sapiens
acaaacagaaaatcattgtaccacttatgattttactctacacttcagctgtattgtgttgcttcgggcttttgcagttgccattgtctaaaacctgctttccttccctcatcacctagtttaccttcaactgttagctcaaatgtcactttttcataaaaggcttatctgaacaggttatctctatttcaagtggatgtagcaccatgtaaagttgcaaatgtaatttacgtaacttgtgcttaatgctcttccccaattatatgtatgctgtgagggcaaggttttgctcccctggcatgtaatagccactctacttacagacatctccactgttatgactgtgagcttcctgaggacagggttgtcttagagtgacttactgtgctttcaaagtttaacatcagctggggtgcagaattagcattgtggcagcagtcacacccacctcttttaaagtgtgctttgtctatcgtttctaggatttttttttttaatcatgcctagactttaactagcactttttttcccatttccaactacaggatataccaggagttggtaacatccactcaggtaaggtccagggcagtgtttttaaaaccctgggagatttttttttttttttgagatggagtcttgttctgtcgccaggctggagtgcagtggcgcaatctcagctcgctgcaacctctgcctctcaggttcaagtgattcttctgcctcagcctcccaagtagctggggttacaggtgtgcaccaccacacccagctaatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtattttcagtagagacggggtttcaccgttttagccgggatggtctcgatctcctgacctcgtgatccacccgcctcggcctcccaaagtgctgggattacaggcatgagccaccgtgcccggactttttttttttttt

SEQ ID NO: 67618 - DNA, 1015 bp, Homo sapiens
aaaccttactagagtctcattctgttgcccaggttggagtgcggaggggcagtcttggctcaatgcaaccaccaattcctgggttcaggtggtcctcacctcagcttcccaagtagctggaattacaagcatgtgccaccatgcccagctaatttttgtatttttggtagagatggggtttcaccttgttggccaggctggtgtgcaactccttacctcaagctatctgcccgtctccacctcccaaagcagtgggattataagcatgagccaccgcgcccagccaaaaaccttactagtttctattgtagcatctgttaagcatctcatcgtgctattctctccccctaggacttatcaaactggtttcaaagcacagagctcaagtaatttacaccagaaataccaagggtggagatgctccagctgctggtgaagatgcatgaataggtgagtaggaatgtgtgggctcatggtgtaggaggtagatacaaagctttatggttctgattcttttaatttttttttacaggtccaaccagctgtacatttggaaaaataaaactttattaaatcaaatgaatgagtatgtctgtttcctaagaaagacaatgataaagaatttggtggaaggtataataggggtttgttgactttgcttttagcctcatggtagttggtagagagcatgattagcttttttctgtatgtgactgcttcttcattgctgcagcttcagttttgaattgatgtctgaaaggaaataaagggttaacacgatgatgaagggtgacatctccaaaaaggaggttggatgggtaggttggagacccggcactgaacacacatacctggactgccagcggcgtccattattccagacgcggccaaaagagggcagccagcctgcactggtcctggagctgtgatcaaagttggccccaactcggtctggggggagttttttcaacttctgtttttcctctgtacaatgatagggaaacttttatttttc

SEQ ID NO: 67619 - DNA, 1979 bp, Homo sapiens
tttgttcaccacatacacactaaaaatcgccatcgctgccttgccgctcggaaactggtattcagcctctacccgacggcccctccccggaaccgcatcacagcacttgccgccggccccaccccagcctcctcctcctcctcctcctcctcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtatgcgtcacaactagcgcagactccggcagtatttaggcggtgcggcttgggaactagaatccacttcctgtcttccgcctcaggctagagggcgagcgcttcgccgtgggacttcttctgcctggctccgccttttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaagtcgccggcgttcttgggtttgaggactcagtggggagagccttcggcgggagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaaggccaaaaagaaggtagaaataagacctctctgaaagagactaggggtaactctctcgtaatcctctagtaataggtaacttgtatagtaagtggtttttcaggtgtagatttctagagtcaaaatgtgagagtttatcttcccgtcaccactcgttctttttcccattaggatcatgaaaatgggtctgttgtgcgaagtgtctgccgctgtgcctgctgtgttatttttaactgatctagtggggctcggcccctgtttgaaggccaaaaacgtgtcggtgttttttttttgtttttgttttagtaatgtgtaatttatccttgataacggtggaacagatttctctgacgcagattactcgagagggaaagggtgcttctgccagaaatactaacttgtttctgttttgttttggtgagcagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggtgaggggtgtatcctacatgtgtgtttttgtaggttaaattgtcttgaccatgttaagcatcttcagtggttttgctggaaaagcagaattaaaaaaaaaaagcgtggcttgaccattggctgttagtaatgtaattctgacgtcttactcctgatcctgagatgaattctcagggttcttagccacttttgtgccgtggaccctgtggcagtttagtgaagcccaaggatcttttatgtttcgagtaaatggatgcatagaattacagggacaaccgtttttgaaataattagattactattttgaaacaactttgaaaatgtttaaaacctttatggtaaatattttgttgatgtattaaattttaaaaccagaaatttagtacggtctactcagtagtatggtctgattaccataattccacaataataaggctcagctaactatagtgactgaacgtctataattctagcactttgggaggccaaggcgggtgaatcaacggaggtc

SEQ ID NO: 67620 - DNA, 1039 bp, Homo sapiens
atgcccgccaccacacccagctaattttttgtggggtttttttgttttgtcttgttttgagatggagtcttgctctgtcacccaggctagagtgcagtggcgcgatgttggctcactgcagccaccactacccgggttcaagcaattctcctgcctcagcctcctgagtagctgggattacaggcatccgccacacgcccagctaatttttgtattttttaggagagatggggtttcaccatgttggccaggctggtctcgaactcctgacctcaggtgatccacctgcctctgcctcccacagtgctgggattacaggcatgagccaccgcgcccggccttcctggcacaattttatagacacatctgtttgtttgttttgtgaatacaaaaccaatatttaatctgaaactgattttgtccatgccacccagcatgttcagcagaggttatcttgtgttcagataaaactcaccttaatgctatttcctgttgcgtgtactttggaaggtgttaagtgtttttccaaaatgaaatttgaaagcaaaatggatatgacctttggattgccagtgtcattgcttcaccctcttcatttattgaaaactgcctgactttgtcccctgcctggcaatgtttctgctgagggactccaaaactgttagtaagtggcagagctagaactcaaagcctggtcttaatcaggtgggtgacataacaaagttacttcacttctctggtctcatcggtagattcaaagtcttgcctttcctgcattatgtggtaaaaagaataaaattaaaataggcttatgaaagtgttttgcaaaattgaaagtgctgtacaaatacaggatgacactatttgctccagtgtctacgctttggtaaccattcttggtctctctccagggatcaagtttgtggttctagcagatcctaggcaagctggaatagattctcttctccgaaagatttatgagatttactcagactttgccctcaagaatccattctattccttagaaatgcctatcagg

SEQ ID NO: 67621 - DNA, 1052 bp, Homo sapiens
tttagagaaaacagactttccttggtgtttatgtcatttttgtttgtttgtttgtggggttttttttgttgatgtttttttttttttttttttttttgagactgagcttcactcttaaccacccaggctggaatgcaatggtgccatcacggctcaccacaacctctgccttccgggttcaggcgattcttttgtctcagcctccggagtagctgggattacaggcacctgccaccatgcctggctaatttttgtatttttagtagagacagggtttcaccatattggccaggctagtctcaaagtcctgacctcagctgatccgcccacctcagccttccatgatatatgttgttcttcaagcagtttcccctggcttaagtggggagaaagcctcaggcctcacactttttttcctcaccctgggcccggcttaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgcaatctgtcttaatcgatggttttgggggaaagatacaggaagtgagtcaaaaatggttagggaattctgggaagatgattatgtgctagtaaaaaacataacaaatatgtgttcattaaataaatgaacataagattttgaagcatgagcattggatctagtcccagaattgctgctgatttcctggggtcctggggtggtggcagcagtggtggtggctgttatgatgatgatgatgatggaacatatttcaagcacttaca

SEQ ID NO: 67622 - DNA, 2071 bp, Homo sapiens
cactgcactccagcctggcaacagagcgagactccgtctcaaaaaaaaaaaaggactattcaaggggtttgttcagttgtagtcactccagagtagtaggatgtaaaccagaaacctgcaggttgggacttcattgtggagaacctttaatacccttctgaggagtctgttagcctcttggggctgaggccaggggtggcagtgatttgcagtctgagggaagaggctggttgggggtgtgattccatctgggacagagatgtctgctctctccatggctagcttggagcctctcctggtctcacccacaggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggtgagaacagggtacctggctgcatgttctgctggacagggagacagcctcctttccttcctgaggctatgtcttacccctggtttccttctaggccagactgaagatgcagagcccatttcagaacctgagaaagtagagactggtgagttggagcaaccatggttgagcacgtggatgttgcattagcccaggggtaggcaaactggcaggcacagcctgtttctagacagcccatgagcttgaatggcctttgcgtttttaaagggttgtttaaaaaaaaaaaaaaaaaaaaaggccaggcacggtggctcacgcctgtaatcccagcagtttggaaggctgaggcgggtagatcacctgaggtcaggagttcgagaccagcctggccaacatggtgaaaccccatctttactaaaaaaataccaaaaaaaagagtcaggcgtggtggcgcacacctttaatcccagctactcaggaggctgaggcaggagaacacttgaacctgggaggcagaggttgcagtaagccaagatggcgccactgcactctgcactccagcctgggcaacagagactctgtctcaaaaaacagagtaggcaaagagaccaaatgtggtacatgcatcctaaaatatttactagctggctcttcatggaaaaactggcccagccttcccttagcctcttcctcccttctgaggagactaacctgtttcttcccaaagcaggatccgagccaggagacactgagcctttggagttaggaggtcctggagcaggtgaggatggagccggggctacggtgggaagcctggtggggtctcaggaaatcctttgcaaagaactggggttggttcctctgtttcacctgcggtgattcctttgctcccccaaactcccaacagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatc

SEQ ID NO: 67623 - DNA, 1343 bp, Homo sapiens
gcgtcgctccagccccagagggagagaagaagcagaagcccgccaggaagcggcgaatggtagaggagatcggggtggagctggttgttctggacctgcctgacttgccagaggataagctggctcagtcggtgcagaagtaagtgaggacagctggtgtgtgtgtgtacatgtgtgtgcaaggtgggcaggatgtgggatggcgccctgggagggagggctgtcggacccagagtctcaagttctcacttgccctctccctcatccctacccctcctttgtcccatagacttcaggacttgacactccgagacctggagaagcaggaacgggaaaaagctgccaacagcttggaagcattcatatttgagacccaggtcagtgggcaggaggcagcagcccccccactgggcttacacctggctctgtgggccttgcctctgggcttgtgggtgcatgtgtttacatgtccccctccccaggacaagctgtaccagcccgagtaccaggaagtgtccacagaggagcagcgtgaggagatctctgggaagctcagcgccgcatccacctggctggaggatgagggtgttggagccaccacagtggtgaggggcctctcaggacatggcaggtggagtgggagctctccttcctctcccagggtcagagagagagaagagctggggcttgagcccataaagaaggacatggggctgactccaggctctgctgtcgtcccttccacccctctgcccaatcgcacatccatcagatgttgaaggagaagctggctgagctgaggaagctgtgccaagggctgttttttcgggtagaggagcgcaagaagtggcccgaacggctgtctgccctcgataatctcctcaaccattccagcatgttcctcaagtgagcagcccctgaaccctttttgcagtcctgccaaggccactggttttcattcctaccagcttcccactccccacactccaggcccctctccctctggggctaatggtctcctttctggcttccaggggggcccggctcatcccagagatggaccagatcttcactgaggtggagatgacaacgttagagaaagtcatcaatgagacctgggtaatcacttcgtaaatacttaaccagatacttagctgccatcctaggtactgtgggagaggtggagagatgaagccacagcagcccctgcctcctggcttagcatctaacctgaagacaaaagatgtttgtatttgagcccacctctgattagtcccaagcaagggccatggccataagagtcatcagcctggaggagcaaaaaagcccatcccatgaggaca

SEQ ID NO: 67624 - DNA, 2503 bp, Homo sapiens
tttgtgtgattattcaacttttccatagcagggaccctgtctctctccccaccgccacatttgtattcccagagggaagtacataagtaatgctcagtaaacactgtcgaatgaatgagtggaagaagggtcactgcgaggtgtcagctgtgctgtagagagttgagggcagagtgtgtgtccacacatggggcactggagatgaacaaggtcccctgagatgaaggaaaggtgccatgtggggatgagaggctcctgtgcagatgcggggactccatgtgttcttcacttttttccctgctcccttttctcaacagatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacaggtgcccacaagtggctggttgaggctatattttgtcccacgtagagggtgggggaccctgccactgaactgggctgctcgtgcctggcatggcccatgctcctcccgctaccatcctcccaaagacctattctttttgtttctgtcctactcaccaagagagcgggagctgggcaagaaccccctgacagtccccatcctctcccagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggtgagcgagtaggggaaggcgggaatgccccgtaggaaagggcataggaaacccatgggacgtcaagggacgagtcagtgctaactgcatgctgttgcacctgtcattcttacccactgcaggatgagattgagcaggtgatcctggtgggtggggccactcgggtccccagagttcaggaggtgctgctgaaggccgtgggcaagtgagtgtgggggctagagcgcttggctgagttctgcctggggcagggctttgggctgagcagctggagggctgaggggagggaagtcccggttgcatgctccagggtagaccgtgctgaggcttggggctttcccagggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtgagtgagcctgactgagcaggtgacaagctccctttacctctcccaagtagggtttccccttctgtctgctctggctcatccctttgtctttctgctaagaggtctcccccatcccacccccatccttaccccagaacctactcgggttctctagtgtgcaacagtgtgcctctgtctgcctgctgtgtaggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcggtgaggggcaggggtgtaggatgggagctccagggagggggaggcgtggctgctggataatctgaggactgggggtgagggaggatgtgggcctgcggggctgaaacagggcagctatgatcagcttcgctggagaatgcatccgtcctcttgagtgtgcccttggggagtgcccctgacaccttgtgccaggaggccatgtagtctagagggcgagatgggctggggtgggtccccctgaactcctctttccttcccaaccagggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtgagagctaaaggataccctgtgtgcagagcaggggctcaggccctgccagccatttccaaagtgggttccacatggcattaggataagataaccaaaaaaggtttaggaatcagaaaaatgttggctctgaacagagctaactgatgatctggtgcagacctccttatagcctataaatgcttataggcattgtaaatttcttggaactattgaatggtttgatataggcattgtaaatttcttggaacaattgaatggtttgaagaatccactctttttttttttttttttttttttttttttttttttttggagagggtcttggctctgttacttaagctggaatataatggcatggtcatagcgcattccagccttgaacacttgg

SEQ ID NO: 67625 - DNA, 1055 bp, Homo sapiens
taaggtatggagccggcgggacccttttctgttgtcatctgtagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccaggtgagccaggggagccttgaccagacatgcagggtgactgaatctaaggatggaggccacttggtcccttttgcatctggtttgcatggctgggctgacccttggcaaaatgcaccaatagcctcctcccagcccctgttggagctgtttagttttgtgttaagagtcagacagcccattggaagcaggtgggtgggcaggcaggccccctggagtttgagaaggttcctgtgacagttgccttgatatctctacagaatatcatgttctatgacatgggctcaggcagcaccgtatgcaccattgtgacctaccagatggtgaagactaaggaagctgggatgcagccacagctgcagatccggggagtagggtaagtggatacttggcagggagggctgcttgtgaagaccctcaagtcaggggtttcttcttggaggagacacactgctttgctttcctgcatgctgcaggaatggtctcctgattgaggcatcagtcattgtaggggaccactcacaaagagtaaggggaagctgaggctcaggggaggacagtttgggaaaactggaagacatggaactttcaaaatgtattctaaggaaatccatggagccgcaggcaatatgtagggtgtcagattcaatcatgtttttgttctcttgtcatttccagttaaataatttaccattcttgttgtcttacctctttttaaatttttttttatggcctgtgacatagccctcaggagatcctgagaacatgtgccctgttgtcttatttcttgaaatcatctttttccgtcttcaccattaccacccagcccaag

SEQ ID NO: 67626 - DNA, 2553 bp, Homo sapiens
gcctgttattccattcctcggccgggctctacaggtgaccggaagaagagccccgagtgcgggactgcagtgcgcccgacctgctctaggcgcaggtcactcccgaaccccggcagcaaagcatccagcgccggaaaaggtcccgcggtcgccccggggccggcgctggggaggaaggagtggagcgcgctggccccgtgacgtggtccaatcccaggccgacgccggctgcttctgcccaaccggtggctggtcccctccgccgccccattacaaggctggcaaagggagggggcggggcctgggacgtggtccaatgagtacgcgcgccggggcggcgggggcggggccgggcgcgcagcgcagggccgggcggccgaggctccaatgagcgcgcgccgcgtccggggccggctggtgcgcgagacgccgccgagaggttggtggctaatgtaacagtttgcaaaccgagaggagttgtgaagggcgcgggtggggggcgctgccggcctcgtgggtacgttcgtgccgcgtctgtcccagagctggggccgcaggagcggaggcaagaggtagcgggggtggatggaggtgcgggccggccacccctcctaggggagacagcgtgcgagctccgggggcgggtcgggagcgcaagggagggccgcgcggacgccgggcgctcggcctcgcaccggggggcacgcagctcggcccccggtctgtccccacttgctggggcgggccgggatccgtttccgggagtgggagccgccgccttcgtcaggtggggtttaggtgaacaccgggtaacggctacccgccgggcggggaaccttaccgcccctggcactgcgtctgtgggcacagcggggccggggagtgagctgggaaaggggagggggcgggacaacccgcagggatgccgaggaggagataggcctttccttcatcctagctacccccaacgtcattacctttctcttcccgtccaggcccagctggctttccccgtcagcgggggagctccaggtgtggggaggtggttgagccctgggcggggatccctggccgcaccccaggtgtctgacaacaggcacagtgctgcggtgcgccactcactgcctgtgtggtggacaaaaggctcgggtctcctttctcttgtcctgttagcttctctgtttagggatgtggcaaagccgaggacccatgctctttcacttgggcctttgtgtgggcgctgctgggatgattagagaatggtttgtacccatcaggagggagaagggagaagtaggctgatctgccctgggtaagaatgaagtagatatgaatcttacagcctctccgttctgggatgtgattctgtctccttcactccgggtatccagttttaagtgttttctttcttcgcctcccccaggggcactatggcagacaaagttaggaggcagaggccgaggaggcgagtctgttgggccttggtggctgtgctcttggcagacctgttggcactgagtggtatgtaccccagtagagggagcaaatggataaatgatgactgaaggatgcatgatgggaattgagcttggggctgttggccagaagtctcttgagttgttaggtccaggcctttttgtcttttgccatcttcgtttacccatggaaagtggtatgctttgattagagggagtcccaggaaggtgggcgaagggagagctaactgacaaacctcttttcccttcagatacactggcagtgatgtctgtggacctgggcagtgagtccatgaaggtggccattgtcaaacctggagtgcccatggaaattgtcttgaataagtgagggtggcccccgtgttaagggtggggaacgagggagtctgggctccaagtgtgaatgtgttagtcatagtgcccacagcagacttcggcatctgagtggttaaatgtgtgtgagtgtcgaggcttctgagtccttctgctgcaggcacctgggcccaaaatctcttttcctcagggaatctcggaggaaaacaccggtgatcgtgaccctgaaagaaaatgaaagattctttggagacagtgcagcaagcatggtgagctagcagtccctcttcccagagtggtgggcagaggagaggagatggcagcccccagagtctgtttccttatcagtctctgtgatgtaagaggtaggtaatggtggacttgggagcctaatactagtctgctccttcttcacccctcaggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgtgagtgctctgttggggaaggtggtctcggcaacgctgctgggctcctcattggtgtgtgttcctgattgtcctgccttaatgcctggctttccttggctccaactaccttccttcccctcaggcagctgcagttctcacctgagg

SEQ ID NO: 67627 - DNA, 1018 bp, Homo sapiens
tgttttggttttatttttttaaggggtaagtggggtcttctgcatgatgaaagtactccctgttagatgctggtttgttttgctttcattcagttccaggcacagtgttttacatataccatgtattggattattattttctaaatgaatggatatgttagtgtacttaattttctaatctgttacttgggttaattgtaggatcctaaagggtaagatcaggtttatgtgttctctatgtacaactaccggcacagcgctgcatgttatgggatgagagggaccagagaggtgatttgtgctgggtgaaatgtgcaccaaagttatcatgggaaaggaaataggggagataagacagagatgtccaaacatctggtgctttttctttcctatgcaggtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggaggcaaggccaccaggctcgcagagctggccacaggcacctagaagcagctgcaggagcaggttccccaagtcatattggccagggtgtttccctccttgtgggtcacagccttactcagcttccttagggtaggattataaggtaaatggcctgggatggggctttagagggaagtagtggctgggagcctgagcccactctaagggttcactttgtttccagagaaccttatgaaataagatgatactgatcttggggatatctggtagctcttggtttgtctaggatctaggcagatcagaaatccaggactttctgttttgtgtgttgtgcgcacattttgggaaagtgtcttcccaggaccacttctaccaattttctaatctctcttcccttctagatgctgtttaagaagaacc

SEQ ID NO: 67628 - DNA, 1034 bp, Homo sapiens
gcaaggggagtgggagaagtgtgttaacaagtttagagaaggtggcccaggaaaggcctcagtgaaagggtcacatctgagtacagacctgaaagttaatttagtggcagttgtgaaaatggagacagaggaaacaatccccaggctgagttggccttgttgggagcatgctgagactcactgcaggtccagggctgttgtattcatttgactcccttaaggcgataagaagagcagggcagggccttcaggggccttaccagggaccttgccctgtgcacttcagctgccttctttctcatccttgactcctggccttgccctcacttttgccactcacttctggtctttcttccctgtagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcaggtggggatgagtgggctagatgggccaggggattcccactagtgtcacagagtcactggagggcttgtttccttatcacctcctcatttaagaaacaagcactttgattctgattcgtattccttccctcctcttctcctgcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaag

SEQ ID NO: 67629 - DNA, 1070 bp, Homo sapiens
ttttctccatgaaagcctagagtctggcctctgattcacaatcttcccagcctacggtgttagaggtggggtggtcaagaagtgaagacagatggtccttgacttacaatagggttacatcctgataaacccattgttaagttgaaaacaagctgaaaatgcatttaatacacctagcctaccttacatgtgctcagaacacttaagattagcctattatagttggacaaaatcatctgacaccaagcctgttttacaataaagtgaatatctcatgtaatgaatactgtactgaaagtaaaaaacagaatggctgtatgggtactaagtacagtttctactgaacgtatatcgctttcacacaatcataaagtctaaaaatcctaaattggggatgactgtaaggcagaaaggagatgcagatgagctggggagaggataggggcaggccctacctgccccacccggttgtgccagcccatgcgctgcaggccagctgttgccaggatgatggcactgaactcctgctgctcgtccagcttccgaagccgggtgttgaggtttccccgctgtggagagttgctaaggaccacagtgtcgggcaatctggggcctcgtgcggttccctctgcctgagtctgtctttccctctctagctggctgactttcagtcatcttccagctctcagcttaatgttaacagctaacagttacatcatacttactacatgccagacactgctctaaaagtactttccatatgtcagctcatttcatcttcacaacaaccctgtgaggaaggtagtattattatccccactttacagataaggaaaatgacatagggaggctaaataacttgccaaggttacaagacctctgagaaaccttccctgacaccccagacttctgtgtttagatgttccaactagaagtttccagaaaattcccaacttcacttattggagcacttagcacatactatttttaaatttagttttatgaaatgtactacatattcattgtaaaagtcaagacaatatagtagcatataaaaatggaagtactga

SEQ ID NO: 67630 - DNA, 2715 bp, Homo sapiens
gaaaacttttaaggggtctaatttcttcacttttccattctccctttgtcaggtaggagaagggagtagggagtgactggacctggaaaggagggctgcagtagctataatattgacccctttcctttaaaaatcctacgccggcacagatttcccagacgctctctaggtggcctcagactccacccctttggtcttccgcttctggtttccgattgtagtgtttaaatctcgcgcgctttacaaggattggctacatcagcggatagttggcagtctgcgtgctacccctcctcctcgccttttctccccgggcaaaaggttttcaaattcgaccaatcagcgggcgcgctccctcagccgagccgcgacacccaagggttaaccgcaaccaaccggaggcgggtattggagaaaagagccaatcaggagggcgcagaggtgtgtcctgggggcttataaaggcggcctcgcggcgcgcgcgcgacagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgctgagatcctggagctggcgggcaatgcggcccgcgacaacaagaagacgcgaatcatcccccgccacctgcagctggccatccgcaacgacgaggagctcaacaagctgctgggcggcgtgacgatcgcccagggaggcgtcctgcccaacatccaggccgtgctgctgcccaagaagaccagcgccaccgtggggccgaaggcgccctcgggcggcaagaaggccacccaggcctcccaggagtactaagagggcccgcgccgcggccggccgccaggcctccccatgccaccacaaaggcccttttaagggccaccaccgccctcatggaaagagctgagccgcttcagactgcggggcaagcgggccgcggctcccttcccctcccctcccctcgcccgccttcgccgcccggcctcgagtccccgcccgcccccgctcccgtcccgcaccgcctgccgcgtcggcctcgggccctgccctgtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattttgcaagagagttgtagaattagtgactttctatactttcctgataataggggtgggaggggccatgcaatataaacaggctctactgttaactgaaggggcaaaccataggaatttaagattgtggctctgtttcttggtgttcctgggagacaatttattctgtgtgaaatgaaaactattgaggcagaagcagaaaggacgtaccaggagaactctgggcaaaagtcccagcctctgaggtaaggatgaaagggctttgtgtttgttcctatcttcccgccaactccacacgcgcacacacaacaccttcagaactggtttattagtaggattggttacattcaaaggctgttgcttggacttctctaaagagatgaagcccccacatactgaggaggcaaggcagtcatcaaggccccaaggtgaggcaaatccctggaaggcttgaaccctgcagttcagtctcccggggtaatcactccccagatagcagtgagaatggggcactgaggcccgggatgtaggcactggacagcagcaacccaggcatctgtgccccacaaaccagttaatgggcatcgttaagctgccgtgcaacatccaggatgttttt

SEQ ID NO: 67631 - DNA, 1059 bp, Homo sapiens
gtggccacagtcaccctcatcccggccttccggggccacttcattgctgcgcgcctctgtggtcaggacctcaacaaaaccagccgacagcagatgtgagcagcggcacacgggtccgggcagggggcaagggctaaggaaggagtggctagggcaggggcgggaaccggggtgcttgaccacacgtgaagactcagaactaacccaggcagcctggaactcggagaggtgatgagcagaacttactcgcattggggaaaggatgggtagggacccttgggtatatctgggactctggcagtggtgctttcctccctccgcccccctcaccacttaccagaataaaaaaccgggaatgagaagaccactttgggttactgtaacacctgcactagtgagtgaccacgccccctttcctcttccccctcgcccccttgctgctgggccacagcccagaatcccagggagtgatcagcggtgctgttttccttatcatcctcttctgcttcatccctttccccttcctgaactgctttgtgaaggagcagtgtaaggcattcccccaccatgaagtaagtgggttcgtgggggtgattgcctgtggctgggacctgggaggtacctgagagaactggggttatttgggcttgtggggaggggctaagaaattatcagaaaagacaggaattcttaaaaggtggaatgggagcaggcttgagtcatggacctgcccgagcctcccccagtttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggtaggtagtcctaccactgctgcccctatggcacctacttcagggaacccttcctggtgctccacattctcctccaagtgttccttttttgtctctgtg

SEQ ID NO: 67632 - DNA, 1034 bp, Homo sapiens
cccagctgactataattgtccatcctgctaccctcagccctccagcaccccctggggtcctccaacaaacccagaggcctctgtggcatttctaccccactcagtgggcccccatggcacttctgccattataggggccccactgaattgccccaacttcagggagccccagtaccccctctgtccccgctccatattttcatagcatctccccacaccttcagcaggccccatggcactttcctacactcccattagctcctggggtgtcttttagtccccacggcatcttcctaatcacccttgtgattaatcaccctttaatcattcttgccctctgagtcacccaaagtctgcatctcaacaaagacagtaggggtgggggccactctgaagcaactcccagctcactgaccctcccccacccaccagactccccctcccgctccccgtccaaggtggaggtgaccgagaagacgacaactgtgctgagtgagagcagtggccccagcaatacctcccatagcagcagccgtgagtggggaatggggtgcatgagtgtgggttggccctggtgccccagcatcaaaaagtactctgggtgggataggaggagttccaatccaagaaagagccagggagaagtcaggttattcattctctgcacccctagcaggggacagccacctttccaacggcttggaccctgtagcagagacagcgattcgccagctgacagagcccagtgggcgggtggccaagaagacacccaccaagcgcagcactctcatcatctctggtgtttccaaggtaacagggctctggggagaggagctgggatggggagaaagccctaatgggtcggtcactcctgcccattaaaacccgtccctcctgccaggtgcccattgctcaggacgagttggcgctatccctgggctatgcggcatccctggaagcctcagtgcaggatgatgcagggaccagcggaggcccctcttcacctccctcagacccaccagccatgtctccag

SEQ ID NO: 67633 - DNA, 1131 bp, Homo sapiens
ttccatgatactgtgtccattcatagctccctaagctctccttttctccttgggtggttcccttctgcctgggatggttcccctctcctttctgtgcctctccactatcacctacagccctcctttcttctgcctgccccaccccagagcagcacttccagtgttctcactgttccaagagatttgccacagagcggctattgcgggaccacatgcgcaaccatggtgagtggcctgcggcccacagcctccctcctgccctccaaggttccacaagttctcacatcacagcctcctctctgcttctctcagtgaatcactataagtgccctctgtgtgacatgacctgcccgctgccttcctccctccgcaaccacatgcgctttcgtcacagtgaggaccggccctttaaatgtgactgttgtgactacaggtaagggggaccagggaccagaaaacagctcatgttccagtgttccccatgtcctccaatccctcctgatttctcatggcagctgcaagaatcttattgacctccagaagcacctggatacccacagcgaggagccagcctacaggtgtgattttgagaactgcaccttcagtgcccgatccctctgctctatcaagtcccattaccgcaaagtacatgaagtgagtggggctggtgttgggaaggactagtggaagtatgggggaccctggggtgaagagctggtctcatttctcccttccttccccatcagggagactctgagccaaggtacaaatgtcatgtgtgtgacaaatgcttcacacggggcaacaacctcaccgtgcaccttcgcaagaagcaccagttcaagtggccctcagggcatccccgttttcggtatgtctctcaaccctccttcccagattaacacacttgtttttataccttttcaaccagttttaaaaaccttaatttgggtcgggcgcggtggctcacgcctgtaatcccagcactttgggaggccaaggtgggcggatcatgaggtcaggagttcgagaccagcctggccaacatggtgaaaccccgtctctactaaaaatacaaaaagtagctgagcatggtggcacatgcctgtagtcccagctacttgggaggct

SEQ ID NO: 67634 - DNA, 1002 bp, Homo sapiens
attaatatttatcatgtgcttgctgtgtgcctgatatattcaaaactcaacctatccttcttcccttactccctacctcactatacacgttagttgagcactttctctgtgtcaggtattctgtattcattgtggagctaaataacctggcctttgcctttatgtaaggacagtatttttctctttagagttgtggacaccgaggctcagagagttagattaacatacgtttaccagcctctcttccttagaaacacacaatggttcaacccaaaaaaaagataagataagtctgcctttacccaaggttttcaaaatgttaatgagcagttctgttttgtttgaatgtaaaggaatggtgactgtttcatttcatattacagaagtgattctttggaggccatacttcaaacatcatataaagtagtaaactacataaatttaagagaagttacacatgtcttaataacctaataaccatgccttttggacacaaaaatattcagtagtgtgatttacagcaggattatatgttcacataacgagagtttcactcctgaaatttctaatggaacataggctagatgatgcagagagaggaattacaaagaaaccctcctgcacccacccccaagaatcagtgataacttttgtaaaactacggtattatagagaagtaggctgtgaatgtcaagtagaaagtgcagaagctttttccaatcactttactctaatattgccaaccaagacttgctctaaaaccataatacttgtgaagtctacaactgcatttaaattaggacatcttaaagaacaagccccaaaactggctacaagaacgtctttcctgccaggctttagtatacaaagccaacaaatgcctgctagagatacctagtagtgtgaaaatgttagcagcattgtaaacttcaatcctggcagcttagttttttttactcttatttgttgtgatttgaatttaataatacattttcttcagaa

SEQ ID NO: 67635 - DNA, 1509 bp, Homo sapiens
tttattaacactttctcctttacataatttttcatcaatgactttttttttttttttttgagatgaggtcttgctatattgagcaggctggatcgaactcctgggctcaagtgatcctcccatctcagcctcctgaatagctgggactacaggcatatgccacggtgcatggctctaattttcttttaatcaaataccatgtcctgttttctgtgaaccaggcattattctaagtactttgtaacaatcttatgagaatacttaaaaaaatttttttttcaaatgacaaataattgtctatattcatggggtacaatgtgatgttttgataacgtttatactttgaaatgattaaactatgagaacacttgaaatgagaaatctgagtttttaaaagcaacttgtttccagctccatgatatgtgcatgtaaccttattctacactgccttcatctcactgctaaacactttgtatctactgacacgtaagtgtgccaactggtaaaatgactaagaaactatgctaccaacaatatgttaatcatttaggatctgcaaggaagataatttataaaacctcaacctagtgattttatttttttttaatcttttttttttttttttcttgagatggagtttcacttttactgcccaggctagagtgtaatggcatgacctcggctgactgcaacctccgcctcttgtgttgaagcaattctcctgccctcagccctcccaagtagctgagattacaggcgcctaccaccacgcccagctaagtttttttgtttgtttgtttgtttgtttgtatttttggtagagatggggtttcaccatgttggccaggctggtctcgaactcctgacctcaggtgatccacccgcctcggcctcccaaagtgctgggattataggcgtgagccaccgcacctggcctcaatctagtgattttaagagtatctaatatttagtcatacataggcctaaaaagccctgcacaatggttgatgtcaatagcacttagattgctatttaacagaaagcacaatggaagattttctttccctaagtggctttttaatcatactcaatgaagtaaaagaacaggaggaaaggaatcactattatctggttcaactttagaaagaaaatattcaactgattattttaaatgtaaataccctgaaaaaaataccataaatataaggaaacaagttaagaaacactaaatctaaatacttaacttggatttcaaccacctagatatattagacactagactggatgagtgttctgcatgtaaatggagtagggggagggtttatggaaagagagaaaagaaaaatgttaacaaaaggtttttttttttttccatttctgtaacaaatttaacacacaggatttaagctttctgaagaaaatgtattattaaattcaaatcacaacaaataagagtaaaaaaaactaagctgccaggattgaagtttacaatgctgctaacattttcac

SEQ ID NO: 67636 - DNA, 1098 bp, Homo sapiens
actgcatcaacaatatatgcttctctccatctctagcagttaacactaagagtttactagggattagatgctttactaagctaaataaagtgcatttaattctcataatgctttgaaataggaattactaaccgtatcttacaaatgagaaacaaagacttagtgacattaaataatttgcaaggtcacaaagctagtaaggggcagcataggtctatgaaattcaagagccagggctctttggttatgacacatttcctttccaatgactacggttactaaatcctgcccattcttcaaagttctcaaacactgcctccttggggaggactctccagtctatatttaacgtctactctcagcttctgaaccccctacagcaacttgctcatagtttttcacaggttccatcacgttctgcttcatattaattgtcttattccccaatctggaagacaactccttaagggcagaggcagggaaagtatctcttacacactttatcccctgcaaccctggtcacactgggcacataacaggcattcaatacatttgtagaactgaactggaaaatattacctacttttgacaaatttttaatttcagaataattctacatctacagaaaagttataaagaccacgcagggagttcccataaaacccaaatccagtttcagtttcccctaatgttaccatcttatattactgtgggacattcttcaaaactaagaaaccaacatcagtatggtagtactaactgaatcccaggctatatccaggcttcaccagttttttccactaatgtttttatctattccaggatccaatcaaggataccactttacatttactcaccctatctccttagtctcctctggtctgtaatcatttcttagtctttccttgtttttcatgacagttctgagcgctgttcaagtattttaaaggatgtctctcagtgtgtctgtctgtctttctgatattttgactggagttacgagtttatggaaagaataacagaggtgaagtgcccttctcaacacatcaagtcataatatctacatggtatcactgaaaatgttcaactcgatcactt

SEQ ID NO: 67637 - DNA, 1329 bp, Homo sapiens
tcttcaaagtaccttatgagcaagagttacaagataactttttcagtattctatatagtagtgactgtactggtcaaaatagtttcagagatttttctgtttacctcatcattcatataaaggccacttttcacctcctgtcttgcttaagatggtgattgtgattcctatgaagttgtatttatatttttacttttgaagctaaaacaatagctatagttgctcatttaatttttaagatacttgtgtattggtgatatgtaaatcttagttctttattatgtgaagttgtacacaggaaaatgcataacattgctttgggcctgaggcacaaaggtacgttggctttgaaggtaggccctgaggtagagagaaaagaaatgacaccagtcttgaattaaaaaaaaaagatactgcatacagaatcagcatttgattatgagtaagctgtgagaggaaaagagaagaggaagacggaagctgtagagtagaatttgtagttccgtagatttggatggttagagctgaaggcgaaggttagagtggaaggcgaatgacctccttcctcagcactgtgttactgggttagagaaaagccagtactgctcgctgctgctggaactgaaggaaggaaagttctgtcttcagggtatttacaaaaagttgaacagttgtgttcctttgtggatctttggagaatcgttagaactcactgtgtgagttaaggtaactgctgacagaattttttcaagtattgcttaccatgtaaactcaaatgtctgtatcatacctcattctttttacatgttaagacagattctgctgattaaattctgccccatatactgtagacactgaaccataagcttcagattggttacaaaatgctctgacccatggacttttgtaaattcattatttccttttaagaagtatgatgcttacagtggatatctctggtggttttaagaaatgtaagcaggctttttggagggatgcattctggagtaggaaaatgtcttaaattgatttcccgtaacagtttcagtcagcactttgaactgctcttaggtacctggtgccattacatctttgtggtcaataactttttgtttgtgtggcttacttcacaaaataaaaatgctttctgtgtcctgttattttggtatgcatattttatctttgatccaacatagtgctaggtacctggtagattttcggtagaaaattattttaagagccaaagataaccagcatggtccagttattccaagacccactccctgtattcacttcagactcagcttaaaaagcaacactcgataaggt

SEQ ID NO: 67638 - DNA, 1093 bp, Homo sapiens
tccgtgatagagtgattatagcagtgcataagttcttacacttatttgttgaattctcttacctgtcatcctaaaaaagtaaatttgtccatgttcatgcttagctattaagctttattaattcaagattaaaagctttaagatatatgactaaattttttctcttgtttacttcataatatctatttgaatggaggagatacaagtggaggcagtgaatgcaacagtatttcttcattgtgtttgtatctttcatatgatcttacagcaaaaagtttctaaaacccttctttaaataaagaacaagatcactgaatatgtaacatcctcaacagcgcatttcttttctcttctctacttttttatatccttgaataatactggccagaaagaatatttgaagaggttctttctaaatgtattttaatattcatgttaattatacatcttgtatggtgaatttggtgcatttaaaataaaaataattttatgtgtttaattattgcattctgatcatttgtaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagtaagtctcagaataatgaatttgaactatgaaaaactaaagcttacgagttttttctttacttttttactaatgaaatatttaaaatttgggaactctgagaaaagtaatatatgtgtatgtatttcctggctttggttaaatattaagtttttgctctgttcattgtttttaaaaaatagttttgcagattaaattgaaacccatgctctttgaatactcttccctttctctccccatccattgtggtttctttttgagacggagtcttgctctgttgcccaggctggagtgcagtggtgcgatctccacttactgcaagctctgcctcctgggttcatgccattctcctgcctcagcctcctgagtcgctgggactataggtgcctgccaccacgcccggctaattttttgcatttttaa

SEQ ID NO: 67639 - DNA, 2702 bp, Homo sapiens
cctgtaatcccagcactttgggaggccaaggtgggcagatacttgagatcagaagtttaagactggcctggccaacatggcgaaaccccatctctactaaaaatacaaaaattagccaggtgtggtggcacatactgtagtcccagctactcaggaggctgaggcaggagaatcatttgaacccaggaggtggaggctgcagtgagctgagattgtgccactgcactctagcctgggtgacagagccagactccatcttaaaaaaagaaagaaagaaaggaagaaagttattgttattcttgatggttcttttgatttttgtctgtatcttgccttgccttccaccgtaataccagcataatctactaaagcttctgtttatgtctgttcatagttatatcttccggctgagctgtactcgtctgggtcagtgggctattgggtatgttactgctgatgggaacattctccagacaatccctcacaataaacctctcttccaagcactgattgatggcttcagggaaggcttgtgagtacctactgcataccatctgttagagtctgggaacttaggggctgtccaacctcatcattaatgactttattccaggtttcttaaactgcagactaagattcaggaaaatattaacagatgatattgatttgaccttcaggtcctggaagacttttgtttttcttttttagggattccatgagtgaaattattctctaccacttcagttattaccataaataaactttatctttcttttttccaaatgttaacttattttcaagcctgtgttaggttttaaaatataccaattagcaggaaatttgaccagttatttaactagtcggcattcaagtgattcaatgttcctaatagccataggcctcagtggccttcatctgctttcatcctcacttcgcttttgttcagcagcatttcttcaggccttgggctactgtaacctatgctgctatttataactaagtccttatttattccagaattgctattcctttgagaattcaaattaattatcagttggtaaacacttaaaaatactaacagttgaccagatggcagaaaactagcttgtgttttgaagtgattaggaaaatacattttatattatacattatcttttacttacaatagcattgggactgaaaggagtgctgccccaaatgtcagaacagtttgatgctagaaactgtggatctccctggtagatgatctcagtagcttaatttgcatattgttacattgcttttaaattggtgtctctcattttcttaaacctgtaaaccttctttgatcaaaagcaaatgcagtttaaactaagaagttaagccgggtgcagtggttcacacctgtgatcccagcactttgggaggccgagacgggtggatcacctgaggtcaggagttcaagaccagcctggccaacatggcaaaaccctgtctgtactaaaagtacaaaaagttagccggacgtggtggtgggtgcctgtaatcccagctacttgggaggctgaggcaggagaatcacttgaatccaggaggcggaggtttcagtgagccaagatcactcactgcaacctcaaaaaaaaaataagaatctgtcgcgcacacacacacacacacacacacacacacataaagaatttctatctggtggccatccattgattaaaaatgggttggtaaactgtgacccatgggccacctgtttgttcccccggggagccaagatagcttttcctaagagtcgttttgaaaaaaacaatcagagaagaatatgtgacacagactaatgtggcctacaaatcctaaatgattttctatctggccctttacagaaaagcttgctaaccaaccccttgattaaaagatagagcctatggcattgttacctggagaaggaataatagtttttggagaatatctttaaactgttctgtgttttttatttttttgaagtattattttttggaagtattttttttttgaagtaagattgatctttatacttacaccacgttgcccttttagaatggagaaactcccagattccatttgtctatattagcaagcactggcaaattggcttaaataaaacccagggttggttactctttacagctatttgtttcctgatggacgaaatcagaatcctgatctgactggcttatgtgaaccaactccccaagaccatatcaaagtgacccaggtgagttttgtttcacatgataaccatatcactggacacaagctttagtatattctttatagaactgacagcataattgaattcattggaacccattgactagattagtgaatttgtgtgtatgtggtttcactttaaaccctggagcttaaaataggacccagactagatgctttctggtttaataaaaaataaaccactgttgtgacatttttatataagcaaaatttgtataggaaacaagtcttcactttttctgttaacatttataattgcagttatttattcaactaatagtcttttaattttttttaatcaaaggaacaatatgaattatactgtgagatgggctccacattccaactatgtaaaatatgtgctgaaaatgataaggatgtaaagattgagccctgtggacacctcatgtgcacatcctgtcttacatcctggcaggtacgga

SEQ ID NO: 67640 - DNA, 1767 bp, Homo sapiens
ttaaatgaggatttccccagatttgcaaatattttctttcctatttcttctagatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttca

SEQ ID NO: 67641 - DNA, 1056 bp, Homo sapiens
caatgcagggaaggtgccatcagcaagaggctgggccaccgtggacattatccccactccttaaagggcaaaggaaaaaaccactgctgaaaatataacctaatattcctcatgttcaaatgaagacacccatataagctgaaattaattcactgggaagaaaaactgaacagataaatccttactgtctattttgtgcatttaaatagcatgtgaacgaagcttcctaaaagctttccggtattctggccagaaagtcatcctggaaacaaatgttcttcccttcccattaagtagaaagactcatgacctacatcagaacacatacctggcaccaaggcaactgactcccacagactattttctggggagggcatggaatgtatttaaaggcctctatctcaaatcggtcattatgtaattaggataatcaaaacatcttaatagcttcaatgttcctatagaaacagtgctttggagtgaccagtgttagctgctagtatcaaacatgcctataatagtgtagcaacagtacttttcctcccacttatctaccaaacaaaccaataccatcacacacaataaagaacatcccataagctgcttggcctcagtaaggctggccatagcaagcccatggcccatgacagaacaccaagaaggatgaggaaggagttgatggggaaagaacagacagaaggtgttctaaaaatagaagactttagctatgcacatggtaatataagccaaaggggagtgttgaagttgtaatacacactaggcttgggtataataccacagtagatggaagtctttaaaaaaagattccttcctaaaccttttgtgctaattccctgcctggaattaacacacacagcaggttaatcttataatcacaaggacacatacaaccacaggcagacacacacacacacggccacatccttaacccaggaagtcttaagtcctcaattaggatttccagcaaaatacttgttctatagctttctggactgttccccaggtaggttatcatgtaatataatccacactctc

SEQ ID NO: 67642 - DNA, 2045 bp, Homo sapiens
gctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcat

SEQ ID NO: 67643 - DNA, 4481 bp, Homo sapiens
tattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagacttgagttcttgctcattcagggggttgggaggcaatactcgagttgccgtaggaccaaatgccaaggcccccttcctcatggcggtgagcctgagctgctgtctggagggcagttccaagtggcaggaaagcataggaaggggacatagctcctgctaacagcctgccaggcccttcgtgctgcgtcatcagggcagttttgctgctgaaaagtagggtgactgtctgctctggtagaacttgagccatttgctcagaagcagaggtaacccctgatctctgctgccaactggaaacggttttgtgtgccttttggttgtagtttcacaggcccccaggttcctgtggtacccatgatgaataaaaagcaatgtatgatttctgggacaattaagctttatttttcatatatatatatattttcatatatatatatacatacatatataaaggaaacaatttgcaaatttacacacctgacaaaaccatatatacacacatatgtatgcatacacacagacagacacacacacccgaagctctagccaggcccgttttccatccctaagtaccattctctcatttgggcccttctagggttggggccctgagcttggtttgtagaagtttggtgctaatataaccatagctttaatccccatgaaggacagtgtagacctcatctttgtctgctccccgctgcctttcagttttacgtgatccatcaagagggctatgggagccaagtgaacacgggggattgaggctaattcacctgaactcgaaaacagcgcccagcttcctcaccgcaggcacgtatcttttctttttttttcctcgagacggagtctcgctgtgttgcccaggctggagtgcagtggcacggtctcggctcactgcaagctccacctcctggattcataccattctcctgcttcagccttccgagtagctgggactataggtgccaaccactacgcctagctaatttttttttgtatttttagtagagacagggtttcaccgtgttagccaggatggtctcgtcctgactttgtgatccgcccgcctcggcctcccaaagtgctgggattacaggcgtgagccaccacacctggccccggcacgtatcttttaaggaatgacaccagttcctggcttctgaccaaagaaaaaatgtcacaggagactttgaagaggcagacaggagggtggtggcagcaacactgcagctgcttctggatgctgctggggtgctctccgg

SEQ ID NO: 67644 - DNA, 1071 bp, Homo sapiens
cattgttagacaatttcttttatacaatgtttctgggtcagtctatttagatcaactgatcgttttgcttactgccaagttttccatactacgcatagcaggtagtcgagttcaccattccccatttagtggacatctagacggctgctcgtttttatcattgcagcattctttgcacacatccttggatatgagcagacatgaaaatgtttttctagggttgacactgagcagtaaaagtgctgggttgaagggtttccagcttgcatttgtacctggccttctacaggggacagggggctatttagatggtcccctgccaaccccagtggacaaccctagggtggggctggaggtggggctgaggctgagtcttcctccccttcctccctgcccaggggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctgtgagtactaacctgactctctgcttactggggctggggctgctggaaactcctgctggctcccccttatccagcccagggttgactcatgggccaagagctaccccctttgcctatgcagacccgacagaaaaagtgtggctggaagtggagcccgtgggaatgctgaaggaaggggaccgcgtggaaatcaggtgtttggctgatggcaaccctccaccacacttcagcatcagcaagcaggtgtgggggctttgtgctgggtgcaggtggggatgcaagcagagacccaggtggagtggcgggaggtgcactctgctcacctccccaatcctccctagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaact

SEQ ID NO: 67645 - DNA, 1634 bp, Homo sapiens
cctgccctccttgtccgagagccaaggtaacaacccaggcatcccagagcccaggcagatggtgtcgagtgacatcacctcctcacagggctggcagcacgctggcaccactgacgtcactcctgcccactgcctggcccttgccctgacccctgggggagactctgacctctccatccttaccagctacctagggtggggtccgcgggtgtgtgcggagtgttcatggaggtgctgctgagggagcatgagaccggaacttccgccagagttagcccgctggggagtgagggcagggattttggagggcagaggatagagcagtggtgtcttcccctggcggtggtgacacaaaagggcctgtgtgccccagcctggcacattctttgcattcccacactctgagctcacccggagaggagggggcctggaaggaaaggggccttcctcttggccccgagcctaggttgcccctttctgcccctctaccagcctcagctggagctgttcggtgctcagtctctgctcaatctctgcttggctccaaggacctgggatctcctggacggggagagggctggcccaggtggggcgcgggtcggggtgggggtagagcgttcagaggacagggccctctgcagaccctctgagtggcaggaaaaacagctgcagcagcgctgcgaggggaggggcggacagcagccggagctgacacagctgcgggggccccgcctccctcccccaggtgtgcccggagaggctgagcagcctgcgcctgagctggtggaggtggaagtgggcagcacagcccttctgaagtgcggcctctcccagtcccaaggcaacctcagccatgtcgactggttttctgtgagtgcttgggctcctgcaagagcagcccggggagggagactctgcccctcttgtagcccaggacccttctcctcctctgtgtctcctcccattaggtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacagtgcgtgaccctgtgtctgccagcagggtagtgagggtggtgggacgtggccagatgtccccctcatttctattttcttgtagaagctccggaggagccaaacatccaggtcaaccccctgggcatccctgtgaacagtaaggagcctgaggaggtgagatgtgtggcaggtgggctgggcagctggtgcgcagccgctgagatggggcttgaagggggctcggaggcagggagactcacaccctgtgctctttaggtcgctacctgtgtagggaggaacgggtaccccattcctcaagtcatctggtacaagaatggccggcctctgaaggaggagaagaaccgtgagtagccctttctcccaaaagccacccttgggccaggtgtggtagctcacacctgtaatctcggtgctttgggaggccaaggcaggaggatctctggaggtgaggagttca

SEQ ID NO: 67646 - DNA, 1124 bp, Homo sapiens
gaggggatttaatctgtcgcctctccttccctttggaaagtaaatacgttcgggcgccattcaaacggaccaatgagtgatcgacgtttttgtggttggccttcaccgattggctggagtttgtcgtccctccctcctcgtcacgcctctggctccacccctttgcacacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttccttccaaattaatcccagaccccctaaaatattgacaaccttgacaaccccccaaccgaggagccagactttgttttggactaacttccatagccctatcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaa

SEQ ID NO: 67647 - DNA, 1088 bp, Homo sapiens
gatgacggacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgct

SEQ ID NO: 67648 - DNA, 1007 bp, Homo sapiens
gtgctccagcccccgcgcttctccccggccaggcgccccctgccctgccgtcaccccagtcctggttcgctccctgccggctccgctttcctcctcccagactccaagaggaaaccagttgttcaggggccaagagctcccggaccgggaaatagctgggaaataactcgtggtgtcgcccggcggccggccaaagtttagggggagaaaggagggggagagagacttgagctgggcacagagaggcagaacttcgagagacggacacacagggcacctcctgttcccagggccagaggagaggcagggcagtggcagagaccaaggaccagaccccatttcagggagaaatacgcagagagatgagggtggagagttctagaggcagacagccagttggatccctagggcctaggacaggggcctgccacatgaatagatgctcagtacatttttgttgaatcaaggaaaaggtcagaaggcaggcgatggagaagctgaaaaagcagatggaaaggggaagaggcctggatgggaagtggtctcgattgtccggtggcacagtgtggggccagtcagcagcctgggaccggtaaagggacaggaaggagcagggagggtggtagggtcccatgagccccagctgaggacttctcttccccctccctgggagccccagagaaggatgggtagagaccctgctgatgctccttcctttgttcccctgcgtgccagccctgaccggcaaaagaggacgggcaggaagagggcaggggccggcttcagggtcagggctgggcacaagcttccaggtcagctgcctctggcagcctgttgcagttgaagggccagggggtgcccagtagtgccaggccagactggcactggtgctccgcttcctggcagacagagcggcaagggggcagaacactgcctagtggggtgcaacggggcacaagcagcccacacaggagcctccggaaatgctggtagcagggcaggcttgt

SEQ ID NO: 67649 - DNA, 1049 bp, Homo sapiens
ttccctagccccaaggcctggctttacatttggacataagacatcaggggaagagggactctcctctgagtgacactggcatactcaggaccagggtatcagacagcaatgcttatcatctggctttggagaaagtaggggagaaatttttatctagggcttgagacaatccaatacctctattccagccctgcctcagctggaatgagggaagaggctctgctggagactgaccaagggctggcatgggctcgctcgccaactaatgcccgcacacgcctctcttggggcactgacgacatctgccttttctgtagttattagtgtgcccattaggtggcaagctctcagaggaggaaaaagaaatcctatctctagatcccctgccacgtgcctcccacaatgggggctgacctgctgattgcagggatgaatggatggatggatgtgtgggtggtgggtgggtggatacacgggtagatggcgggtggacagatggacaggcaagcatatgggcagaagggctggatgctgtgtctcctccattaccttatgtacccctccctactcctaggacaaatacattttgaaaacaacagcatgccacagcaagaaatactgcttggagggctgatccagacaaatgcagcaggggttcaggaataggggcaggaccttgaagcttgcataactaaaggtcttgagagagcaactttgataatatgacttagggagtcttggctttgttgtgccatctgtgaagtggcacaggagatagaaacgctggtgcctcccagaacattcagaacttgacaaggcagggctggatccactgtagaaaggagtggagaagagagatgtgtcacaacagagctggcatggtggggaagtatcagctctcagggtgctgcgtgctgggcttggagtggagcaggactcacttggactcggctggtgctgttcaaccccagggcaattagaatatggctctcctcggaggggctcgggtcctagaagcctctgcggggctccctccccttgctcagaag

SEQ ID NO: 67650 - DNA, 1050 bp, Homo sapiens
ttcccccaggccaccaggagaatgcttggcccctctggggtggttccactctacctgtgggagggctcaggattccagggccacagagccgggctgggcagggtcacaagaggaaggaacggggttcttagcctctctggccttggtgcacttgtctgctcccaggacgtttctcgatggctctccccgaggactgggagtacccagcctggtgcctccaccctgtcttagcacaggctactgactcagcccaggtcctaatgatgcacttcagaggacgccctcattccagtcctcattctgactccagtctgacatgcatctacagcatcaaaggagggggcctgcctcgaccttagcccaatcagctctcctttcctctgctttacgggggtccatctgggggatgttctcatgcccattccaggggaggtgagcagcccctaccactacctccagctcagtcccattctaaaggcagccaggtcaggaggtaggatgttcactcttcagggaagggctagaatgggttggctagggcttcccttgactgttgagaagttgctctctccggagcaccgcgtgcctgcttctggtttgggactggtgagaatttcaaagctgcctctttctggtttgggattggtggaaaatctccccttccgcttaattgttgcccaacccccgcccctaaccccctttagcaaactgaccggggagctttaagagcagcgagtgagctgcacgcacacgtggggagggggtttgtcagtgtcgctcaggccacataccaccgatatacacggggcacagcgaggaggacccgccaaagcagcatttccttagaatacactgatcagcacacagttggctcttcctggcaccctgggctgtcagcaggcagccctcacacaactggcagacacagctggagcgtccctgcacagccggctctctccctatatttctagtgtccactctgcccagaatgtcgtggacaccttactttctgagctccaaaccggcactgatccccgaatcccccctccc

SEQ ID NO: 67651 - DNA, 1190 bp, Homo sapiens
tgagctgggagagccaggctcggggacagcaggcagttcccttggctggactagagaggagaatagccccataacgctctcaccctctcccaactgctgcctggtcaactggggaaccattgccttcggtgtgaatggggtgaagagctcagggccagacaggcagagcagtgtggttccaccagaactgtgggcaaggcctttggcctccctaatcttccttctcccagcgggaaaacagggatgacaccacctccctcagccagttttcttgtcatgatgtttagtaaggttttcataagatgatatgtgtgcaagagatcagtaatctgcaaatgggaaagatggctggttctgtgagaccgggctgttcctggtcccagctaagacattgcagtacccacctcccaaagggagtacacccttgctttgggcctgtgcctgcctgagtcctgatccgtcttccttcctaccctgcccccggcccccttctctttctgcagacaaactggtcaagtgtgagggcatcagcctgctggctcagaacacctcgtggctgctgctgctcctgctctccctctccctcctccaggccacggatttcatgtccctgtgactggtggggcccatggaggagacaggaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcat

SEQ ID NO: 67652 - DNA, 1024 bp, Homo sapiens
ttgaaagacaaaaagagttccggagatgggctgcatagcaacgtgaatgtatccagcactgctgaatatactgaatttaagtactgaatttaaatggttaaaatagtaattattatgctttttgtattttaccacgattaaattttttttttaaatacgaagcctcagccctcataggtcttatattaccatacactatgttaatgtaagaagaggagaaagagtggtaaagttacttaaagtcacccagctagtaagtgctccatggccaagcgcagaaacacaccgtgactgggcttgttctccctccttccttgctttccctgagcaggaaagagccagtggcagtatcatgttcagtgagatgcagggacgagagggggaatggagagagggacttagatgactgccatagccactatgccatgttcccagggacccccagccctggtggtaagtgtggcacagcttggctgattcccatcctgttcccaccccagatccaggactgagatcccagaaccatgaacctggccatcagcatcgctctcctgctaacaggtacccggcatggggcaggactggggctccaggcgccctggcttccttccctccagagaagcagcttctccctcacagtctcagaaaagcgcaggtgacaaagagagggctctttttcatcctgaagtcagccaatccaccgcgctgatattctgacggcctgaggtggtttttgaaaacacagtttgctgagccctccttcacactattgaactagaatccccaactgagaacccggaaccagcatcaactccctaagatctcctgtccttgaaacacattgataggatccaaggctcaagcagagtggggagggaggctggggtctgcaaaggagaagtgggatccctggggtggggaaaggcactcagagagcagaccccggtcccctccctagccaggcccatctctccacttcaggtgggtgggaggcccctgtgccgcaggcccctccagtttgaag

SEQ ID NO: 67653 - DNA, 1048 bp, Homo sapiens
atgtctgtgagcctcacccatgaggtctgttgtccattgctgtgtattattatcccaaagtgtgaaaaggccacagtgtgcctctctcttgtaccatcagtggggatgtgagcagtctccaggctgggacaattaaagttgctacaaacattcttgtatgtaactttggggtccatcaccctcatttctgctgggagtggaactagggttagtagatacaatcagtgttccagagtggttgtgccaatgtcgctcccaccaacagcgtatgagagttcccatggctctgcttctcgcccactcttggtgccatccgtccttttatcttttagtctttctggcaagggcatagtggtatgttattatgattcagtttgcatttccccatgactaaggatgttgagcactttttcatatgactatcagagatgtaggattttgaaagtttccaaggcttttaaaaaagaatgtttgaaggcctattgtcatacattccctggagctcaagaggaagggttagtgtgtatctggtctgccaggtgggggccctcctagaagaaatccctgttccggtggcctgggaggcactggagaggctgggacaggatgggtggagtcagaggaggagggggaggagatgtgctctgggggattcccagaagaataggaaggacaagccagccatcaggaaacaggagtcgtggggcacaacagagtgattggcatgaggcctcgaggtgtcatggtgaccacaccgggtggggttcgctggaaaaccttcctctggtccccacaattgacccgaagcaatggaaatttcctggggcgttaatgacaagaaggacaggggacagcaaggcacaccaaatgggattttccctgttgactataatgggttggaagagaagggcaggcagtcagggctggatggcagccggcgggagggaggtaatatgctggcgagaggcctggactaggaggcagggggctgggctctgcaaccagctctgccacttctcaccaggtgaccttgagcaaggccctttgc

SEQ ID NO: 67654 - DNA, 1043 bp, Homo sapiens
gccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcat

SEQ ID NO: 67655 - DNA, 1024 bp, Homo sapiens
ggtgctgtgggtactgccctctgcctctcctcttgcctgtctctcactccagctaccaacgctgcggcatgttagggctccaggatgggtggagtgctgcggggcctcgaactggagctgctcaaacctggggtgcagacagcctgtccttcctggcctctcctttccctgcctccctcccaccccctctacaccccaggagcacacgctgatgctgtcccctccatctcttttcctcacccagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccccgcacgccccctgcccaccccccacctcccactccaggagctgaacagagacttgcccagctgcccaaagccagccccgaactcctggggggccaggggagcccagggcagccacgacttggctttgtgttttatttcctccctctcctccgcccttccccatggtgttgtgttcgactg

SEQ ID NO: 67656 - DNA, 1442 bp, Homo sapiens
tcaggagttcgagaccagcctggccaacgttgtgaaaccccgtctctacaaaatattagccgggtgtggcagtgcgtgcctgtagtcccaactactcaggaggctgaggcacaagaattgcttgagcctgggaggcggaggttgcagtgagccgagatcgtgccactgcactccagcccaggcgatggagcgagactctgtctcaaaaaaaaaaaaaaaaaaaaggacttaggaaaaagaattaaatagaaggcctggaggagaaaaaaagcctagtgtcatctggtcccaagccaccacaccactcctcctgtcacccactccagagaaacaaggtcccagtgggccccatgcaggtttattcgagtctctccttacaatacttgctctgcctagaacaaggcttatctctaagacataatcttgccattgtagaattcattctgtcgtccaacagatacttcttgaacattgaccacatgacaagcggtctaggtgcttggtataaatccatgagcaaaacagacaaaaagtccctatccttgtggagcttacgttttcgcataggaggaaagacaatagataaaatacatttttaaaaaatatgtaggctgggcgtggtggctcacacctgtaatcccagcactttgggaggctgaggtgggtggatcatctgaggtcaggagtgtgagatcagcctggccaacatggtgaaatccccatctctactgaaattacaaaaattagccgggtgtggtggcacatgcctgtaatcccagctactcaagaggctgaggcaggagaatcgcttgaacccgggaggcggaggttgcatgagccaagattgagccactgcactccagcctgggcgacagagcaagactccgtctcaaaaaaaaaaaaaaagtagtaattttgaaggtgatattgaggaggaaaaaaagagagtaaggggatcccaagtgctagggaccacacaggtggagtgggcttatgagctgcagttttaaatagggtagttggggaaggtcttgatgagaaggggctatttgagctgtgtcccaaagagagtaaaggagtgaacctgggggccctggggaagtggctttcagggggcagggcagcccgtgcagtgtgtgccaggagtggggcaagcctgcaggaaagcgggaacagatgacttcagaggtggggcggggcgtagggcaagcagagcacgttaaggctctagggagagtcattggagggctctgagcagatatgttacacttcaacaggatttgtctggctgctgtgtggaaaacagtccacagagggaaaggatggaatcaggggagcagttaggcagctattgcaatcaataatccagatgaaagatgagagtatcttggatcagggtggtagtgatggagacggtgagaagagatcaggttcaaggtgca

SEQ ID NO: 67657 - DNA, 1072 bp, Homo sapiens
aaacaacaggcccaggctgtggctgtggcgatgggggcaccgaggagatggaccggacagaatctgtgtgtgcttccgtgggcacaggccccagagaacccctttcagaggcccttacacagaggagcagtttcatggggtgggcccagtggtcacaaaatgaagctccctcccttctccctctggggtaatgacaaggtggggagaggcccagggtgcagcctccaccagactgaaaaaaaacagatgaggcagcctctatccctgtgggtgtcgggaggagacaggccaggcctctccagctgggacccagcctctcgccactcccaagagcaggacagggaggctgccagggtgtaggatgtccatcccagggtgcagggcgtctgtcccaactcacatttccagtgaagcccgggctcatcccttgcaggtgagggtcacagtctgcccatcagtcctggagttcttcagacccagaattgcgggccttgaaggccagtgtcctggaagggaggcaggtgtgagcctgcaagtgtgcatgcccagccatggtatggacatgtgtctctgggcatgtaaatgtgaaccagtgtgaacaggctccgtctgcatgctgagtgtgcatgtgggagcccgtggctgtgccgtggcaacgtgccattctctgagccagcgaatggcagtgtgttgggaggtctgagaaggcagctgcatccgtgcctctgggaggattcggttctcccccagcttgccgaggccctgcctgatggtctgacacgaggcacagctgctgcagctgcagatggacagaagggcttcccagaggtggaccccaggcctccccactctccctgtggctggctgcactgcatgctggggggtgtagttcttgcagcttccaggcctaatctgatgccggagcatttcctgcctgaggaagcgccaggcattggtttcggaggcaaacccaaacattctctttgaccccaaacctccagatcctagatccagactgtaagccctaacacttcactccacctcagatctatccaaagcccccagcaccagc

SEQ ID NO: 67658 - DNA, 1057 bp, Homo sapiens
tgtggtgcaagttccccaattatgcccacattatctcagccactgggcagcctccagcagcctgggggaggggtggggagcacccaattatcctgctggagagggcctagggcttagctgcttgccaactagcccgtcagcaagagtactgggccgtctggcccactgacctcaccatggaactgtatctggagtggggccacagctgcactgggctgtcatgagacagttaggaccaggaggaccactgggactcgggaggccagtctgctgccttacagaggaggaagctagggctcagaaaggggaggtgactggccacggtcccactgcctgctaaaggcagaggcaggctacagcccagccttcccaactcgtggctggatacttctcccatcgtattcccaacccatggggcctctgcccagggagcatcagctccgaagcaccccacaggctggcagagggaacagctggaggagtgagggtggggataggcctgatggaccttgagggctgtgtggatgtgaatcagcacagagaagggggaacctcagggaaactttcagaacacggtagggcctggcttggtgaagccaaagatagacttattcagcaagcatttcttgagtagctactttatgctgagcaccagggatactgcagtgacctagagacctggcctgtggcctctcgagcggaagagaggggagcaacttactgcactgaccatgggttttggggccctcagaggagcctgtgttgctacaatatccccgtcacgctgaggaggtgagtgagcataagccccaaattcccactcttggatcccagactcccttggggggtcatttagatcctccccctgccttgggtcagtacaggtcctggtgttattaatgctattgatgacgctcaataaagtgagtgaagtaaggatacaaagacatgaagtatacaaatgacagcaaggacacggcttgtggggagttgcaggactcaggagagagctggagtgtacagcctagtgctgaggacaaccgccccacgttaaggg

SEQ ID NO: 67659 - DNA, 1050 bp, Homo sapiens
cagaacacatgttgtggatttcacttaagcagaaaccaaatgaggtgaaaatccttccaaaatgatagcagtttaccagccgaaggaagacgctgcctgactttgtttcagctcttagaaacctagcgcagcccctaccttggcagcctccctcccctccctgtctaaaggtgctcacaacaccccaccgcatgtcccctgtgtccctcccctcgctgcccctacccaccctcttgcatcctctgaggacacacatgccactctataacccatattctgacagccagctccccagaggaccctgttctctctacctgtctcccccaaacacaactcactgcccctcctacagagcccagactctccagccctgttcccagccacttctggaccctctgtccctggacaaacaaggacagttccccaccagagtgccccccaactatgtttcccactcctctctgcaccagcttgccacagccagccctgcatgtccctcgtgagctccaccatccctgcctgagctttactcccttcctctaggccagtggtcttacccggggatgattttgcctgccatgggagatgcagcaatgtctgtggttattttgtcatcacaaatggagggggtgcacttgggtagaggccagggatcttgctaaacttctgcaacacacaggacagccccccacaacaggacagtccccccctccaaaatgtcattggtgcggagttcattcgtgccctgggggagtagcctcatcactgcaggggtctgctcaggatcacagggtgggcttagagccgggatgggaatcagggaaccagagcacgtgatttctaggtaggttctttctcctagcaaataatacaactgcttgtatagcatagctatgggccaagcactacgccaagagcaaaactgaattatttcattggatcctcaaatcagccctaggagatagtactattactggccccattttatacatgaggaaactgaggcatggagagattaatgcacctttctcgaagtcaaccagctaaaaa

SEQ ID NO: 67660 - DNA, 2356 bp, Homo sapiens
tctcagatacaaaaaaaaaaggaaacactggggtggtcctggatgtagacccagaaggaggaagcagacagcccctgcccgcaggttcgtgtgcaggaaaatgatggtggggcgtgaggggtgcacccagctgtgtgaccttgggtgagccttttgaggcagcttcttgcccggagaaccgtgttcctgggtaaagctggggagatttgccaggaggaaccattgtcttggagaagaggtggcaaaaaggcacactaacacgtactccgagtgtgaaaggatgggcatgataaaggccactctctccctgtgagcgccattcctgagcacctgtgtgccagttccgagcccggcatcctggatgcagtggaggtgacaggctgaacaggctgagccgcgcatctcattactctagcaataagctaccttgcattttccatgatcaatccttttgggatctcatgaagagtgtgggtggcagaggactttaccaataatccaggttgatggaaattcagggtacgaggcagacaggaggttctttgctaacatgggccaggtgtgctttcatgaaagagcgtcagcctcgttgttgggagtcctgcctcagccacttgtgggtcgggtcacctcaggcattccctggcctcaatttccttatctgtacagcaagtaggttgggcttgttgctcctggggagctcttggagtctcctggcccatcctgggtacacaggggatctgtgtgggaccagctactataatcctaccacttggacaagtccaaggcaaacaccaagaagggtacaagacagcgtggtattgtgacttctgagggccagccagcctctgagctctggagatgcctgactgccccttgctgaaagacatttatctgtcccgttggtgccagcatgaaggcccttcctgactacttgggcctccagcacgtgggacacagagtggggccaggcagaagaaactcgtggtcagatcctctgccaggagcatttctcaaacccacgtgggtcccaacccctcccactggagctggggaagctttgaggcaccttggtctcctggtcatgccgtgtgtcagttacctcttaattgttgatcacctcccatgtgcaggccctgggaagtgctgggcatcagctttgagcaaaacaggtgccatgcatgttctcatggagctcacaggctggtgggggccagacactgaatatgctttttaagtgtggcaaaggcctgagcctggtgggaacatagagcaaggggggtttaacccatactgggggacagggctgcctcccagggtaagagatgttactcaaggcacgaagaatgaatgggccatggagaaagaggaaaaaaagaggaagagaccctgggaaggccctgcatctgccaaaggtgtgggggccacagcgccaaaagctaccatctactgagccatcatatgccagggtcagctctcagggctttgcttatagagctttatttaatcttccctacagcctttgagggagtgattattctctctccatttttatagacgagaaaaaaaagtcacagagcttgcaagtggcagagctgggatttgaacccaggagcctggagtcagaggcttctctgctgtataactgagagaacggggatcttcagcaaatgcccctggtgaggtaggactagaagggggcaagtggaagggccaggctaggcccaaccagaagcagaaggaacaatctgcttcttcccagcagcagagttagcctagcagtacacagatggcctcagccacagccctggactcgccttgatggcatctggcggtggctgacccactcccaggctctgtatcaaaaggcttagggaaatggacttgctcttcagcagaagggattgagatgaaaccacaggacgaatttcccagctgtcatgaccatacgctattaaaacaggcagccgagggaggtggaggccctggtgggaaaggttaatgccttggttgctcagagctgctggagaggtgagtggggcagggggaggtccaggatgacccctccagtgtctagagatgagatcacatcacacagatcaaaaacactgtcccacaggaagagggcactgtcagctgtccccaggctggtgccaccctcttcctgggaccctgtctgccccagccctgccatcggacttcattaaattgcattttcccagagcagggcaggccggtgacagaatgagtcaacgtcagcttgctacaactgtcgcccctggagccggcgggcatagagggagataattgggagtggtttgacagcttaatgtctggggctggcttcctggagcag

SEQ ID NO: 67661 - DNA, 1277 bp, Homo sapiens
agtcgcctccaccagtctcccggcctgcgctccctcctgttcattctcagcagttgtcagtggtcttgttgaaacaaagccgggtcacagatctcatccctctgctcgtggcctccaacagcatggtccagctcaggggagaggcctggcccctgcatcagtctcctccgtctagctacaccggccacagttaccagacgctctcccgccacggggcctttgcacctgctgtctgctgcctctgcctggaatatctcctcccaggtggccacatggttggcttgctcaccttgtttttttctttgctcaaatgtctcctttctcagtgagatcttctctgggcatctttgatctaaaattaattaatcctacacacattttatcttctttcttgtctggttgccattgctagaacataagttccatgaagacagagaatgttttctgctttgtccagtgctgtatgcctgggacctaataggtactgaatgacagcaggaatattttaataaatgaataccctaatggacagctgctgcctcctctgcctgcacaccctgtttctgcatgcaatcacatgaagtctccctgaaattcctgctcatgaaggcctaatctcgagccctgcctggccagcacacactgcatctcccttatggttccaccctggcctgtgatgtgggctggcctcccgtagagccttatcatcctgcagagctttatggcatctacacagttctctcaccttatcttcttagcactctctgaggtcaggactatcaccctggtttacatttaagaaaagaaagttcagaggttaatgactaatttacttgaaaataacaccacatgtaagtggcagggccaggactcaaaccagatcttagctagagctgtccccttgctgcccaaggtcccaggacacctggtcccccctccctggcgtgcgcagtcatggctgagctctcagccctttttctgcatctgctcacctgcccggagagagcctcccggggtggagtggggcattctcacctccaccaaggcctgcttcataccccacggaggagatggagactcattctgagccctgccaacacttagaaaaccaagttacagatggggcggtagaagctgggagcacccagtggacctcttcctaccctcaggcaaggggctgaaatccacagcctctttctgggaagcccttccctccagctctgggctctccatttcaagaaacacgggggtggactgcgtgcagtggctcatacctg

SEQ ID NO: 67662 - DNA, 1079 bp, Homo sapiens
tgaccatgtcaccactttgcttaaaaggcgtcagtggctcccagttgcctacaaggtgaagttcagaccctcatctaatacaaagcccttttacaactggctcctaccttgctttccattcaccctgtattcccctctcctctgccccacatatccagtgctttcgccacatccaagcttttaaagacactctttcctcttttcctcttcccctcctgttcccttccctctctctgtctgtctctgtctctgtctctatctctgtctgtctcaaggactcctgcttatcctgcaggacccagctaaaaaatctcacatcttctgtggcgcctccgtcaccttcagacagaatcactcccccttctgagctcccattgctttgggtttgtatttttcagaaacaaacaaaaactgcgtttatcactcagtcattatttgttttcatgtctggggcccctgctagacagagcttttaaggtaaaagaaaatgtcttagtctttcttattcctccacgctccttcctcttgccactaccactgtcactttcacccaaaaggtgccagcaccatgcttgacacattgtataggtgtagtaatgctttgtgaattaaagcaggggtagaagagtgtcgaggtgatggatagcccagccctgatttgatattttgatacctgcctacaatgtataattatcaaatcagggctggaagctcatgtacccccaaaatatgtacaactatgatatatcaattaaaaatccaaaaaaataaaagcaaggggaagaaccagagacagtacattagtctgagagaggcaaccctatagaggaacctggaggaaggagaggattctgcaacttggcatagcagggacaaggtggggtatgactggacctaggaactgcctacatgggcagttggagtggggagacggtggggaggtgttgttcaccctgttcgacagccttgtggagtgtcatggtggtcactagcatgagagatggggtggaaggtttggcagggatgggaggggaatggggaacggccataaaagagaaggtggaggtgacctttagcaa

SEQ ID NO: 67663 - DNA, 1948 bp, Homo sapiens
atccaagccggagcattgcccagccagcacgaagggaccagcattgcccagagcccccctacccccgggcctgcaggtgcctgccgggctcccaagcttagccacttttatgtccctctcctctgccctctgggaccgggcccctttgagggttttgaatcagtggcagaggctttctgcagcaactcctaggcataaattggagcggaggcagggacaggcatctccctgagtgtaaataacactgtaaataacactggagcggagcagccacactgcactggattattttatcgtgattgcccacctcccccaccccctgaactgtcccaatctcattggcctagattgctgcatctctcagaatgatggaggggctgcctctcccttcccgggcagggtggccagccctgccgttgaggcaccctcctacccagcaacttcccagatttattccctgtctttatggtgcctggagagtcatcagtgtcctgggccggcagagcactctgatggtctccactggcgtgatggataggcctttgggggaacgtgtgcgacagccccctgctcccggcctgcctctgccctgaccacagcaccgttccccaccctcccaggggtcagatgatgggcctcgtggccagtcctgaaggggcggtgatgatggaagagggagagagcatcagtcctcggcgcccacctctcagtgctgctgcagagtctttctggcctcctccccaagctctgctcacaaacacccttcccaggaaatatccccattaccctctctcatctcccatcactccattactgctagcccctcggcacttgtgtacacagtttgcgctgtaatgataatctgtgctggtttatgtgtttctttacaagtgtttttatgtcctctgtgtgtgtatgaggaaggtttatggtgtgtgtgcgtgtatgaggtcacgtgctgtgtgtgtgtgcgtgcgtgcgtgcgcgcgcgtgtgcacgcgcctgcttctgattagactctgatcgccatcttctcccacacacaggtagggggccctcacccccctcctggggttgggggcacagcctggctactaagggtgggtggagaaggagggggagccaatcaaagatgatgactgtccgggcaaggtctacactgccccccagccgccagttagagaaccggcgaaggtcagtcttagatcattgttttgtctacagggtcacaaacaactagtttgactatttttccccaagaaattgactgaacccagtggttattttggagtcaaatgatctcagtcttttatgacttacctgtgtcagcgggtgtatctgtgtcttctctaaacaagttcccctagctgtacaatgggatgagatgataagaggctggaaggggcgaataacatatgtggtgtgcttagcacaagcaataatttgcttgatccagggaaagccttcgcaccgctggactgttgtgagctaccactgggagggactcccagtctggagaaggagggtccgttccctggggctggggaagccaggcccaggaaccctcctggctgtgtgtgccccagaacgctgtggggagcccctctgctgggctcctgtgacttctccagggtggtcaatgcaagcagagtatgtcttagtctcaggcccctgggctactggagatccgcccccccaacccagatgatcacctgggcaggtgcctcctgtgctcccttctgaaaggaaagcaagggtttcactcaaggtgcagaattctggctgccccaagcgcccagtgccagtccctgtaggaatcccactgccctggatgtgttgtgggagaggcagacaggttcatcctggcattcactcgacatgtgccaggcacagaggtgggagctgtagacagcaacaaacataatatccagtccagcactgcatggca

SEQ ID NO: 67664 - DNA, 1023 bp, Homo sapiens
tggcctggggtttgcagcatgtgtaaatgggaatctccttacccatttataaggcagcactgtggagtgccttggaattggattctaggcctccgtagtcaaggctggaggggaagaggagatactgcagagcttgggcccagttgccctggctgagtggcccggaaggcatctcttgaacctgaacttcagagcatatgggacaggtagcccttgttgcctgaggcttgctgaggctaagagtgttattggttcccttctcagccactcacctttgtacaatgaatccaccttggctactgtttgacccccggactctgctgtatgttttcaggatggttgagccggccagaaccctagtgctgatgactgagcaagtggaccaggcttggggggcagagggtcagttccagttgctgtctatgatactgccattgtttagcagctgactaatgttcattgttcagcacaaacagaaaatacccaagggaggtgtgaatgtatcttcaatttttccgattgtatctcttcctggttaacctggtgaattgaatgcctcctacctcagagagggacagacagagaggtgtcagcatattcacctgttttgctgatttaaaaaaaacaaaaaacaaaaaaactttaaacattagccagtgtgccaggctaaaatggtcatgagccagctgtggaacttaagctgtgacatttctgacagtctgcatagggtctcacctttagtataaagtgtgtgtgtgcacacaggtatacagggctttggtgtttgtgttggtgatctaccattcactgtgtgtgtgtgcatctatggggactaggagtagaaggtgtatgtgcttgtgtctgtgggtcactatgggactagggccataaatatataacatcgaatgtatattcacatataactgactgcttagagttttctgactaggacctgtgagtggtccagacttgagaatgcctattttatgtgtcagagtgtcggtgagggtgactttgggaggg

SEQ ID NO: 67665 - DNA, 1134 bp, Homo sapiens
cgctggtggctgtggtgattatgatggtgcctctgtatcccacagcgcttagcaacatttaattactgttattcctatggagatcactgcagagtcttggctgccattgctcttggggatggagcaactacacacagctgcacccactccccagtccaatgatccactgtgttgaagtgctgccaggatggttaacagacaccagcctctcccttgtgggccatggtgtcccagcgatctgcatggcttttggggctgagctctgagaggtgataggaaggcccaagttccatcttgaaccatctaactctccagaaagaagggaaattgttctatgccttgtgtctggtcagaaggccctcagtatacttctgtgaatcatgacgtcccaaatcctaaagaattctggttgtgagtagaggcggcactcctgattagggatgggagcacttaaaactcaacggtgatactgagaagagggtttcatccaggatccgcatagaccggagagcttaggtcatgaagatgggaagggacggagtggagcttctgtgtggagcatgccttatgtagaaagatgaaagggaaaagggctttgagaaaggaagatactcaacctcccacccacactttcctccctttgatgatgctcttatatccagggatgggtgttatggtcaggataattatcaggatggactacttgtctagaggaaccagatttttcttgcaagttatgtgaaaaccaagaaatagaaggtattgttagggaagagcagagttcctggatcagcccaaccccagcagaaaaagctcatggttgatgcctgcctgggagtggggaggtaaggctcgggctgtggagctgtgggtcttgactctttggtctcagaccttttcgggatctgatgagcgctgtgtccctgaaaactgcacatacgcacaaggacagtgtttgcatggcaacctgctgaagcccagctggggccttgagttaggaatccctgctgaagaaggagtgctttgggaaggaggcagccctgagcccagactccctgtgatctgggctaatgactgatgctaatgacatggagaaccccaaatgaggaaagtccaacccagacccttctataa

SEQ ID NO: 67666 - DNA, 1025 bp, Homo sapiens
gaaggcagtttccttttcagacccaagagtattggcaagggtacacctcaacatgttcctgcaactcatacccgggcagacatggagccctcctccccctgagctataggcagggtggccccgtggctgggagtgtgcagtaccccaattcctccccaaccccatgctcaggctcgagtgaaggcagcctcctgggatacttggcccctgatccagggtagcacaagtggcgtgatgatgaaggcaggagtcagggactctagctggggtgaagagccctcccaggtgctgttgggagggcctctaacatgctggtcttgacctgcaggctgtctcctgggtctgttctgagctcacccatctgagggtgtttaatccttttgcggtgatttaaaatatgtatgcaattatttgatgttccctttaaaagatggagccaattctcctcccttgagtgtgggctggactttgaggctcagttttcacaaatagaatatggcagaagttatgccatgtgacttctgagactaggtcataaaaagtattgtggttttctcctggctctgtgggaagcagctgccctgttatgaagacactcacacaacctctttatgaaacctccccgtggtggggaactgaggcgtcctgcccagcaccatgcaagtgagccacctgggaggtggatcttccaaccccggttctgccttcagatgcctgaagctttggccaacttcttgactgtggccacatgagaggacttgagccagaaccacccagccaacattctctcacagcctgtgactcacacaaactgagatgataaacatttctttgtttaagccaataagtttggggataatttgttacacagcaatagataatgaatgtatcccaaacttgtttgttttcctcaggtgtttggcaatttgcaggaaggattttaactcactttccattttctgctagggggaaatcaatgcccatggtggctggggcccacccacctgtttcataaggacctggga

SEQ ID NO: 67667 - DNA, 1091 bp, Homo sapiens
ggggtgatttgcctggcagagcttctagaccctggcatatcctgcaagccatgccccacttctagaccctggcatatcctgcaagccatggccagcgcccttcttatttcctgatctgggcccagagctggtgaaactggcaggggcagcctagccagagcagggggaggcagcaaagccatggacttgccagaggagctttcaggggggttaagggcttttaaaacagcccatcagcatggagccagcatccttggcctttggagtgatggactgggaaagaatggggggtagtttagttgacagcatgttgatactaacataaatctcattaaaataatgaatttgtcaaacataaccatgtctgtccccttaacagtttagggtgcaatggctgtgcccctttatgtccacgtaataaggatgctgaagcccagtctccaacccatgactgccctgagatggcaaatccagacacaccctccccatcctgggccccaggaggccctgggcctaacgagtgtttggaggggcaggaccagacttgctggcacccagggcccttgcacttgcctgccccctgtctggactgctcctcctgagatgtctacatggcttgctccctcacctcccacaagtcctttgctgggattttacacttgcagcccggtggtctctggaaagaccatttaaaattgcccctgacctggccatccctccactccccctctgccgtgcatctccctcccgtttaatcagtcattgctgtgtcctgacacctgcctgtaatggtcatggggacagggatttctgtctgtcttaccgtactcccaaacctccaatggtatctggtacatagtaggtgctcaatacatatttgttaaacattcatttgcacctgggttgggaatttttgtgtaccacaaggagggttttgcaatctttatctgtttttagatatgtttacttttcagaatttatctccttttgtgtttttgatttctaattcacactcaacctcttattcccactctgtactgtttaggataatataaatgataataaaaagtgggaaataacctaaatatcca

SEQ ID NO: 67668 - DNA, 1060 bp, Homo sapiens
gtattttacacacatttaactgtttaagcctcactacgaccctgggtgctggatactgttattatacctgtttcacagatggagaaactgacaaacagaaattgccccaaatcacacagctagtaagtgaagatgggatacaagtacgatgtagaagatgttaacagagggacaccatgagatgcttatctcaaattcagtcacccagcgtgtgagaccagagttggggattctctgctctgcttcatctagggaagctgcggctggagaagtgggcccaccctctcctcacaccttcgtccccctcctcctggctccccatatcagatttgaacagaaattgggccactccatctttgacattagcctcctcctcaaatgtcccagcaggctggggagagcctcagagatgggagccggcttgggcctacaaatctcgccttcctgcccaaaccggggttcagcccactaggccattttcatccagcgggtcaaaaagggcattgccaaggcttctcttcccccgatctcctgcttctaggtgtcctgtttctcagtggacagtgttgatccaaccaactacagaagtctgtcctccatttcccagggacaggggttctggtcccttccaggggcaatgagagtgacctctaggtcttagtgtgaaggatcctggaggtcacacagaacacagcaatgacatgtgtgggctcttgagtcaagtcaatgtttgtatgtactgggacctcactttcctcacctgtaaaatggggagttggggggatttaatgtgtacaatgcagtggctaaaataggttaaataatggctactacagtggctagacccaaaattaaaatttgcctttcctgtttggatcatctggaaaattcacttttttttttttttcttgagacagagtctcactttgtcatccaggcaggagtgcagcagtggcacgatctcagctcactacaacctccacttcctaggttcacgtgattctcctgcctcagcctcctatggagctgtgattacaggtgcccaccaccacacctggct

SEQ ID NO: 67669 - DNA, 1036 bp, Homo sapiens
atagaggagggtgattcctatttaatctgtttctcccacgagcccagcaaggaggagcctagtaaccaggtcttacctctgtgtcccatggcaagcttggaaatggaggtgtctgtaaatgcctgtgggatgacagaggagaccaagtggggaatggcagcggcctctgactaggggagctccttccctccctccctccctccctccctgatccttgcctctctcccccaggtgtggacagttctgtgttcgaggctctgcccaaggcctcagagcaggcggagctgcctcgctgcaggcaggtgggggaccacgggaagccctgcgtctgccgctatggcctgagcctggcctggtacccctgcatgctcaagtactgccacagccgcgaccggcccacgccctacaagtgtggcatccgcagctgccagaagagctacagcttcgacttctacgtgccccagaggcagctgtgtctctgggatgaggatccctacccaggctagggtgggagcaacctggcgggtggctgctctgggcccactgctcttcaccagccactagagggggtggcaacccccacctgaggccttatttccctccctccccactcccctggccctagagcctgggcccctctggccccatctcacatgactgtgaagggggtgtggcatggcagggggtctcatgaaggcacccccattcccaccctgtgccttccttgcgggcagagagggagagaagggctccccagatctacacccctccctcctgcatctcccctggagtgttcacttgcaagctgccaaaacatgatggcctctggttgttctgttgaactccttgaacgtttagaccctaaaaggagtctatacctggacacccacctccccagacacaactcccttccccatgcacacatctggaaggagctggcccctcagtcccttcctactccccaacaaggggctcactatccccaaagaaggagctgttggggacccacgacgcagcccctgtactggattacagc

SEQ ID NO: 67670 - DNA, 1452 bp, Homo sapiens
aatggaggagctaatgaatactaactaataacaacatcttgctcatttagattttagtcctgtgtgactaaattgactcagttatagttgttcttgtcctaacgtatttgtcaccagtaaaagttccaaggtacagctttctggcttcatttcatttttaactgaataattgccttaaggatatttttagatctcaacaaaaactcccctcctcttgaaccttagaatccttctgcttcactcttggcaaatctttgggtcggatttcagaactgaataaagccaggatttccccccaacctccaagatgtctggactctttgtttagttctgtatttaagtttatcccaagttttgtttttgactgatgaacctgtgacccaaatccaaacctcagctgaatttagtatcagcttaaaaccacattaaactgccatgtgtcatgtgacctctagcagaaaccaacgtggcagtgttctgttttttcatgagtgcgtttcattggggtttttgaactgtgaagacattatttaatacatgtgctttattttctgtgtattattgcccaaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggtaggtaggggattttcccttagggatttatgatttgggggtagtcttagaagtatgggacttttaaacagaatttgtacaatactgaagactaattcccattataattttgtattggaatccttattcttcttcattgttaactctgatattgtttatgtcacctgttgtttctgcttttcataactctctacttttaaaacagattttaaattgcttgttacaatttaattggaaatacaaaaactataaagccagtatcaacatcttccactaccacccccgaaaagacaaaaatagaactgtatcatacatatttttggcaacttgcaacttttacttgactgtctattcaaaagacag

SEQ ID NO: 67671 - DNA, 1051 bp, Homo sapiens
ttgaagtcaatggtgtttgattagctcagtgggtgagcaagcatatggtgctactggagtcaaggctggtcagtaggaagcatcagtccattccatggccactggtaatctaacgtaatgaatggtgtcttttgttgttgttgttgttgttgttgttgtttgagacagagtcttgctctgtcgcccaggctggagtgcagtggtgtgatctcaactcactgcaacctccgccttctgtgttcaagtgattctcctgcctcagcctcccgagtagctgggactacaggcgtgtgccaccatgcctggctactttttgtatttttagtagagacggggtttcaccatgttggccaggctggtcttgaactcctgacttcatgacccacccgcctcggcctcccaaagtgctgggattacaggtgtgagccaccgtgcccagccatgagcggtcttgaaaatgaaaaatggtcttggccacagaaaccaggtatgagggagtggttggaatggtataaagtcatcactgttagggaaacagtaactttaaatgcatgttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaa

SEQ ID NO: 67672 - DNA, 1777 bp, Homo sapiens
ctgcgccgggagacgccgccgcctccgcctcccggaccagggcttccaggccgggccggacgggcatctcccgcccctcgcggggagcgtcggggaggagccgccgcctctggcgattgcggaagagtccgggcctcaaagggatggggagcagtccgcggcgctgagagacccgggtccctgtcacctcgggccgcgggacctctccgccggcgccagcggctcgtcccagcaccgggagcctggtgagggcggcgagcacagaaggagccccgggcccgggacatggaatcgcgcgagcccggcgcgggacggccggagacgcggccaacgctgcggccacgagcagccggcagccccagatagagagccgggagggagggccccggcccttgccgcggcggggagttcgaggccccgagactccggaggaggagccgacacccgtccgtgagctgatcccgccccagccccggcgggagtcccgggtccccttcccactgcgcgcggatttccctctctgaggaagtttatccttgtgccttctggaggatttctctctagctcgactcactctggactgactcgctccctggctttctcagttcgttttgggagataacttgttttgctccaagccgcatccgttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggttggtatgaattcctccttcgttcggcctcccggaatcgggcccgacctagcaggggagtcggtgattgcagattgcctttggccagcgaagttgacaggcagaggaaagagggttgtttcggagctgtgcagttagcctggggttgctgccgagttatccagttgattggcttttggaaatgtaatttttccggagagaaacttcccttccgattctcagagaagggggaggcaaaaccatgattgtggttttccgcctgtagtgtgcattaggattgtgtactcgtctggaaatcagaggagaaggtcattttaggtgaaggtcggtgcctgaagtcggctcggtattggtgtattatttatcagctttagccgtgtcctgcagtagattctcaagacaattacattttaggaatttctacctgtgaacttaatgttgagcctactgcatggtgatctgggaacttgatctctttcagatgttgacctgcacggtgtttaattattatctaataactttccagaatgttgacattaccagtaaatcacaggttcttgctggaagcaatgtccaggagctgaagaaatgagggtaaatcatggggtttgcttttaattcttgtatttaaatatttcgtcttccagaaacacttggcgtttaagagatataagccgtaagcatagtgtaagcgcgcagctgaatttgttgagttctgtgtctgtcctttatagcacctaccagtgttgcatggtggtgggtggcgaattgagctagaccatgtgtggttgaagtgcagtttgcttatcctaagttactcttgtttatagggtaagggataaaaagcatattgattccttgaccacatttcattctcaatttaattatgacactgcatgctagtcccaaatttgtcagcttgctttattttta

SEQ ID NO: 67673 - DNA, 1756 bp, Homo sapiens
aatcttggaatttgtatcctctttataacgtagatggcatataaacattcaataaatatgaaattactgaaagcctgtttcttttctttttcttttttttttttttttttggccaggcactgtgcaggcacaagagattacaaaatgaatattgtaagattaatctgcaaattggtttgggcattaatgttttttgaactggttcaggtgctgctgcctaattttacattttttttttttaaagaaaagaccttggaaagccaattaataagcactgctgagacctgtttcgtaggatttttttttactagggtctttttttattaagaattattcttatttgaccacatttaaatatattttgtaaatataaagcatccatttgctgttaagagagtagttgttcctaatatgaatatatgttggggtgaaatctggaggtactggtttagtattatttctctgccaaggtgtcttaacaaagttacgagtatataatagtttctagctttctgtcagccctacctcatccttttttcgtagtgtctaactcttactgtaggtatattttgctgactctagaactgttggaaaattaacagcaccagtgtagctttttagatagagatcctttcaagtttgaagtgctgtatgtggtatggctttgtttcgtagagtgtgcagaaccaccaggccagctgtgtgagttagagttctttcattgtggtgcttctgactacagagtctgtctgtcctcagttgaaatcagactagctggttttgggcgttgttctgttttgcagtttgtggcaggcgacacatggctgaacaagataagggttttattcttgtgttagggacgtgctggggctgggatggaattcagctatgtttaggctctgattggtcactttggatactcagaactctgttacatcctgttattattttgcagttaaatcaacacattaacttgctctcttctctttcccttcatcttttactccccagtccgcaccccttaaaacctaaaactcaaactttttaaaagactttaaactcaaactatgttcatggtagctattacttctatgtagtatatccaaacagctttaaaaaaaatggtaagcaatttatgagccctggagtctgtagttttcatcgtttagaatgagcacttgacaagtgtagaaatgtctgattgctgctttttagtctgcattgattgctgcattcagtcttaaaatacatcctaatcgtttccaatcctcctacatgtctttcttgtatccctgagaatttaggggtcctatagcaattggaatttcttctgagaggtagacaggagagaatgcccttttagtagactcagtaaatgatttcaggccagtgtctataacattgaattttcagggacagtacaggtaggaaagttatagggttcttccttgaaataaatggacttttgttttggctagggcttatgaattttgtagtttttgatttatagataaagacaggtttttgatacaatttttttaaagcactgaattcagctttgagctgtttaacttaagcagatttttaaagtgagtgtggaaacctgtgactttatatgcctgtacccagtaattaatgatacttttcattagtgatactttttctgtcaaaattgctgtataatggttttgattaaaaaaaaaagagctactcatgtttatatgttattttcaacgttgcatgagtcatctctcgg

SEQ ID NO: 67674 - DNA, 1057 bp, Homo sapiens
accacgcctggctaatttttgtatttttagtagagacggggtttcaccatattggccaggctggtcttgaactcctgaccttaggtgatccacccgtctcggcctcccaaagtgccgggattacaggcttgagccaccgagcccagtggttttttttgttgttgctgttgttgttttttaactaagtttgagttttcagtttaaaaaatgaaatttgaggcaaacattcatggaatccataaatggtgaattttacatatgtttctgtggagcattgcgattccagggaaaacagttggaaaatatttcattgtacatatgtggttgcctcttctaaatgtcatccagtggtgggtatgaattgcttcccaaactgatacgggtcacagaaacagcaagataacatactggttcccagaggtaattgaagggactcttttgcatcatggttgtctgacattattagaaatgtttcttatatacttgcttgtttcctagaaattgaccatgacacattttcaagaatagtagcttaacttcttttggtcttttctgttaaaacttggttttgatgatgttcctgagctttatttgaagacatgctcctttcccttataataattacaggttttcaaaatagtgccatgtgagttaaaatttttaaatcaacaaaattatatttttgccttcttttgagtaaaataccatcatgtaggtaatgatatcctgtggtagtataattctttaacatttacaatattttcagttcagtacagggcagatcatgcttctgtcatttacactttaagctaattcatacagtttaagtcaagattttaagtcaagattataaaactagaaagggcagacccaagattttaacctagattttctggctctcaagtcccccattgttttttttcattttaaattattgtctttctttgtactgtatttttctgtgctattttcctttagtaactctccagcttgatgaagtcagttggatttttctcttacagcatagtttctagtaccttacccattctaattttaa

SEQ ID NO: 67675 - DNA, 1008 bp, Homo sapiens
aggaagttgtttcttattttttccagtggtttttcagttcgttatcttaaattgtaggtcaaaacattcctcgatgtttggtttatttttaccttattgttttgtctcctcttatttccacatgttagtgaaataacaatgcttagcagtattttttttttcagtaaaatggatattgtgaaaattgaaatattttactttcttgctgttgtatttacaagaattgttaatgacaagacagtgtaacagaaaaagtgcatatttagattattataaaatctgtaagactgtagaccttttgaatactttattagcatattttctttagtactattttagtttcaaattattgagatagatgtccttgttttgtattttgctaatattaatattttgtattttggtaatactaaaatttgcaaacatgccaaatttagagcattttactttttcaacttagaatatctggaatcatcaagatagtcatatagggaagaccgctataagacagcttctaactccaatagaagcctatgaagctagtgcctggtcagaggctgtgcctaaattgcatgagtatatagtgtcgacttttagtaaaagaaaaaatacactaactttacctcttgaattagcatgcaccaatgcagtttagattcataccgaaacaggatcttttactaattcaaatgctgagtcctggtttttgagatcacagtcacatgacaggcctgggtggcttctcagtgtctagagacaagcaaatctactggccaatgaaaagtaggtttcctgtcttggactgcaagtaacaattcatgcagaaattggaactatataagagagcctggttttagttaatgctttcaattagctgcttgtcacactgctttttcttttggtgttatataacacattagagtcatttaaaggtacactctgatactacagtttttgtcaaatattacatataaatgttgattttacattcatatactcaaaagatca

SEQ ID NO: 67676 - DNA, 1024 bp, Homo sapiens
gcactatccactatggtaaccacaagacaaatgtggctatttacatttaaattaattgaaattaaataaaattgaaaattcagttcctcagtgacactagccacatttcaaatattcactagccacatgaagccagtggctacagtactgttggttgatcatagaacgttttaaattattgcaaaaagctcttttggacagtgctgccaaacatttatcaacgcatagtttactaagatcagaaatcggtgagcaactttgctgggtggttctgcttcaaggtttctcatgaggttgcagtccaggtgtctgcaactagaagcaagggcttcaggaatctgaaggctcaactgcacctggtgggtccatttccaaggtgacttactcatgctggtcaagtgagtgctgattgttggtaggaagccctagctcctctgttggtaggtggacttctctgtggggatgtgtgaggcagctggctttgccctgagtgagtgattttagccagagagggaggtagaagccattataacttttgtgagctgacctcaaaagtcacactacatcatttctataatctgttggttacacaggtcagcactattcactgtgggaagaaactatacaagggcatgaataccaagagtcaatggggcccattttgtttttttgagataggatctcactgtgttgctcaggctggggtgcagtggtgtgatcatggctcactgcagcctgaatctcccagcctaaagcagtctctcatctcagcctcccaagtagctgggactacaggcatgccaccatgctcagctaattgtattttatttttatttatttatttatttttggtagagatagggttttgccatgttgcctaggctggcctcaaattcctcggcacaagtgatctgcccaccttggcctcccaaagtgctgggattacaggcataagccaaagtgcccagcctattggtggtcattttggaggcttcccaccacaaatacttacggaatatctggg

SEQ ID NO: 67677 - DNA, 3262 bp, Homo sapiens
tcaaaaatttcaagcatcttttacaattttcgaaatatttccagtgagtttttcagaggaatccttaactggtcctttcagagaggaaaaaagtatccagctcacctacatatctcatagttctagtttcacatttatcttgttcactttgttttgtacgtggaatacgtaaacttgtcaggataaatttaggttgttcacataagtagatatatttgtcaagatatgcttatttgcagagcctgtctcaggcatgcacatgatctcacaaactgaagatttcttccagaaatatttgaaatttttcctgcagctcaaaaggatgcatgaagagttttccactctttttgccaaactctatatgtagccccaattttgaagttacttttataaggttttaaataaatggttttgaactgtaatgactaacaaaaggcatgtgaatgatagtgctagagatgctgccaccaaagtaccaagaaagaatatcatgcttgatgataaaataaaagctttggagtgtctcaaattggctgaatacatttaatgagctattagaggaaacatggtaaagatggatggtcatttagaaattctaaagtcctgtaatgttgaggaagctaaacattatcaaatcttggaagaagtaatcaatataggaagaagaaggaggagaagcaatactttggatactaagcaatagtttcaatactaagttgaaattacttagctaacctcaatttaatggactcactacatttcctctgcagaacatgacttttacccagtgagttaaatgcttgtgtctcatggctattttgtagtgtgtctgaatgcttctacttcgtccagttgaattgtataatctcaacccgttgtacttgaattggaattagatgatttagttaaatattatgaaaactgaaaactgatgaaatctgagcaccaaaaagaaagttatttctataaacagtgagttgtgtgtgctttggaaataagagtagagacttgtcactgaaaaaaaattctgtcaaattagacgtgtatacaaaacaattattatttggaaagtatcttctagattattatgaatgtctttcgtttcttgctccactctaaggaaacaggaaataaatcatagctgatatattttaggacagtttataccagaaagctgatgggacactccaatcaacagacccctacttaaagaaacagccaggcgcagtggctcatgcctgtaatcccagcagtttgggaggccgaggcgggcggatcatgaggtcaggagatcgagaccatcctgactaacacagtgaaaccccatctctactaaaaataaaaaaaattagccgggcgtggtggcaggcgcctgtagtcccagctacttgggaggctgaggcaggagaatggcgtgaactcgggaggcagagcttgcagtgagctgagatcgcaccactgcactccagccttggcaacagagcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatggagaaatatcatgcaacttaggacagtgctttggatggaggaatatcatggaactttagttttccagctttattgagctttgcctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaacaaaaaaaaatttagaaaaatcccttagcccatcccatgctgtgctgggagcttcatctttctttttaattgcaatttaaacgatctactgctacaagagggttgtggtaaagcagaatttcttatactgtgcaggtgggcatgtaaattggtttaaacttacagaaaataatttgacaatatagttcaaaagcctaagaaatgtttaaactttttgaattagtaatgccaattttggtatatatctcaagacattaaggatatacagttttagctgtcattttatacaaagagatcacccacaccattattttagtaggggcaaagaggaaccaatgtaagtctggtgcctctgaagaggtagacctagaaactgggatgacaaggaactcccaggggactgctgttaataaattactttatgtcatttgataaaatatatgtaagcattaaagacattttcaagtaaaccttagtgaggaaattgttcatgatctgtgaaaagtatgggataaaacttcaaatataatgccagttacatttttaaaaaacattcatgtgatgcttttaaaaagacttctaggacatgtaccaattttttttttttttttttttgagccaagtcccactttgtcgcctaggc

SEQ ID NO: 67678 - DNA, 1088 bp, Homo sapiens
gctcacctcctgctgtgtggcctggttcctaacagatcatggaccagtattgtctgtggcccaggagttggagacccctgtcctagagtacacagtgaaaaagtttgatagagaggggaacagtggaagattttgttagatatgtcacatgattaatggatgactaaagttttgtttggtgatctaggatgatagagatgttgagacatgaaattagttggcttcaagttctaagctgtcctgtgtgagaaattgcctcatcagccaacacaggctttgacatatgggtagcttcgtgtttcttaggatacttgggctggtcagaaagtgccaagcatcagagaaactgagacctcggtataggtggaggaagtctaatgatagccacagtcagtagcctagtctgatttgtttttagcaaatctagactattttcttaatcagtaactacttctttagtaactacttacaaggcgactgcctttgccaaggtatatgttctctgaaagctgattcttcatagatcactaactgtagttttgaggttctgtgatttccttcaaaattcacagaaccttgagctataatttatgtggatagagtgattactgggatttaacttaaaattagatgtattcaaatgttttaaggaatatgttttgtaaaacaacatgtttttcattcgttacttatatattgatcccagaaattgtgtgcctgcaaattgtcaagttgggttgatgcttcagaaaaggaaagtagaggctgagtcttcttagtatagcaatgcattttttagagcagtgtttgaggcaaattattttcgcaaaattacatggcttctagggattagattgcatgagtttgtctcttgttcctccctcattctactgtaagaggccaggctgctagttaacagaatgccagacataatgcctagggcatagtttgagacctgggaagattcacaataatcaaacacaaacagacagagtagcatgaagaaatttcaatcctcccagtcttgcttacagatttaattaggcttattggggcagaaaatatttttcctccccccatgtttaaat

SEQ ID NO: 67679 - DNA, 4259 bp, Homo sapiens
ttatttccatcatggtgatatgagttatcatactgtttgccacattttgaaagctgtttgactcctcagaagtattaacaaattaacaaattcttactgagcatttacattatgctaggttctttagatgtatatcaggtttatagtctagtaaaggatataaaaaactcatgcatatgatgtaccatttttggtgcaagcatataagtattgcagtgttatatatttatgtactgacatgtaggtgttttacataagctactacatttaatcctcataacaacctagtcacgaaattattgtcattcttgttatcctatgcacattagtccaaacaagcaaacaaaaattgtcattctcttttatagatgagaaaatttacattttgagagattaagtgatttaccataagtaacaaagccatgaagtgatgaagcctgggtcagtcagactctaaagctctttccactgtttgtatatgagtagattaaagcattttatcatgattatttgacatcacaaatagtgatgccatgagtgaaaaggagatagggatcctaatctttaatctatgccaagaactgagtgattgagcaaatcatttaacatcgtctgtaaagtgtgagggttggactaggcaaccttggttcatgattctattcagtgtaagagattttcacatatggtctatggaaacaattctcattactttagtgtttttattatatttagtttccattactcatccttcataatgtgctgtacatgttggattgtgtgtggtggggggggagggtgatagagtgcatatcatcttctaacatattacatacaatatacatttatttattaagattattactgtctgtcatcttccttcttcccttcccccaaatatgtcacgaggacctagactagagcctggctacatagtatgcagttataaactaattttttgaatgaatgaataggaataatagacttgtatagtacattggcaaaatatataagtaacttcataattcttaacaccaaaagattccctgggggccaaaattattaatctttctattacagtgatcctttaaggaactaagtgtaagaatcttaaaaagaagaacacctacgaaacaatcaagtgtagtcaagtaatctgaagtttgctggaattcccccatacaaaattattggtagtatagaacttgctaaccataggtttgtttacccagtgttctatttgaaagtagtttactaaagcattccatataagcaaagaaaaaaagcagcaaagtttcttttttgtttatgtgtcactgtatagtctcaaatgctgtaaatttacagtgagtagaaaatattcagaccattgagtcttttgcttaaaagatatttcgtaaggtataacataacgtttactggtagttttgtttcatttaaacattaggcttcttgagagttttaacagttttattgaaatgtaattggtgtataataaactgcctatggttagagtataatttgataggttttgatgtatatacacgattaggaaactatcaccacaattgagaaaataaacatattcaccccaaaggtttccttgtgcattttcataatttctccgtccctccacccctcctcacctatccccaggtgtacccattgacttgtctttggtccttatagagtagtttgaattttcttgctttctttcttgtcattatagattaatttgcatgtctttttgtaagtgaactcacatagtttgtgcttttcttatgtggtctcttttactctgcataattattttgagatttgtctgtattcctgtgtatcagtagttcatttctttttattgctgaatgatatcccattgtgtggatataccacagtttatccattcagctgttgatgggcatttgggttgtttcaagttttagactattaggaataagtttgctttggacattcatgtacaagtttttgtgtgtacataagctttcatctcttaggtaaacacccaggagtggaatggctggattatatggtaggtatatattttaactctttaagaaattgccagactgtttttccaggtgactgtattgtgttacattcccattagcaacattccagttgctgcacaacttcattaatagttggttttgtcagtctttttaattttagccattttactgtgtgtgtgatggtatcatattgtagtttttatttgcatttcatctgatgactaaaaatgtttaacatattttcatgtgcctgttttatcatccatacttcttttgtggattgtctgttcaaatcttgtttttaattgagcttttaattattgggttgtaagagttccttatatgtttgggatataagtgcttttattttttttttattttattttattttgcgacagagttttgctcttgtttcccaggctggagttcaatggtgcaatcttggctcactacagcctcctcctcctgagttcaagcgattctcctgcctcagcctcccaagtagctgggattacaggtggccaccaccatgcctggctaatttatttctagttttagttttagtagagatggagtttcatcatgttagccaggctggtttcgaactcctgacctcaagtaatctgcctgcctcagcctcccaaggtgctaggattacaggcatgagccaccatgcccggccataagtccttttaggtatatgatttagaaatactttctcccagcctgtggcttgtattttcattttttagcatcctctttctctctttaatacttttattgagatataattcacatttccttgagcaaaagttttaaagtttgaattctaatttatcattttttctttcgtagattgtgcttttgctatatctaagaaatatttgcctaacccaaggtcacacctctttgcttctagttttatagttttgggttttacttttaggtctgtgatacattttcaggtagtcttttatttttaatttttgtgggtacctagtaagtgtatgtatttatggattacatcagatattttgatataggcatgcaatgtgtaataatcacatcagggtggatggggtatctttcatctcaagcatttatcttttgtgttacaaacaatccagttgtactcttttagttatttttaatgtacagttaaactattttttactataatcaccctccactacccttcccagcctctgataatcatccttctactttctgtctccatgagttcagttgttttaatttttagcttccacaaatgagtgagaacatgtgaagtttgtctttctgttgctggcttatttcacttaccataatgacgtccatttccatccatcttgttgcaaatgacaggaactcattcttttttatggctaaatagtactccattgtgtatatgtaccacattttctttatccatttgtttgttgatagatacttaggttgcttccaaatcttggctattgtgaataatgctgcaaaaaacatgggagtgcagataacccttcgatatccaggagtgtcctaaatctaaggatgtgtcatattattttttctttatttttttctcctcctgctgttccgggtctctacagtgtcccctactcctttgttttattcgcacacctgggtagtgcctttccaatcaaaggatagttgggtctgcatttcaggtctgtgatctttatgtttagggaaatccgtttcctggtcaaagcctaccagacttccttggtatcactccagaatttaacagatttggcaagtatgttttttagttaatggtttgagatcataatcatttccttcatgctcctcctgccttctatttttgcttttaatattgaggaatgctaatggaatagatttgcttttgctctctcccatctttacctggaattgaacacatatttattgaaggaatgagtggtttgcaggaatgttgccattcaggtggagacatgtttctctttaaatatatagctggcaagttgcccatatggcacatagatattaactgaattatccactgagctctgggattaggagatacagattgtgtaggattgggagttctttctattggcttatcttttcctaaaactatgtaacgggatatgaatacctttctacctaagtatcttgtcattatactagatctagttttctgagtctcacttgtgaaagcttttggttaactattaataaaaaactgtacaa

SEQ ID NO: 67680 - DNA, 1047 bp, Homo sapiens
tatgggagctacaattcaagatgagatttgggtggggacacagccaaaccatatcatgtgtatgtataccccagttagtataacacattcatttccctgctctctctgctgagagggcctagaaatggtgacatctcagtagcagtgagcgcacccagctcctggatcttggttactaaatatcactctccaataaaatagctccttggagaaatggttgactctaaggctgcaatagggaaaatgcaagttgaacctagagtgccttatagtgccacaaacaagaaagtgcccaaacagaagggtgagagcatgtcagtggcataaacgggaagaatttgagcaagagaataaataacgtagtattggattagaactcaaagtctaaaataaacatacatgagcccatactgataaaaatgattacataaatacatgggtgagaaaacacaaatcttccttacaggaaaatttcaaatagtatacgtagattcctattcccaggagatggagcttaatcctctcagatgctagtgtggattgggcttagtgacttcttcaaagaaaaaaatatggcaagggaaaaataataactttacagggagacgtcgagcaaccactcccttaaccaaatgaccaaagttaacattactagtgttaagtcatattggtgtcatatatcctctgatgggtgatgaaaagggtacttcacccctgtggtattccaaaaatagacccacgtatatatggaaaactgattttcaaaagtgcaaaaggcaattcagtttcaacaaacggtgctggaacaattggatttcaattggatatcacactctatataaaaattattacaaaatatattgtagacctaaaagtaaaatagaaagtcactcagctcttagaagaaaatgtaggggtaaatctttgtgatttggggttaggcaaagatttcttaggtatgataccataaacatgggcagtgacctaatttccaaataaagtcccacaggtatggaagttaagacttcagcatgtctttggagataa

SEQ ID NO: 67681 - DNA, 1025 bp, Homo sapiens
catttacatttagtcttccaatgtgttggtgttgtcattaacaaaatacaaattctcctaaaaatattatgaattgtagctttgggcatttattcagtttgtggatagtataataattgctattatgtgtatccctgggttttgtttgtgtgtttgttttctactttcaacacaaatagggagagagtctctctcaccgatttcgtgccacactttgtcacttgggcattaaaataattttaccctggccctttgtcttacaaggtctgttgccaaaacaagcttcttcagcttctgctgctgtttccataaagatttgacatgagttcatggaattgatctcggggacgagtgtgtcctctcttttctgtttacctagtacccacagaaactcctgtcatttctagtccaaactcccacctggattccttactataaatgaattcatcccaaggaagaaatcaagggggagtatagaacttgggttacaaggatatttgttataacattctttattatgctgaaaaattagacccagcctaaatatttacaaaagggaacttcttaattaaatagccatatcacaggatactttgcagttatcaagaattatttagaactatgttttttaaatctttatctgatttggaagttcaatatatagaatgaataaaaaacaaagcagctctgatatgtgggaagtctagagccccatctacacactcccgctctgtgagggacctcttttaaacctctagaattttatagagcacagtttaaaaccagcactgtagtgaaatatttaatatgtaaacatatgttgatattttatgaagttaaagttgtcaatatgtccagtatgctttaatttttatgaaaataaattttaaacattgtatacagaaatctatctctattttgggaaagaatgggaatatatgcataacaatgctgggtgttgggattatgggtgatttttgtttactattttgtctttagtttttaaaagtttatacgtgtacttc

SEQ ID NO: 67682 - DNA, 1085 bp, Homo sapiens
cagagagaaccattgctttataggaaactacagtttggaaaaacggcagtctcattactcaatcccttgagagaggaattatcttgaaaatgttataaaaaatattagtaacagatttactagtgtcagtggtcttgtgtgttaagtatattaggataagccacatttgtaacagctaacggagaaaacataactgaatgtcagtgttacacagtgaactttgtagagcagtgattcccaattctgagatgttgtaagaggaatgtcagaattcctaaaacactcatcctccaacctttcaaattcagtgctgtggtgagccattgttactgataagggtatatcccacttgtgatttctttgttttgggtcaagaaaagcttttgtagaagccagtgtaaaatggcatgcatataattaatttcctcatcttttcctcataaaatcagaggtccttttatcgatggtggtttgaaagtctggggtattcagatttggcagcagaaagtgtgttttttttgtgtgtgtgtgataaactaggtggattgctaattctgattgaggaattcgtaatgtttgacaccagaaccagagcacttgtgaaaagaagtctctttagtacaaaaccaaaaatttaattacagcatttgttataactatagccaataaaagtatttttaatgaaaaagaatttccgcagaagaaaatgctttctattaatgcagaaggtgttatatagaagatttaattgtaatgatattggttatgatccgttttttgttttatctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctgg

SEQ ID NO: 67683 - DNA, 1025 bp, Homo sapiens
gcatttgattactttgctttaatttaggcatggaagtattttgaaccgagagtcaccaacagataagaagcagaaagttgagcgcattgcatcacatgattttgaccccacaggtaaaacactattcattctttcaaagagtattgagagtagtgaagttcagaataatagagcttaagctacccgaaacactcaggaatagttgtttgatctgttttaggactctcacattcctccaattatatcataataaagcctttgcatttagtaggaatgcaagcatttttaacttccaacactgtacattccactacagaagtatcattgtagagtatattgtatctttaaatagtgataataatagaaatggttatataataattggagatttggtcagatcaagaactcagtgttaagttgaatcatggtataagcagtaatatgtcataaaaccaaggctctaacaactcgacacttgcgtagtcatctaaaaattcaattgtgattatggtgaattggagttttagataaatcagtttcacaaattaatgatggtctcattttagagtaaacaaatgaatagaaatccctttctcttcagtcaaaaagtattctgaacttaaagagctgtctttcaacctaagcagtgtcgatctttcctagggttgtcaccttaacagactttcagattgatctccttttaaaacatctaggctttttccttttgctttctccttgtaagcttactccatatttgattcatagaaagtgcttggtaatcttgcttttttcatttgaaactgatatatattttttgtgcacatactattttattcagttgcctgtccctttgacaagagacgaagtaaatcccgctatctcagatacataaaaataatgtatctatttttaggtatttttacttagaaatataattttaaatatttaatagagaatagtatgttttatttatctaagacatttcatactttattagtataaactcctttattttgaaaaaatat

SEQ ID NO: 67684 - DNA, 1052 bp, Homo sapiens
tggtttcaaccccactgccttgtccatcattttattagactattataatagattcgtaacttacttttatttcagtttcacattgattcattaacttttctccattctatattctgccttgacttgtcagattaatattactaaagtaagaatttggtcattcacttgctaagaaagtacaggtagttattaagataatgccacaatttgtttccaatttattctactctgattctccttcagcgtttcattttccaaaacatgttttggcattcttcctttgcacatgccatttctgttgtcttgagtgaattaccacctataacttagaatcctactcatctttcaaggcttaattcaagtactgccttttcctaggattgcccagctacttttgttgtttctgaatgttgacatctgttttgtatttaattacttatatttatgtttatctttacatctcccataatgctgaacatattggagacactcattaagtgagttttgaatgaatgattgttgagattgacataggaagtattttagtagagaaaattgatggaataagatcttcactcatcctaattgaatctttctttccttctgaaaaacttgaagatagaagaaaatgtaacttggagacatttttctggtagtggtctgaaagaatgaaatcagcatacttggaatttaaggctcttcttgctggcaagactgtgcatttagaatcaagaagcttcttaatcaaaggattatctgaggtcttactcataaaacatgtatgtctggcaccagtttaaaatgagctgtttttatgaggttgcacatggcccttctccactcccttccctgaagctgattcttaagagctgaaacctagagaagtttggtcatgaaataaaataaaaggtgaagaaagactaatgtgctttcactaaagtcaatgtaatatggaagatttaacaggttatcttacatgtttaacactccattttcattaatatgccccacaccctattttcattataggagttatggccttctttcaggaa

SEQ ID NO: 67685 - DNA, 1033 bp, Homo sapiens
catctcagccttccaaatgcgcccagccagaattgattctcttaaggatcatttgcattaattgataggagtttattaacataaaagtacttacaattgtactagtagcatggatagaggagaaaatccaaggtcaacctccccttaatcataataaaataatatttaacgtgtaggaacccttaatatttgttagacattaagctaactactttatatatttttttattcaagtgagaggtgcaaacatagcaaactccttgactccaaatacccgtttccctcatgttttacaggtgtcctgttctctgcaggcatctgaaaaaaggtctatttaagaagcccaggttgcttagcactgcagtcacccatattagaaacctttaattcattaattttcagcttttgtgaggtgaggtgggagaatggagaagcacgaatatagtatgaaaaaacgtattcagtgttataattgccttgatttctaaagtcacagtatctaatttattttgaaatttcaaataactataagggaggttgtgaaatatttgtttccaaaagcaagcatggattttaaaaggttcctgtaaaatgctgcttagtctaataattttttttttttttttttttgagatggagtctctcactctgtcacccaggctaggctggagtgcagtggtgcagtctcggctcactgcaacctccagctcccagattcaagcagttctcctgcctcagcctcccaagtagctgagattacaggtacctaccaccatgccaggctgattttgttttatcatgttggtcaggctggtctcactcctgacttcattcaggtgatccacctgtctcagcctaccaaagtgctgagattacaggcatgagccaccatgcctggccagaatctctgattctatttattatatgctagaatttataaagaatgctttttttaaacttgatttatatattcatatcctattttataggtgtcctaattacttgaaggaagtaacactgaacagataacaaa

SEQ ID NO: 67686 - DNA, 1045 bp, Homo sapiens
ttgatgacttggtaattaaaagcaaagagatcttttctatttgtatgagcccttcaccgtgaacgatttgtaaatctgtttcatgttatgttttgtcatttgtcatggtgaataagttgtactgttttgtatgtcaaggcctcggtttatgtttaagttcattttgttgctgaatatgccctgtagaatcatggtgtgaaaatgaatattgaatcaaatacataaatattttaatgtaatgtgattactatattatattggttatattatgtatgataattcttgaagtcattttatccattgtctcaatagaatgtatctgacatacactactttcgttttcttacaggtgaatggaactctggtgactcattcaaatcatctggaggtggtgaagctaatcaaatgtaggtgaatgttattcttagttttaattgttttctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatggaactttaaaaatcatctagcacaatcactttccctcagataagtaaatgattatataatccagagtagcgatcttctcttggaaatctttagggttaagaatttgtgatcttcaggtttgagtgaatagcccacttggacttagttctctgtggagaaacaggcttgaagcagtgggagtctgca

SEQ ID NO: 67687 - DNA, 1061 bp, Homo sapiens
gcaaaagagtacatgattatcctaggattataggaagactaatttggtaaaatattatagggttgtgaaacaaggagggatgatgggtgatgaattagggagctgtcttcatatttcaggtaagaggtactgggagtttgagctatgcatggggatcgatagtaaagatccaaatgagggaaagtaaaagatactattcttatactaagacaacttcatttctccaatatcaatatttagtgttctcttgaatccagtttagtaaaaatgaaatagaagggcagacatttccttgtagtttcttgtaagtgtcatgtctgaaagcctgtccacataacccggaagtaaaaacctaataggtattgataattggagccgaggcagaactttgtatgccacattttctctatttattttagcttcattttgtctatactggttgttgtttgttttttatctttttcttttctaggaggaaaacaatgtggttcataaccagaaagtagaaattctgagaaaaatgttacagaaagaacaggaacggctacaggtattaaatgagaagtagggctgtttacaggccaataaaaatgtgagtgggcatggttgagttggtgtttatcagtcacaatcaagcagcattgtaaccaatgccattagttatattattgattaagaatggactatttctgtatcttttttacataagtaattaattctgaaaatatttttataacttttcagttattgcaggaagattacaaccgaacacctgcccaaagattgctaaaagagatccaagaggccaagaaacacattcctcagctgcaagagcagttatccaaagccacaggctctgctcaggtagcatcactattacaagtgctacccaactttttgcaggagaattttcttctgggaatgtgtcagagaatgttgcagttgccttttttaaagttatttttctagcgtaggacaacaggatgtcctgttaaggatgttacagaagtaatgattaacaaaaataaatgtgggcgtctgattgtttgcttgctcatgag

SEQ ID NO: 67688 - DNA, 1040 bp, Homo sapiens
aaaaaaactcgttgttgtggtctttttctctgccagagtggtacatggccttgaaaatttgtgaacccctactttgaaaataaagtacttcaaaggaaataaacaaaaagaaatctcaccatttaagtgaaccatgtctttttgatgggttggctttattctttttctaaatttgaccaccaggtaatttttctgtttcttttccctgaatgttgccaggacactcaatcacttgtcggaagtccctcaacccgtatagcacctcatattattggagcagaagatgatgattttggtactgaacatgaacaggtgatgacttttttctttctaaaaaatagattgttactttctgcaatatctgatttgttgcaaaaatgagcacgttctggagattaagataacatttgtaaggatttgaagctaaatcttagaaccaatagctccttgggttaattgcttattttagctttgaccaacagaaatgaccttgcttttaaagccagtgagagatcattaatatatgtttaagtacttcattttattggggttgagtgtgtttcttaaaatagtatttttaaaaaaaatttcaaatcccagttcattggtgctataaaggaatatgattagctagattcttgtccttgtatcctgtgatcttgctaaattcacttattatttcttggtgcttttaaaaataagtcttttggagttttctacatagataaatatgttgtctatagtttttatttccttattttcaagctgtttatcttttatttcttgttcttgcctttattgcactggctaggacttccactatgaggttgaatcagagtgacaagacatgcttgccttattcctgctattagggagaaaacactcagtctttcatcattaagtatgatgttagctataagtattttttagaggctctttataaggttaagggttattaggttaaggaatactcctggtttgctgagagtttttatcatcactggatgttgaattttgtggaatgagattattatgtggtt

SEQ ID NO: 67689 - DNA, 1032 bp, Homo sapiens
agctcacatttatttcatatatacaccatcatacagaaatgagcttttattacttttttgcacttgagctagaaatgcttttaagaaagttgatttgagctactgcctgtcaaagagaaagttttaaaatccattttacttttcttcaaatgaatataaagagatcttacaatttttagcggtgacttattttcaaatttaaaacttcagatcttataggatgtgtttaaattctgaaattgtatgacttaaataggtatacaatacaaaataagcaggaagaggttaagatattttctcttaatgcaaaataataaagtattcccctccattagtttgggggtgggggaaaacaacagactggtaattattatgcaaatattatggggaaaatcctagctaggaataagtaaattctaagatagtcaccttatttggttcagtagcaagaactgtagatggttgctggagatttaaaactccaaaaactcaacattgacattcaatattttctcactgggagtgtgacattgtgagggctcttaaactttacataggaaaacgattaggaatattattggtcttcagaatgagcatctcaaatataggaaagaaaaatcatggctatatgtgagtacatttttcatatgataatatacacataatttaggttttacctatattgatctaaatgacatataactgattatattgaccaatgattctaggaagccaaagccaaagccagtatattcattaagtgtgtcacagaagcattcagtcatctagctaaacgactgtagacttttcctttatagcatgatcctcgggaaaagggctcattttcaagtttaaacgatagaatgttctggagttgtgaaatgtgaatgaataaatgagcttgtacttgattgtgcttgtagagtgggtatccaagttgtatccccttactttacagaagtacttatgtacatcttcaaatatctttagcgttgttacaccttttgtttgcatttcattttagcacctgaa

SEQ ID NO: 67690 - DNA, 2211 bp, Homo sapiens
tagaagattttcggtaagcttagtggtagatagaatttcatatgattattctaaattaatttttttagttaagaaaaagttgctcattaaatacttagcttagcactagataaaccatatggtcttattgttattaaaacataatgaacatctggagccaaagggttagagtggaactgagagtccagactctccattccaggcacttgcaggatctgagctcagtgctgtgtctatgctaagtgtgttcctttaagatattgtatgtgttcttggagtcattgcttctagaattttttcctctggtatcctagatgacatggacccataagtggaaaagtgacatttttcctgttcctagaaaccatagctgtgaagactgtgatgaagcgtccccagaatgaggtagtttttctttaggctacctcaggaaacttctctattcccttcaggcagaaacgtagtatgggactgaccttggctgaaagcgagctgactaaacttgatgcagagcgagacaaggaccgattgactttggagaaggagcggacatgtgcagaacagattgttgccaaaattgaagaagtattgtaagtaatagaagtatatgtggaaatgccctctctgctgagatactagttatgcttgaagtgtcctttgggtaggtttagaaaaactgtcagattgtgtatgtggagccgtttattttgtcatagtacttgagaaactggattttttttttcttttttctgatacttttagataaatttcttgtgttcctttttctgggtggtggtaaatgggtaactctaaaacttctaatcagtgatcaaaaacaggttgattactttcattattttcaatttataggccttggaaatatttcttgccatgaagcatatacagttggtgacatgagggtgaaacagataaggttctttaggggatcagggttcttttggtattttattctagggtgtggcccaaagcatttggctctgttctgttatttcaggtatctgagttaataacaatttttaaggccaggcatggtggcgcactcctgtaatcccagcactttgggaggccgagcgggcggattacgtaaggccaagagttcgagaccaagctggccaacatggtgaaaccccatctctactaaaaaccccaaaattagccaggcatggtggcactcctgtaatcccagctactcagaaggctgaggcacgagaatcacttgcgcccaggaggcggaggttgcagtgagccaggatcatgccattgcactccagcctgggtggcagagtgagactctgtctcaaaaaaattaattaaacttccatatttcatttttaaatttttttttcttttttttaaggatgactgctcaggctgtagaggaagataagaggtaacataactgttttttttcccctagaattttaagaaaaaaagaactatgtttttttcctttcagtcctaaattacaatttatttcttttaacttacaaatacagtttgtggtctctctctggtggcttgtatgttatttgactaatattctactgttgtcctgagtagaattctcttctctgtgcaatgactagttagttctttagtgtttgtttgatttatttcaataattccaaccttggggttttggaaatcatttgatgtctttattctaccaaccctcccttctcagaagtcttaatttacttcgtcctttctcctccagctccaccatgcagtatgttattctcatgtatatgaagcatttgggagtaaaagtgaaagagcctcgaaatttggagcacaaacggggtcggattggatttcttcccaaaatcaaggtaagaatgaaataatgtaatagcatgttcaggccttagggcttctttacatttggttgcagtgtcttccatcatcttagtatttacttaatcagcaaattaatgctagtcatacaaacatttataagatactgtctctgttctcaagaaactcaaaatacagtgagaaatccagacatataaactattattagacaatgtgaaaagtgaaattagcagtttacaaagagtgctatttctgattctgttcatgccttatactttccttttactttgcctaaactaaataccccctgtgttgctacataatcgtcatgaacatctttagtggcagtagagtattctgtcagtttgtaat

SEQ ID NO: 67691 - DNA, 1108 bp, Homo sapiens
tgtattttcaactgttagcaaaatgcttagtaaatatttgttgaatggatgaatgaattgtttagaataagttcctggtaaatgtgctataaaactaccctttgattttccaaagctgtcagtgataaagagtttgaagaaaacatcttgagtttgaggtgtacacggtactgtgtgcgaacttttaattagtgctctgtgtgcatacacacgtgtacgggttttcatttacacttaacaatttctttgaactaaccattagcattacactatgaaaatcgcaaaagaaatttactctgttacgtatctcttattttttgtacttcaactctagcaaagtatgaagaaagataaagaaggggaagaaaaagggaagcgaagaggattccccagcatcctgggacccccacggagaccaagccgtcatgacaacagtgcaagtatgttgaagtttgaagtgctgcattttcagtactccaggccctcttcacatcagaggcttcttcagctagaatgaatttctggagaaaggagttgttaggatgattttactgaattcccaatatgccttgtttccattcagcgttatttctgaactaagtaccccctatgttgctacataattgtcataaacatctttcgtgggctgggcgtggtgattcacgcctgtaatcccagcagtttgggaggctgaggcaggcggatcacaagttcaggagatcgagaccatcctggctaacacaatgaagcctgtctctactaaaaataccaacaattagccaggcgtggtggcatgcgcctgtagtcccagctactcgggaggctgaggtaggagaattgcttgaacctgggaggcagaggttgtagtgagccgagattgcaccactgcactcaagcctgggtgacactggagcgagactctgcctcaataaaacaaaaagaaaagaaaaaaaaaaaacgaaaacacacatctttagtggcagtattctgtcaaatgtccgtaacatagtttacttacctcttctgattctgtttccattcaacttgtgtttgttaaattaaaaaaaaaaagtgtgtatagatctctccaccacactgaacgtctctt

SEQ ID NO: 67692 - DNA, 1032 bp, Homo sapiens
attttgttttcatgttactctttactttccattgttttagggtgactgaacatgggacaccaaagccctttcgaaagtaagtaaatcttaagcagctttcaataaaggcgcattttaagaaacgtaaccttttttcctctaaagtttcattttaaaggaaaagaaaccctgtataccaatctgttatgtagtataaaagaaagctcttaagaaacactggtcattcaaaagctgtattttgaagtatgtataaaacagccatttgtaggagaggatgaaatttcagtgctaagtcagattcaggaatctgattagaatttattgtaatataaagatttgtgctgtttctcattgtccacctaaagtcttcaaattgaattcactcttttttcttcataggtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatggtgagtgtaatcaatttgttgttgttgtttacaaatactgagttttgtcagagtgaattaagtctctcagccttggagtttgcttcaaagtttctcctagccttttgttttaaacaaagaggaaattaaactggacagataatccttgaactcaagaaaatgcaaatgtttctctgattcttattgataatttaaaaggaaaatgtgttaagccttaaagatatttaagattcatagcattatagatcttaaagttgaaaagtcattgcaacaactaagttatttttatgcatagattttaaatgaggaaggtaaagcccagggagattgaattcgttaagatcatacagctaataacgtgtaaggaaaaaaattcagttcctggtctttctgtatcgaagtgcagtgttctttatttaccctagcatgtatgtgataaatgtgtggcatgggtgctgtaccctttactatccttagc

SEQ ID NO: 67693 - DNA, 1039 bp, Homo sapiens
ttccatttatattatttacaaagtaaatgagacctgcccttctggagtgtatagtatagtggtcctggtacttcacgtaaagcatctcttcttggatttcgggttctgtactgtgatttctttttaaagattagaatttatgttttaaagtcctgttataagaagttttacctgtccaaagactgcttgaattgagactctgacagaggctttaagctggtacaaaaatcttcaaggtcttaatatgctcttaaaagtattgaaatgaaatgaaatctcatttacatatattttatggttttttgctcagttcttttacattttggatttctttcccatatttagaatggccaacagaaagggagaaggtgaagaaagctgcagatcactgtcgtcagatcttaaattatgtaaatcaggctgtcaaggaggcagaaaacaagcaggtaaaaaaggaaaacaagaaggtacaggatgacattgggagaacattaaattaatattacctggaatctgtgaaatagttgttaaaactatcattacctaatggacagggagaacatttgtttactgttcgcatagtaggcaggtcaagatcaatctgtgatagaatatcggagttgtatttgactttttgaaacacctcaagctgcttgtttgctctttcatttatctcttcattcagcagatatttatagaacatctactgtatgctgggcatagggtacagagtagttgagaaaatgagtgcaatatctgcccacactgagcttgtttgctaggaggatagaaaggcatttaacaggattatagtgcaaatattttgtatcagttgtgatagctactatcaaggataatttcaagatgctacgatatataactatggggcctagcttagtttggggatgttaggtggtgcctattagagaaaattttcttgaggaattgacacttgagccaagctctgaaggatgagtggaagtgaaccaaaatgatgtgaagggtgcaaccctagaggtagaggcaatatataccaaag

SEQ ID NO: 67694 - DNA, 1065 bp, Homo sapiens
ggactgtttggtaactttccagatcatttaataacacaagatagcatactattttctcatgaggctcttcagaagcataaaagttggaaccattacaggaacgatagtaaaatgtttactaattgccacttctagtatgtgggcttatgtgttaactttttcggattttaagtgtttttgtaccatttcactaggtggtggttttggcagatttatttggtggctgttaaaatagacttttatgtcatatattaatacttcgtcaacaagcacgtaaatgtgcttattccccttagcttccaaagaatgagagttttctagagctgctaatactaaaagatgattctcttactaataagttgttaatatttagaccaagtctgagtagtacctggacttttcatgagtactatttcttagaactttctttgaaattagagccttggaactcagaagccactttcttatagacaagcatatgtaccatgctcatccagttattcataggaaaattaaaggatacgttgagaatctagtgactgaatgtttgtaacttgatcttcataatctgttatcatctgtttagagtgaggtttgaagatagtactcctgaatgttcttctgcaagataccttttcctttttagaaaattgtatgcagattactttaatatggcttttgtgccattttcaagaactgacaaatagcaataatgatagttgaatgtaaatggtgtattttatattaagaatttctttaaaagagactgtattatatagataatcatgttactgagtgcttggaaattatttgtgcatgattttctttattttgccagaatttggatttaacaaaaaggaagatgattcatgaagggccattggtttggaaggtgaatagagataaaactattggtaggtctgatattgtcttttagttttggggagagtggcaaaagggaaggaataggaaagtttcctatgacaaagggaagaggagagaaccattctctcagcagtttgcagtgctacctcgtgttatttgtacatttgtagatctgcttgt

SEQ ID NO: 67695 - DNA, 1019 bp, Homo sapiens
attaagttgagtacagtgttggttcgacaagtggcaacaggcaagtatgtccactgaaggatactaatttccagattcattgtgaagttgcataagatactcggtgctgtctcaataacacaagtggcatagagtcttgctatttttatattcttaagcaaattacatgaaatttactgcttagaaagagacctaagagtttataccccaaagttattagggtgtctcgattctgtgaacagttttctgcatttgaaaatttttatgctattactttggttctttatgttcaaatcattgatagatcccaatgaaaagcctttcatttagggtggtatgttttttgatttggtgagaaaaaaatcaaaaaccaaagagacggatgtagtgttgattaaaaatcaaatttgactggcaagttatattttaactctattaacaacggggtcccttttaaaacttgttagtttcatggtggcaaaataaatttgtgacctcttttctccactactcactgaatattattaactaacaacttagcaaaagtgcagttcaaaataaatgcaaaagagtaatagcatttaatctggtaatttggatttatttattttttttcttttgagacgagggtcccaccctgtcacccaggctggagtgcagtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataa

SEQ ID NO: 67696 - DNA, 2366 bp, Homo sapiens
tccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatggctgcatcagtgaaggagcaatccacaaagccaattccattaccacagtcaacacctggcgagtgagtgttcctttgcattgtagtaggacttattttatgttttgggttggaaaagactaggataattattatgttttgttgcgatgatgtttagatacctcaggaaggtaaaagtttttttttttttttttttctctacagaggagataatgatgaagaagatccttcaaaattaaaagaggagcagcatggcatttcagtcactggtttgcagagtccaggtacactcttctgaagagttcaatggagaatgtgctctattatctgttaaaatgctggccggatgtggtggctcatgcctgtaatcccagtgctttgggaggtcgagataggcgtatcacctgaggccaggagttagaggccaacctgaccaacatgacaaaaccctgtctctactaaaaaatacaaaaattagccgggcatggtggtaggtgcctgtaatcccagctacttgggaggctgaggcagggagaattgcttgaacccaggaggcggaggttacggtgagccgagatcgtgccattgcactccagcctgggcaacaagaccgaaacaccaaaaaaaaaaaagaaaaaaagaaaaaaaagaaaataaaataaaatgcaaagaaactttaatactgtttggtttatgcaggttccagcatcagagattcagtttaacaaactttgcctttgagccttctgtgtgtcagtataacactgttctaagtgatgtgtatttttcttaacagatgatctctgtagtttatggattgttttttttttttctgattcttccctgaatgcttcatgttaaaagttaaaagctttgtttagatatagtctaccttttctattccattggacagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaattgtaagttttattcataacttattacagatacttactaagtatgacactcatgtgccatccctaaagtatgtggatttatcaaactccacttattcttctagttctattgtggagattatagtattctctacagtggcccatgccacaggcacacacacacatgccactctgttagctccccacccccctgcctggttcagaatcactgttaaaatgggaggatagcatatctctcagttgtattgaggtgggaaaaaggctgagaacaatttctttggctggggagaaccacttgaaatttttaaaccagcgtatgactaaaggtatgaaaaaagattaatctggctgaaagcggtggaaggatttgaatggaaagaggtatggaatggtgtacttactaaataagctattataatagtctggcctgagactaaaagagtttggactagaatgttatcagaaggaataagaagaaactgagaagtcatcaaatgcttaaaataattgacttctttgaatgtgaggtcaaaggaaagggaatatttagagataatttcattaatctagtcagaaataagagtcagaaaaggactaccactgcttcccccacctccttccattgtactttcttttttctttcttttgatttggtagaattataggctcagttttaaagcatgtcaagattaagataatgaatgacaaaacactaaaaagtgagtaactagcaggaagttagagttttaggagtgaaactttagagagaggttaggaagagatagagatgtgagcatcagagccatgagacttcctggcatctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaat

SEQ ID NO: 67697 - DNA, 1069 bp, Homo sapiens
ttctaaatagtagtatctccctattcagaatgcttagatcttttcaagtttagtttaacgttaaatcttctctaaaagatggtgctttatttcatcttcaaaacaaaatggaaaatgattgtatgaagtaagatgattgtatgaaattaataattaacattttaatatgtcattaaaagatactttttaaagatagatcattggtaagtcagctaatttaattcttgcagcctgaggttatagttgtgaatatgttttttttccccctccttcctaaatcgtttagtgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggcaagtatctttcacacttaaactttgattttgattttgatcattgttaactgtcctgtattttgaaatggatgttgtattggtatccaggtgtgtgtgtgtgtgtgtgttcacacatgtgcaatatttattccttcatttgataaatactgaatctactctgtaccagacctcatcataggtgctgggagatatagcagtgaataaaacacagaaaaatcccatcttctcatgaagctaggggaaagaaggatggtaaataagtaaacaaataaatagacttcaggaagtattaggaagaaacataagtca

SEQ ID NO: 67698 - DNA, 1035 bp, Homo sapiens
aaacatttagcagaggggaagaatagggtgatgaaaatgctgatgtcaataaacttgttcaggttctagatttctttgactattatccatgaataggcctgggtaaaaagttgagattggcattgtttatctttttctttctttctttttttttttttttttgagacggagtctcgctctgtcaaccaggctagagtgcagtggcgtgatctcagctcactgcaagctctgccttccaggttcacaccattctcctgcctcagcctcccaagcagctgggactacaggcacccgcccccacgcccagctaattttttgtatttttaatagagacggggtttcaccatgttagccaggatggtctcgatctcctgacctcgtgatccgcctgcctcggcctcccaaagtactgggattacaggcgtgagccaccgcgcccagtcggcattgtttatcttttgactatcacaagagcagaaaaagttgcagctctgtgaactgtgtgtttgtatgggtgtctaagtttaagaacctgaaatgcttcgggtagttggctggcctctgtcagacatgaacaagaagatgagataggtagggtttatgtagttatgaatctaggctgagaaatgctatgactttctgtagcctattatctgtgactcattaggtgacattggcagcttcccaaatcctatgacagatagaaattggcttcagtggctcctgtaatctaaaaacatggtcatgcatgggatttttgtagattggtaattgaagatgtcactattgcaaaactgacttgtgtggcaatttccaagagaaagacctatcttaaagttttccatcagaggcagggcacggtggctcacgcctgtaattccagcactttgggaggcaaggcaggcggatcacgaggtcaggagatcgagaccatccttgctaacacggtgaaaccccgtctctactaaaaataaaaaaaatcagccaggtgtggtggtgggcgcctgtagtcccagctactcaggaggctgaggc

SEQ ID NO: 67699 - DNA, 3610 bp, Homo sapiens
tttgaaatttgggggcttgtacctgtaatgtaaaaagggcttcttttctgttttctgaagtttttgttttgttttgtttcattacgtttgaataaaaaacctatgggttttatttcacagaaggtggaggaaagttacaccattctttgccaaaggctggctggatcagccctcacagacaagcactcaggtatgtaaaagttatgagttccagactctagactaatcatcctacactgaatgaaatgacttatcatactttgaagtgaaaaccttctgagattccatttctcttctgtctttaaagaactgcctgtttctaaacatcagatatcaagcggaagctcatgcctgctgactctactcttctctaagaggaactgcagttgtcagttcccataccatcccctcttctctctcttttcaccttttcaaagcagaaggcagagcagtgggaagcctggtaaatcacagattcggtgtgaggcttactggtactgctgtgactccctagtgtggaggatttggccttattggatgttggtgcacttgcctctgctgacagtgtggctggtgtctcccctgactgcagatggatttgtgttccctgcagcagtttatactcatctgcttacatactgattcagaaacaaagattgaaccacgcccacagatgtcatgggtattctttgcaatgttagtatattctttttcttaatatcatttccatgtatctttattcttctcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactg

SEQ ID NO: 67700 - DNA, 1261 bp, Homo sapiens
ttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcct

SEQ ID NO: 67701 - DNA, 1054 bp, Homo sapiens
acatgcctgtaatccaagctatttgggaggctgaggcaggagaatcacttgaacctggaaggcggaggttgcagtgagccagaggttgcagtgagccaagattgcaccattgcactccagcctgtgcagcaagagtgaaacaccatctcaaaaaaaagaaaaaaaaagttcgtttttaaagtgcttatcacagtcaggttataaatggctaaagggcggtcacttgacagtgtccaagaggaaacctggaatgatgttaatagaaatagtggttgaacactttaggcagaagaaacattttctcatttaaacctcaacaactcacattttacaagtggggaaactcagtgaggttgcagaagttgcccaaagtcacacagccagcccgtggcagagggtctgaccagagccagcacccagtcctggggaacctggaggatgcaaaggcaggtggggttgccctgatcccgcctcggcttgccggggctttggcttctggagctgcgtcatctttgtggctctgcccctgctggggtcctgccaggcctcagctttcatggaatgtggagagcagcctcagctccctgcggccccagggtggagatgcttccagagtgggaggaagcaggggcgggagctggacagcatctgtctgcagggtctgctgggtggggaccccggagcagatggtgtttcactcagttaaaacccctcagggcagacccctgccggtgagagagggagcatggcaatgcttatcccagcagaggaggggagcagggagccgctgcaagttccctcctgccttcctggagcccgtgctggggatttatctcctcccagaggcctaactgcgccccagacactcgcacctgcatcctccaggggcgggctgggggctgggaggaagacgggcattcaggtgcttttgttacctttgtgatgtggctgagccagacagcctcgctcacactaagccacccctggcgtgtggccttgtctggtgagagagaggtggcattgtgcttgcatttatatgcagctggcagagcag

SEQ ID NO: 67702 - DNA, 1032 bp, Homo sapiens
ctgttttcatgctgctgataaagacatatcagagactgggtaacttatacaggaaaaaggggttaatgaagttacagttccacgtggctggggaggcctcacaatcatggcggaaggcaaagaggagcaagtcacatcttacatgaatggcagcaggcaaagagagagcttgtgcagggaaactgcccctcataaaaccatcagatcttgtgagacccatgagatctctcatgagatgctagcatgagaacaacacgggaaagacctgcctccatgattcaatgacctcccaccagtttcctcccacgacacatgggaactgtgggagttgcaattcaagatgagatttgggtgggggcacagccaaaccacatcaccatctattgagcatgtgcccatctacagcactttagtttcccagggtagctttggctccctgcctcaggacctttgcacatgctgttcactctgcctgcaactcctccttccacctcctctccttctcttgcttcactactccttatccattcctcttccaggaagccctttcctgacgcctccctgagcctgcataaccccccaccccgaccctcatgtgctcttgcagccccaaccctcgttccctttggagcactcccaccttgcattgtaacctacaacttacattgtagcactgagctgtgggaggccaggcatcaagtcaccacatccacttctgtgccacactttaacacagtgtctggcttacaggaggatcttgccaaatatttgttgaaagaagcaaagcgatcgagcaccaaagagaggagcaagcccagccgctgtgcccatcgacattagagggattgcccttggctgtgacctcctccaccttagtctgagcccctagcagttactacagggacgagcctagagcccagcctgggcaccagtgaccacatctgttttgcacagcgctgggttcctgacatctgcacagagatgcagcctaatagtgtctcttagatgtccttggatagtcacacatgtaag

SEQ ID NO: 67703 - DNA, 1031 bp, Homo sapiens
gagagggtattgtttagacgttttgtgtaaattaataatattgtaactgttaattgaatgtccattgattgcctgtcagaggtttgatttaatctgtcctcctccctctgagccggctggctgcttaaatagtttgctcgctttgccttgtttttcttgctctagtgtggactctttcccctaccccgcaaaccttggtttcatttcgctggcttcataattagcatcttctgctttctggcactggccttggccttcttgcagttactagtccctcccaagtggattcctgtgattcatccctcaaccagagttttctgaagtatctggagactcgggacaaagacagtcggcctgtctttgtcccctttcttttggggttttagatgctttgggcttctccttggaagggagtgggaagggcagtgcctggagacttaggggatgagcccggtagggctgctggcttcattcactcattcatccgtctattcaccaggccctgtgttcagcactaaggggacacattcctgagttcagtacttagtggtggagacagagaagtaaacagatgatgcaatgcggtgtgatgtgccaaggtggaggccaatgtaggggggcgcagagacatggaagaaaacggtaaaatcagatgtggcagcatggaaggcttcctggaggaggagtaacctgcactgcagttggaactgcatttcaataaacaaggaggaattagtctggcaaaggaaaggacaagagcctcctagcagagggaaaagcacatgtcacagctgggtcagaggggacttctagagtgagagatggcagagaataaggtaagggttaataatatctacagaatgataatatactgcacactcactaagcattgggcagagttctgagggctttccttgtattatctagcttagtccttataacaaccctgcatacaggtactgctagcgccccttttaatagctgagcctagagatatgggcacaggcagtctgattcaggggtgctggctc

SEQ ID NO: 67704 - DNA, 1047 bp, Homo sapiens
tcctgggaccagagggaagagggaaggggggtgcagatctttgcagggagggttggggagggcttgggggccttggtggtctcaaggaaggaagaggggagtgtgaagggggaggtaagagggagggagggaaggagggaagaaggagtttggaaaagcctgtaaaaggagggggtagggagcaggccgggacccccacccaggatcctggagcagtgctgagggcagggaggtgacactgtccaggcaccacacttgtggaacagcctagaagtgggcatgtaggagggaaggagctggctaggcagggtgtgtagggcaaggtcactaaaggacaaaggagcaggacagctcgggatcccggttctacatcccccacctcacaggactgtagcgaggattaaatgagttaaaatgcatgaaacacttactacctgagcacgggcagtgggctagcacattagtattagtatagcagcaactgagtgaacgttgcattttttatgtgtgtatctgtgcacatttgcattgctgcacctattcctaccttgctcccatgtaacatgcagtccttaagatatgaaagtgacactgtgcctgccttcagtcagtaggcatcactgtaccttttccagggtaggtatacacgtgcatgaatacagtcccaacacgcttcactggttcctcctggccatctcgctgcatgtatctcatgctgggctcaagccaggggtggaaaaagacgagaaggtagacacaggtgaactctcatgtcaggcttaggggagcagtggaagattataaagccatccttgaagtattgtgtgtagcactaagaaggtgagaggtgccaaaaatcaagtcaggcagatgttttcacaaagaacagaaaggtagattaaaaagtattctaaagcaataagtgttaggctattttcctgcaacaattcgaaagagtgtatgaagcagatggtcctgcagctctgagaacacaaaagaggagctcgcggggctggcagcagttcctgaaggacaagttgggcccaa

SEQ ID NO: 67705 - DNA, 1064 bp, Homo sapiens
cctgggtgtggtggctcaagcctgtaatcccagcacttttctgaggcaggtggatcacctgagggtcaggagttcgagaccagcctgaccaacatggcgaaaccctgtctctactaaaaatacaaaaaaattagccggggatggtggtgtgtgcctgtaatccagctactcgggaggctgaggcaggagaattacttgaacccgggaggcggatgttgcagtgagctgagatcacgccactgcactccagcctaggtgacagagtgagactccatctcaaaagaaaagagaatgtatgttcctcaaaaaattaaaaatagaactaccatacaagccagtaatcccacttctgggtatttatccaaagggattgaaatcaggatcttgaagagatatctacattcccatgtgcattgcagcactagtcacaatagccaagagagtgttcctcttggaagaatggaatccagaatatgtggtccacacatacagtgaatattattcagccttaataaagaagaagatcctacctttgcaaaaacgtggatgaacctggaggacagtgtgctaagtgaaataagccaggtacagaaagacaaatattgtatgatctcacttacatgtggaatctaaaatagctcacagaagcagagggtagaatgatggttgtcaggggctggtggggaggggaaatgagttgttggtcagagggcacaaagcttcagctatgcaaggcgagtcagttctggcgagctgcgctgcatagtgcccatagctaacaatactgtgttctatacttagaatttgcagagaggatggatctgatagtaagcgttcttaccatagacatatgaaaatagttataaagagggtgagagaaactgtgggagctgatggatgtgtctgtggccttggtggtgatagtagtttcaccagtgtatacttgtccccaaactcatcaagttgtatacattaaatatgtatggtcttttacatgtcaatcataccttaacaaagtggttaaataatactatttttatacttttttttttgagatggagtct

SEQ ID NO: 67706 - DNA, 1085 bp, Homo sapiens
cctcgccttgtcacccttacctgggttctggcctccctcctgacagcgggcagctgcttgcctccctttcttggtgtgagttaacatccctcctgagctgacccgtccagtctcctcctgcccacagaaggcaccgacctctgactcctgctgcaaacctggcctgactgaggcttctgttaccctgactcacagcaggcagcttgtccttggagcctgcttgatggcagcattcagggacccagggctgactgtctttctcttgtggctccattagtgcactggaggaccggatagaattcagaaggagcccctcccttgcctctcctgtcccccccgaggactctcgtgttcagcacaccatcccttccctctgcctgcagtctttctgctgcacgctctaggtccgctgccttgggggaagaaaacggtacctcctgccatccagtctcctcacaggctgtgcctgccctggctgctgctgtcctgtccaccgcagcctcttctcttgaccacttgtttgcagtttcccagcctctcctgctgtctgggtgatgggagtactcagccaagacaatctgaattaattttgcaagtaaaatttcatcagacgacctatctagcgcttccctaaatcaagacgtattacatctcatgtgtgccctgagcccattcatcatgttaagtcagcccctgaaataccagccaggctcaggctgaaaatgagcagcattctcgtctgaatctggaaggggtcttctttatccccagatttgccacgagagaggcttctgtcagctcttttgctggtgataacatcaagaagtaatcgggccgggcgcggtggctcacgcctgtaatcccagcactttgggaggccgaggcaggcggatcacgaggtcaggagatcgagaccagcttggctaacacggtgaaactccgtctctactaaaaatacaaaaaaaattagctgggcgcggtggcgggcgcctgtagtcccagctactcgggaggctgaggcaggagaatggcgtgaaccagggaggcggagcttgcagtgagccgagattgggccactgcagtcc

SEQ ID NO: 67707 - DNA, 1035 bp, Homo sapiens
ggagaaagttgagtccctagcagtgacattcctgtactccttgtgttggtgtggcattgttttgaatatatgcccagttttccaagcagatttttttttttgagacagtctcactctattgcccaggctggagtgcagtgttgcgatcttggatcactgcaacctccacctccgggttcaagggattctcatgcctcagcctcccaagtagctgggattgtaggtgtgtgccaccacgcccggctaatttttttggtatttttagtagagatggtgtttcaccatgttggccaggctggtctcaaactcccgacctcaggtgatccacctgccttggcctcccaaagtgctaggattacaggagtgagccactgtgcctggcctccaagcagattttaaggtcatgatagacaggggacctagccccgcatttgttatgctggccacacagcagtgctctgggtgtagcagggagcctacacagtgtccccgttgaattcatcaatgagtctccttcacagtgatatacggaagtaaactgaatatagtatgtatatgtgtgtatatggtatagctagacttatatacaagtctgggaagaaagagtgtttccatcaggcacacacaagagacagtatgatagtaagagtcaaattgaggttctaatttcagctcctccattcattagttgagtggtcttagatcactcggtgcctcagtttcctcatctataaaatgggataattatagtggctaccttattgggttgtgaggattaaatgagatcatggcttttaaattgcttagcacagtatctggcacataataagcattcagtgatgttaatgacaataattaaaaagctttaacatctacttcagtggaagagcagtggggatggtatgatctcgtgggggattttctgtgggtcctttctgtctgctaaggatttcatcttcctccttccccccttccacgcctctgggaagatctttatttggcctcagccttaaatggatattaatgcggaaatgt

SEQ ID NO: 67708 - DNA, 1051 bp, Homo sapiens
ccctgatttacattccctatttctgagaccttgcatcttcttctttcttggtttactccattgttttgatggagcgtgctctccaggagttttctcagattgaaaagctgtgcagcagctgaggacatggtgacgactgtcctctgcatgccgctgcacaccctgcactctggctggttgccttccacacctgtgcacagcagtctcttttcccctgggctggatctcccgttttctgtagcttacatgttccttttgcttaggttagtccctcatcttgctggaagattttgattttttaggaaagctgattggtggcaggaccctcctgcatgctgcactagtaagtggcagaattgtgactcaaacccaggtctgctggtttacatcaggtgttcctcctcccccaagctatgattctaactcctcctcctgtgggggcccaggagccacaccctcccctggctctcaccacccctcatccacctggcctggcccacccccctcatctctcctcttcttcctctcttgccagcccccattgtggatgtctgtctttctgacaccctgcacctttgcctagactatgtctagggcctgggttgccaggacagaagccccaggtctgtgaggtgacctgggttctttaaactttcctgggtgaacgacctacttggtggtggggaacatgttggggaacatgaggagtgaggccattactgtggcacagccctgctcatggtcctttgattggcaggaagtcaccggaggcatcctgtctatgtcagctggagctgctataacagatcattctaccatagactgagtggcttaaacaacacatatttctcaccattctggaggcagggaaatccacgatcaagatgccggcggatccagggtctgaagaaggcccccttcctggattgcagatggccatcttcctgttgtcttctcacatggcggagagcagagagagcaagagcaagttctgtgtctctttgagaggcacgagtctccttcttgagggctccaccctcctgatctagtc

SEQ ID NO: 67709 - DNA, 1028 bp, Homo sapiens
tgcttccttcctcagagacatgttttaggtgggtcaccagggccttggtgtgaattagaggagacaggaagatcagcgaggagttctcctttactgccagatgccgagtgtgtggactcagcggtgcttgggatgggaagtgagaggtgacaatgggacattcgggtgaccttgtcttcctgttgtagtctcccttccctctgtcccacagcaaggggacccttcctccgacctggagagtatgtttgtccctagggatccctgatttgatcaagccccagggtgccgagaaacctctccctgctttagcctctccattcctgatgtgtggttaggatcaggccctgcagtcgcgctgccccaggcatagtagtgaggggaggtccagattctggccttcagggaactggtgtcaggtctgatgcctcatccattggcctaatcagaccctgtcaggaatacagatgtgatgctgtttcttcgctctgtctgaaattgctttgtaataacagtaggagttagagaggcatttttattgattaaacaatcgaggcgatttgtctttacaaaactgaaaatatagaggtgtctctttctctctctgtatgcattacacatgcttatttattagaggcggcagtctctgcttgtaatcaagctgatgtttatgatggggctgttttataaagccaggcagagatgatataaggggaactggaatgaaaagaagccctaatataacgacaccgacaatcggggtgagaggcccctggggaaggcaccgcggccagtgtgagtacgtgattggagggaaacttggagctactttgacatggaaaaaaatcttataatgtcacatggaaaggagaccgtgagctttggatcagatagctcagggtttgaatcttagctctgccatttattgcatgtgtcacctgggaaaagttacttaaaatctgtgacactcaaaatagggataatggtatgtaatgacatagcatatgtaaatcgcttggcacagtgtcaga

SEQ ID NO: 67710 - DNA, 1039 bp, Homo sapiens
ggaatcaggcacttggagctgtcagggagaaatatctaaatcatttgaacaggtaataataggatagtgtaagcttgtttagtgcaaggaaactcgttgtaacagaaaccccctcccagctcatcaacttgcagctaagggattttctgtgaggtagacacaaagaagacttccccagagccctggcagtgaggcaagggagggtctgggccatcaggagccagaaagagtgaaggtcctggcatcctcaggggcttatgaaagactatgggagttgggttagtgtgctttcaccttagactgggagttccaagatggagtctagtcttatctcaagcatgtactaactatgtaaacttgccaagtcacagttctttgggccttattttcttcctttctaaagtgaaggcacttaattgcatgattttagtcagttttgacatactgtcatccgtagagacttctcagctgcagcggcagtacaagggggtctttgtaatgattaacatgggtatggggtatagcttgtgcttgtctttatatatgtcatttattattattattattgttttaatttttgtttttttgagacagagtctcactctgtcgcccaagctggagtccggtggtgcaatctcagctcattgcaacctccacctcctgggttcaagcgattctcctgcctcagcctcccgagtagctgtgactacaggcccccgccaccacacccagttaatttttgtatttttagtagagacggagttttgccatgttggccaggctgatctcaaactcctgacctcaggtgatccacccacctcggcctcccaaagtgctgggattacaggcgtgaagcaccgcccccggccttattattatttttaactgtgacaaatgtgcaaccaccaccaacactgggatgtggtacatttaattttcacaacaaccccatgaactaggtactattactacccccatttttcagacacagacaggaggcttagagagggtaagtgacttgccccaggtcacactgcct

SEQ ID NO: 67711 - DNA, 1045 bp, Homo sapiens
tattagtctagagggctgtcagcagcccaggggagggggcttcagtgggccctgcccctttcctgtgtgctggtgacagatgacccaagtctctgccaccaagggaatggaagaaaggccagggaaggggaaaatgggtttaaatgatttagatgcgacctcagaaagaacttggaaccattttacctgctttaactggctcggcacactttattggagggaaactgatgcgcttccctacccttagacgagagagtggcatgtcttatgtgtgtggggaggtgaactcttcaagaggttgtgctgtctcaaagccgcacagggtggctctaggacccaggatcttttggccttacctttggtcccctgccacaccaacactgcttccagggtgcactcaagtctcaagctcaccttgatccgtgctttccccagggaacagtagtctcctaggcatcccggagctcattgcatctgttcctctgcctgaacgccccatttggatccaatctcaaggactccgcagctgctgtgcactcatcgctctggacacacgatgtctggaaaactctcttgctggacttctgtgctttctcccttgatcagggctcgtcaggaggatggcatactcacatatcaagggctttgtagggcaaacagatgaaaacaattgtcttatgatctaccctaaagaaacatggcttgatgtgattgacagaaagccagccctagtgatggtaaacactgatggtcagcacaccggttccttatgtgccaactgactccacggaggcccgaagggcttctccactgcccaaggccctgggcagaggccacgtagcaggcgggcctggccctgtttgtgctgatctgttcttgagagccccggtctgtgtgtctggggttgcacagctcagtgtccctctgtgtcaccagcccactttatctactgttgggtccccagggctcagcacagagtaggaatttcattaatgttggttgatgataaacattatggagcccaagttaatccagttcttccttc

SEQ ID NO: 67712 - DNA, 1120 bp, Homo sapiens
acaaataagccatgagatgggctggttctatcatcagccatttaacagatgaggaaacttagaaggcacatggttcacccaggcacacaaacagatgatggcaccttggtcatctgatcctaagttcagtgccctttgccttgggtggcagctgcccacagagccaccagcgccatgcagaagagtagagtcaaccaagaacattatatgttcagtgacagtgagttcagagtcttcttggcctggagcttcgtttaagatgaagtgccaatggcaaggtaattatcattttgggcatatttaaagtacttaaatggccatgtcaggctttcagagccctgtaaatcagagacacagtgagtgcagggccaggcctcataggactcccaggccttctcgatggggagcggagagagccatttcctgggataaagaggactctctgcagacgctggcccctcttaatcgctgcccatgccttgttctgtgcacgtgagcacatgtgtgtgctcgcatgcacctgctttgaaagcctttgacttagacattgtcaggacgttgctctgtgtctgaagctaggctgccatatctgctattgatggtgtttaattagggaccggggaagcttttaacttttattgtttattaataaagataaatttgaagcatcaaaagtgtactgagttggcttttttaagtaaagagggaaatgaaagccacaggtcccctcaaatgaaaggggatgggctgtgttagcattagaaggcccctgagcagggagaggctgggaggggaagggagagtttctctgtctccctgctgctactgtgggggtttgctggggagaaccaagcataggcagaagggaagtgtggctgggcatggagattttttgagataagggccctgcttgcggcacatctcccagtgggatgtgtgaaagacgattgcaaacctctgagctgatgcaaactgaagatctgtgagcacgggggtgggagaagggctcttggggagagagagcacagcgattagtaggacagaacttggaggtggccaaacgtaggttcaaatcctgttgtttccgcttatgagcagtgtaacgttagagcagcggctg

SEQ ID NO: 67713 - DNA, 1085 bp, Homo sapiens
aaagcgattctgctttattaaaaaggaagtcccccagggaggggtagtactgttgaaccgctatcagtcatggacaatttagtaccaattaattaatcggatgctttcctgttgcctgcagagtgaatggggtgtgatgagtgtttggaaagggcatgaggtcaccaggtgattcaggagagatagcaaaggagcaagccaagggcgtacaggataagcatgccctgtggttgccagcttatctcatttgtcttaaaaattattttagtaaacattttcacaaaattatatcaatcatccccaaaatgcacaaatcataagtgtatggctttgaatttttaggaagtgtacacacccttatagccagcacctgggctgtgaaacagttactagttgctcctctcagacccccagccagccactgtgacccccaaggcatccgctatcctgacttccatagataacgttttgcctcttttcaaactctgtgagcgtggacttcttcaatgcgtctaccctttgcgtctggctttccttcgttcaacgtttctgttggtgaggttcacccatgttgttaaagtttgttcattttcattgctgtgtagtgttccgttgtgtgaatatactacagtttattctatggttggtggacatttggatgtctagcttttgactttcatgaatggtgatgctttaaatgttcttggccatatctgtcttcttcttttatgtctgaggttatgtgctgttctcctgggaaccgtcttctgacccctaccccaggggagcatgagtgcccctcctttaccctcccatggcactctgtcataatccaggaaagatgaatagtgatattttcagttcctaggcaaatgtctggcagtggtagatgctcaaaagcattagttgagtgaaggaacaaattttatgtcacagttttgcccagggcttctcttgatatctaagaagagcagtgtggggagactgtgttgggagtcttggggatcagttcggattcttccctagaaagactgctactcttggccaggcacggtggctcacacctgtaatcccagcactttggg

SEQ ID NO: 67714 - DNA, 1054 bp, Homo sapiens
tgcatgcctgacccccttaggagactgaacatagtggttccccagagttcctccttccctgagggagggcctgagatccagccaagaactagagccagggatctttgaggtgagaatcatggctgtaggcaggtgaataccagctgtggagggggtgatcctggttggaggagtgcaggtcttggggtgaactcccaggctcagcactgagctccagcttctctctgggcagccagagcataggctgtggaggaatgttccagagaggccaccagagacctaggcaggcccagcattcactgaacacttgaacctgggcataggtgtattagcctcactctgcagaggggggatgcgggctaagggggttaaggaacaggcccaggtcttggagctaggtattgagagagtcaggattctttattgtgtttgtaattattaaccagactttttaagtgaaacaaacaaacaaacaaacaaacaaacagaaaaaccagtctaacctctcagttaaaaatgcaaacaatagagaacacttgagaatgaaaagcaagtctacttccttctccgactggagtcctgtatcccctctctgggggcagccagtcagcagccagtttctcctcccttggcccccgagggagcctggtgccagggccttgccccaagcagatgggagtcagtgctaactgggctgatggaaggggaggggtggcatgggccctgcatgtgcccttaggcaattccgagagactattctgagcttggatgactctagtggcataggtctccgaaccttcagcaggacaccgctcacgttgctggggacctatctagctctgctgccctctgccccacacacctgggagggctgaggggggctgattctgggtttctccaaggaatgcgcacatccagagatagctcctttctcacctgctctggctaagactgaagaaaaaaaaaaagatagggcctactttctgacgatggtggataagacaacaaaaagcactgatgtgcaccagaagtggccatggacaggacagatgta

SEQ ID NO: 67715 - DNA, 1130 bp, Homo sapiens
tctgtgagccatcagcacccaggcatggctctgagagcagcacttttcctgcctctgctgttgcctttatgcgtctaggcctgggatcagtatgtgctccttaagggcaaggactgtgtccaggttcctgttgcatccccagggtctatttatacataataggtgcacagcacatatttgttcaatgaatggaaggcctcaagcaatcacctgctagaggaagacagaggaagataaagagtaaaggatgggggtgaaggcaactccgctgttggcaaatcaggcccagaatctttgttctttaattcatgggtgttggtgcagggatagattaaagcaaacacagtcttaggagaagctagacattcttacttattatggataaagttgattattcagtgattttctgtctccctactagaatttaagctcaatagaggtggggcaaggacaggaatcttgtttggactatatccccagggcctagaacagtgcctggtatattatacggccttaataaatatttgttgagtggataaatatttgttgagtggaacaaggagaaaaaaactgtaataatccagttaggctatataaaagtactactaaatacaatcacttacctcaaatgccttccatttatgcctgatcagcatgctgcaccataattattaagcagactgctaaataggtgtcagattaccctgtgtaaattttatttgatgacagaactacacgcagttcgtgcaggcctgaggaactgagtgaagctgctcatggccccaaagactggtggatcctggagactacatttatttttgagacagagtcttgctctgtcgctcaggctggagtgcagtggcgcgatcttggctcactgcaacctccacctcccaggttcaaacaattctcctgcctcagcctcccaggtagctgggattacagatgcccaccaccaagcctggctaattttttagtggagatgggacttcaccatgatgaccaggctggtctcgaactcctgacctcaggtgatccacccgcctcggcctcccaaagtgctgggattacaggcgtgagccactgcacccagccgagactacatttaagcatgacagtggctcaggtcc

SEQ ID NO: 67716 - DNA, 1096 bp, Homo sapiens
gtcggggatcaggggtgtctatgtgtacatcgggggatggggattagtgtggacaggtgggtggggcacagcagtgacaaacccagaaaggtaggttgatggccacaagacgacccatccaacagcagggccccaagggtagagttaagtgacagccctagaggaactcaaataccaggcaggttaccccaacggataaccacatgaggcccctcttcccacactgggggtggggttgggggtgggagcaaaggcaggaatctagatcttaaacctgagcctgaaagggttagaggctgacttagagcaaagatggcacgatgctgaatctcagggagctgacttaaagctcccaaattcctccaattgcattcaggtcggtgtgctggtgatggtcaggaggccatggtgtgggcagaggtgggcgagcagccaaaacctggctaggccaggggtcacaggccggaagcccagcctgcaggtctgtgagctgcttcgttttaccttgtgggcacagtttttcatgcaaatgcagaggagctgattggaatcagaaatgtggacaggtgacccagttctccccctcaccctgccctcgacacactgctctgcatgcttaaaaaaaaagaaattaaaaaacaaaattttccctccctcttctccgttcatttttacagaaacttcaaaacctaatttaattctgcttagcagcaatgcaaaacggttcatatccttaagatgtttaatttataagatgcctatagtttttcagcgtttgctgcaaggtcttctccctctctaaatgagtgaataaagtggcaacccatcaatttccatttgtcgctaatgggaagcggaaagggattgagccagaatcagtagcacctcatggcctcgcctctcccgacacttgtgctctgggagggaagcagaaagcggagctgacaggtccctcttttggctgccacaacagagggcttcaaaggcacccctcgtgctcccaaacccatactctgaacaatgcttgttcagctctgtcaagactgctggccctcagttttggttcatgctaggccacttccagccgctttccagc

SEQ ID NO: 67717 - DNA, 1049 bp, Homo sapiens
tcgaatgaggttttgggtaaaagaaagggattttatttatggctgtgaggctggctgcataaattccccaaactctcacacatatgtcaaccccttccatcatctatcttctgaaaatgtgtttggattttgcttcagtccctctgggtcctctgagtgataactgtggagccacaagttaataaatgccctgaggagaccccaccccatctttgcacccccttcattacttaaagagaccagagatcattgtcattcttagatccggaagggactgtaaggattcgttatctaacctgctcatcttgcaaatgaggaaacagggtcacagcaggcagtggtttggccaaggtcacctgacaagtaggggcctggctggtggcagctgacactggtgctggtatccttgactcctcttccagtgctctcttctccatgcacccatgggctcccttagctgctgagaagcagaatcaccttcaatagtatgtgaaggttatattctcctacagtttcctccattcctgttcagaaaacatttcagacattagcaaatgtgttacccttgcccctaacaccttgagactcattaagtatttgttaactgaatgaacgctaggctccaagcctacctcttgttactccttccttggctctgtattttacctacactaaaccactccctgtgagccaaatataccaggaggatttactcccagctttacccattcccctgctctccctatagtgctcttcctcccgtttcatcttctctgcctgcaaaacaaatccagctcctccttctactcctcttctttttcttcgtcttcctcctccatcaccatcagcttaaatggctcttcctctgcaaagtcctttcccgttatcatcctgtccgtaagagggagaattcatctttttcctaccattcccccattcccccagcacataacatctgttccagcacttgccgtgttatattctaaagattatggcattttcccactagactctgaactccatgggagagtgatccccaacagaagggc

SEQ ID NO: 67718 - DNA, 1039 bp, Homo sapiens
tcttaatccaattaaagcctgaactgagtccctgccgggttgtgttttggtcagatttagtttacctctggctcactcctttcccagagcagagccaccattagttgagagcctcctgtgtttactgggtcccctccccagcaggtcctcaattctagtcttgctgttcagtgcctcagaatggccagaaaacactctctgctttatagagactttcggctgagattttttggccttctcctccattcagcttcagaattctgtaaatgacttaaggagaaaattgggaccctatatttgaggaccctcaagtccttaattttctctctctagtcccaaggctgccagagctctgctggcttctttgtcccccagcagcagtctttgcttcttgcaaacctgggttctcagcctctcatcctgggcctagaaatgacataccctccggaagtgattacagaatatcagctcacctcttcacactttcccccctcagtaactgtatcctctcccatccttcttgctccagcaggtcaatggtgccttgaaacagatgattgttatatttcttctagcatttctagttcttagtggaagcattgattggccacaaactatcccaccctaccccgaagaggaagtcagatgcttactattaacacataaaaaccacaggattacaagagcagctcttagctgggtgtcttggtagctggcccagccaactaggagcaaacactgtttaaggcattcccttgagtgtctgggctgcctcaccatgaagaaggcagggaaatggatgggagtgtaactgtgggcccaggaagaaggcattcactgggatgaggaatgagtgttcagcaagcccaggaggcctcgatacttcatcaggtttctaatgattttgtcagagtgttaatcccatgggtgagtagcagcattttgataccagcaaacagattgtgtttcagcccagataatccaatatggagatctgcatgagagccgaaaataattaatcacattttaatggggttga

SEQ ID NO: 67719 - DNA, 1050 bp, Homo sapiens
ccatacccaccctcctttccttcatcatcttcctccattccctcccaaccctacactgcacccctgttctagagttcacttggccactcagtattcctgtagacaaccagcactttctttgtcccttggctttcttggtggtgttccttgtgcctgaaatgtcctttcctgccatcttcacctgatgaaaagtctaccctttacctcagacccagatcacatatcacctcctttctggaaacttccctgatcctcccagtccaaatgagtcatttctcttctgagttacctgatagtttcctcctctgttaaaataaatcacactctgctcatctcatagcagcttttgtctctgtctgttggttactcccacacccccgccagggcaaactccttgaaggcaggagaacaccctttcatctccatggtctccaccacagctcctttggtgccttgtgcattcctggtgctcgataaatatttattgatcgaatgagtaaatgagtatcgaatgggctttccatgtgttttgctccaggtgtctcttattgtaattaaagtttttttttccttagtcaatttcaggcaaaaagcaacataaattttatgtgaggtttgagaaggactgtaaaagtgatttatggttgggtaggagatctgtgcaaacaggttaggaaaatgctcagagtcagcttctacctgctcccctcgtcactccagaccctaaatgctgaagcatagctgccctgtcgtcctggtgcgtgagtggctttagtgtctggtgttgaagtgctgaataaaaaatgctcactcctgagagcatggtaagatgtttgtgggtagtgttcacatagaatgccctgcagcttgatgttcgagaatgatcttttgtgtgggcttgtgcttctaggcacatctctattgtccagccacattctcccactgcaatccttggcaaagcacacatggggctgaaacctgtgaccctgcctcctggtttcacgctctcaccagctgagcccccacactgcagcaagaactggctgcgcc

SEQ ID NO: 67720 - DNA, 1052 bp, Homo sapiens
gagtagtctgtccatccatccatccatccgtctatcagttagtcctttcaataaatatttcttgggtacctagtatgtgtcagatactgggaaagtcctgggtatagagaggtagataagaaagacagtctctgcccaccaaaggtgacatagaaaaggtaaggaggcctggacctctcttgtagagcagatagagaaaggaagataaagtaaaaaggccttttggaagccagtttatcaggatttggccatggattggatgtggggtagtgggcatgaaggaggaggcataaatagctcccattttccaccttggagggctgtagtggctgagccgggaggggctcctgccagcatcttcagcccctgagttaagcacagaagcagaggagagcggtgcatttgccgtgtagatgcacctctgagacaagggcgtcaccttttctgtcttaagacagaaaattgtcttagcaccattttctgtcagcccaattgcctttcattccctcctgtagaaatccaggagctgccttgggtgactaggtgggccaccaaccaagggagacattcagcagggggcagatggtgagcttgggtggactgcaagtgcccatggcatctggacgagacgtccagtagacagctggatgcataggcctaaagcatgagggagggatctgggctggaggaattgctttggcattgtcagtgacagaaagcacgagagcagatgaaattattgaaggaagagtgcagtagggaaaagaaccctgggctaaatgtcaaggtaccttggtctgagtcttagatttgccattcatatcctgcgacctaagacaggctcttccgcctctcagccttggaggccctcatctgtagaatgagatgatcagaacagatcagtggtctccaaacttagtttttagtggttgaaccttttgttcaaataaaatcacacacagaatcccaacagcaaaaagtgagctgctctaggaggagaatgacaagagattggaggttgagctctgtttccccacccaccccccaaccca

SEQ ID NO: 67721 - DNA, 1813 bp, Homo sapiens
gtttattagccagtttacaagctctctaaagtctcctgaagcctgtttcttccactgtcagcccaacccaggctgtaaggttgggcttacaggagtaagggtgaggacccaggagtaagggtgaggacaggagggtatatctagtatatgtaccacttataaatcctaccgtctgtcaatttccttcatgaaacttcccctgtccactcagccgtatctcctgagcagcaaatcatttaaattcctttgaaatactgttacttaaacttgtttttggacacttagattgtacctattattaccattactatttcggttgtgtctgtgtgctgctttctgaatctctttataaactcctggaggcaggtgaattatgtcctgtttcctatacatggtaggtacaggatggggtggtataaagagcactcgtcttgatcatctttggtagcactaaagccaagaatgatgcttacaaaattgtgggacctcaacagatgtctgtttaataactgaatggctaaacttagaaccacatagttttagtttagatttctgagtttccgttcactagctttgttgccaaaggcgaaaaacgaaactctttgaaacccaatttgctcatctgtcaatttgttcatctatcaaaagcagtgtatttcttgtgttctcgtgagggtcaaatgagataataaccatagaagtttttgcacagtgcctggcacatagtaggtgcttatttattaagtgttaatgtttctttacttttcttatgatgatatatatgcggtttattcttcactagactgtggtcttatggcaaatggggattgtattttactcactgttgtcctccatagcactcacacagtgccctgagcatattaggttcttaggaagagctattggatttattgcttgctggatacctctggtcgcagctcaggagatgcagctgaatgagacatgacccagggccaacagggaacatttgggagtgcccaagcttagagcagtcacagcctctatctcagcttcgaagcctgcacgtaatttacagtctcattccttctgtttctcaagtggccatttaaattctttagattgcagggctgtcatagataattcctctactagaatgtaagctctgtgaggatagacatttttgcttgctgttgtgtctagaacagggctggggcatggtatgtggtcggtaaatgtcagatgaaggaatgaacacaggtggggcatgggaagcaatattgtacaacataactctgcaaacttttttttttttttgtaaaggaccaaagagtaggtactttagacttgtatactatagtatctctgttgagattattaacctctgccattctagctcaaatggagtcacaaacaacatataaacaaatgagcaggtctatgttccaaaaaatgtactttacaaaaacaggtggcatgtggttttccagttgtcccagaaccatttgttgaatagactgttctttccctagtgaatagtcttagcactcttgccaaagattaattggccatagatgtttcagttttttctggactctcaattctattccattgactgtatgactatcctatgccaataacacactgttttgattactgtagctttgtagttagttttgaaatcaggtactgtgaatcctccagttttgtttgtctttttcaatgttgttttggctgttcatagagtcccttgcaattgtatatgagtttgagaatcagcttttccatttctttcttttcttttttttttttttttgagatggagtttcactgt

SEQ ID NO: 67722 - DNA, 1160 bp, Homo sapiens
gactgctttccagcatcgggcctgctcttgagctttctagagttccagggaccctggacagccaccatgaccaagtccattggatgtcagctcaggagagacacaggaacctcttcctgcctatttgcaggagtttgatggtctgtcctgaagtccatggctctcctaggaaggggctgtgggttctaggactgaccctgatctctgcctgtaattctttctaacacatttttatcaccaactccacccatagctgccctatgtagaacagatttcttgtcttgtctttgtttagacccagtttcttctggactcctggctgatccagcctgagtgctgtgtggccacctcttccattccgactgcgttggcatgcctgggctctgtgagtgtgagtgtgcacgtgtggatgtggcatgggggagcatgtgtctgccctgtgtctctcccctcctgcaggcctggagtccttgcatggagcccaggggtgagtcatgtagagaatgggatggatggctggacttccaggtgaggggctgttggtgggtggtatgctctgacattttaggggcacaggggaccccttaaaggactgggttgatttctggcctagaaaacgttcgacctatggggatctttatcacctaagacatataggtagtctgctgcatgcagtatcaaagcaatatgtgaggttgagagaagggagcgtatgaccaagaccaagctgtgagtagggatggcaactggttctcaccccctctgtagctgctgtcccagcaggcctcctaatttcaggtccctagtctgcagatgcacactgcttggtggctgtgtctcctgcaagtactgtctttatttgttaggatcaccatatgaacggactgacagtgctgacagtggtgccatggtgctgtgacctgataccatgtcaggcaccatgaaaagagcgaatagctaccaatcctctctgacttgggccaagattctgcagcacctcagagctcctgggacaaccacacagagcctttttgttttcatcaacattgaacgaccaggcttgaatgagctgccaggacagggctgctcaggaggatacggcagtgtgatggccatttacagaggcctggaggcaagaagacagagaaagtaatgagaca

SEQ ID NO: 67723 - DNA, 1049 bp, Homo sapiens
tggggatcagtgctgaggcacaccctggcatgggtcatgcttctcttcaaggggtgtctctcaggatagcccaagttcaggaggacaggctctttcagaatctaagagcagagactcccaaggcagaaaggggcctccaagatcctaaccaatctcttttgaatctgtagccacctggcaaaactataccaaacagattgatccttaatgttttccagaaaagaacttcccaaaatgtccattgcaggatgatccaatagaaagagggaagctaatgtaccctgaacctgcagaaggccttttgtggctggagagggctggaaatttctccccagtgccctcaggccaggacagaaaggctttaaagctgacgtgtagcccagaggagacaggaggtgggttctgtacgggatgaaaagcttggaagtcctagcaactgaatcctacccattccgtggtctgagtagcttcattaagaatccaattcattcatatatccatgcactcaggaaatgattattatacactgcactgtgccatgctctttgtgaggtgctgtggatgcaataatacacaaagcacacaaggtcgctgcttcacgcagcttacacccagcagggaaattaaatggacatgtcaataaatagtgactgtaaagtaaggtgaatactccactagcacacatacagggtgctaagggaacctggggtgcaggggcacccagcctgcccttgggggtagtggaaggcttctcagaggtgatggagaagccaggtcctgatgtccagccatgcggtgtgctggggcgagggttgggaagagagggggaaacgtgacagaaaatgagaccggacaggtaggatttaagagaggaaaagaaaccaggcctgctggcctaggaaggaccttagccaaggcagtctgtaaccattttcagctcctttaggcaaatctccctcaaacttagtcattttttgccttccagaggcagtgtcaacagaggtcacccacccttctgtgcttttcttctaaatttatcctctgaccac

SEQ ID NO: 67724 - DNA, 1049 bp, Homo sapiens
acccgtgtcactagcctggatcccttcttttgctggtctgttattgtccttttgaaaggaatgacaataactggtcacagtttcctgcgtgagcctggctggagtggggatgagagaggcagtgcccaactttgagacactctgctattatttacacagcccaaggttgcacttttttataagcagcagtttgccacagctggctcatgtcaagcgtgtggttctaaaaacaaatgaaaaaacaaagctcatgttttcctcttttaataaacttgtccaagtcaagtgtccccctgtttataggtctgctgtatttcttgaatccaagatttcactggattggtttctctcagcgttctattctgctgttcattggttgtttggattcggccacctgacatgctaagcacaccccctcccagttttgtgccctctgcagattttatcagcatgctctgtgggttgtcattcctggcacctgaaaagccccccgaacccaggcaggtaaactccataaagagagcaggaggaagacagaggggggccacccttgcgtcactgacattgggctcttcagtcattgtcatgttgtaattggcaaatgcagaaagcaccagcatgttttgtgcttagagctctttaccaggcgaggtttaattgcaatgggatttatgaccgtagcttgtaggaggtaatagatgtagctgtgtctcttttatcttctctggctacagaggattttttaagggaggaggaaagacaagtggggctggaactgggaaactcggtgaggtagagaggtggctacgagggacttgatgagtcgcagttgctaaggttgccctaagagatgtacaacatgaatattcatagttctgttcacttaggtgactgctttgctagctttatctcttcacagcagctttggaagatagggaaaggaaggctcaattctccattttacagagggggaaattgagtcgagagtggatttgctgcggactcaaagtcccattgagagtcatgaatagaattggggctggaatcag

SEQ ID NO: 67725 - DNA, 1023 bp, Homo sapiens
ggcggtggctcctcgtcgctctgacaggcagtttggggtccagccaggagatttttcctgccgacggaatgcctgtaaatggaggccaggtgccctgtgctcatcgcggaactggttgcctttggtcaccttagtgtgagcctcaggctggggtcacagccattgcaaggtagctaatggctgggacagaggaagcaactgcacacacctgggtggtgggcaacgctgcaggaacaggctttcagaagggcagctgctgtggggcatcctttggcaatgtttacagtatcacgaggtgagatgttactgccccctggggcttcttccctacttctcctgtcccttgaacctgctcacaggcggatgagcatgcccaggatctggcagtgcttagggattggagaaggatgggcccactatctcctttgccatcctgccaacacacatgtcccagcctgcatagaaagacaccgcagggccaggaaatctgagtcctaaaagtttaaaaaaaaaaaagcgatgggagaacttgatttgtgatgttggctgtatcagttgacctctttggtcctcatttccttacttacaagaggggaaataagaatcctcctgcttcctgcatcaccaaggtgaggagaggagactacatgggatgaagaaagagagggcttgggtggggaaagcctgctgggggtgtgtgggattctgatcagggaagcccagccgcccagcctggggtgcccttccagctctgggctttgtgggcaggaatgtgctctccctggagctgaggctccacgggcttaggcctcctggaggctgagcagctgggggatggggagacctcccagcaaggctggggtaggaaatggccagcctgtacctccctgcccgcgtctgtaagctgaggcggctgtctgtggcaagagggcttgaaaagattccgaaaagaattaagtcagtgccatggttttccccttaagtgtctgtctagacacaacacctgattccaggaaaggatca

SEQ ID NO: 67726 - DNA, 1045 bp, Homo sapiens
catttttctctccacattagctgctgctgttatccatttgacagagaagccgagaaaagaggctgagagctaacggcttaaatgttaggaacctttgttccctaaagatcaattcaagaaagagataaggtagattaaaaaaaaaaaaaagatttggggaaacatttcatttgtaaaaattcaagctgtttcaggaaataacttttacttaaagcaaactacacctgggattggggagcactgccctgccttatacctagaatgtggagcaggttgtgtgtgttgtggggggaggtggtaaagaaagagaaaggaggggagagggtgagatttcgaactgagagctcattggcatgaccattagaacaacttctgctggtcacagtcacagcgtattaaggtctgctgaggtgggattggtcatgaaatcgataagcactgcattttgtgtttgattctggtttattgtagactgttttctgcagacatcctttgatgtgcgtttggctgtgagcaaagtaatatagattttcccattgcattctgggtctcaaggctgactcccttgcagtccagcacctttggggtggggataaggagctatttgggatggtacctgggcctccagatgccaggcctggaccacgtgggaggtaggaactgatggtgttgatgtgtcctgctttggttaagattagctcaggactgaaaggaactaagctttcagatgggagctcctggtgcacagccatgggtagttggagatcagagaaatttgggaggggaagaaggtgctggcaccaggataggcaattgtgatttgatatttattctgcaagggtgggggttagggaggaatagggagggaggtagatttaagagtttagctatattttaagaagttaagggtgcaacatggcttggagggggaagatactggaatttttaaaatgaattgagaaatcattgctctgtctcagtgtgtgatggaaaggttagaggaatggagggtgaggatggagggaaaagggagagagatgaatgc

SEQ ID NO: 67727 - DNA, 1047 bp, Homo sapiens
gtaataactgttatttatataagagaacagcaatgaatatatcaaaatgtgaggtttcaaggtaataactggaccatcagaatcatcattatccatttaaaaggcaatttctgggcttggaaattgatagaaaaaaatggcccaattctaccacggtggtaattaaatttgtgtttcttttttatgatttgattttgttctgaacctgatgggacttgatgaccgaggggaattgagtagggatgtaaatgggaatgaccgtcccacctcatccttgctgatgtccaaacatgacagctggggagaggcctccagttttcatcctggtcacagttggagggaaaacagtggagacagaggaggtgactccggccagagtccactggacatcttctagaacacttactcctggatcctgtgattctgcctctctctcgcctgccaagttaaccagcatgggtgaacattcctctggcttttttctatttatactaaatctataaatttttttttctctccaaagaatggggaacattccatacgtactgcatgacaatgagcccattacactgtatcgtgaacagctttccatatcagttcatatgcatccatctacttctttttaaaagctgtgtgcttgtcctctaatgtactatcattgaactaacctttcccctttaggtggacatatgggttgtttccatccctgtgcctgggtctttgtacatttgcaggagcatttctggagagtaattcctagaagtggaagatttgggtgaaagggtatgaacatcttaaagcagaatcagttgggcattgttgaccttgagaaatgagattcaacaacgtttgtcctctaggtcgaatggattctcattatgtcagactactgcacaaaaccctgaaagatcttttgggaattggtgattttgcttatttaggggccaggatgaagactgagaaagagatagagcttgttttggactgtagaacatttagcctcactcccaccatcagtgggacttgagaggtgttcaggagggtagt

SEQ ID NO: 67728 - DNA, 1103 bp, Homo sapiens
tgaggctgatgaaaagcttagacagatagctaggactttagaaattactttggaggtcttcagaacaatacgaggtgaaggagggagaagaggctgccagggttccttgttctatgcgccgttcccatttgtggtattttcgcttagtgatttattttgagcatagctcagtagtactgttaatatttttggtattgtggttaatattgtgaacattattgtcaaataattttaatcagaattttatcaaagtgtctagaagtcagcttagggcctggcacaaaatctttgcgtgtgcgtggctacgcacacatgcaaacctatgcacacacacaccagttttcaagcctcaccctctccaagtgtgctcttcaaacaagattcagggtgagggccgtgatgagtaaacttgactatttataacccaagcccatgatccagcaactaagtggtttaattacgcttatcactgccaggcgcctctgtggattaatgtagctaattcaatatcctctctaagaagcgccattggggactgtgattctgctctgaggagcagccttcagcctctctgttcaccaccaagaccttggctggggagttggtgtttgtctcccgaggtggtctgtgagaagctggccgacaggttaaaccctcctctctccctgcgtccctcctcctctagcacttggctgttgtgtccattggaaaccttcccagactctcccttccacctcccatctccttccaccccctgccaagcacttttaatttgcttggaataattgattctgtcttcttcttgcacctcatttttcctcacttttatttatcaccttgaaacctctccttgatgtacgcaggccccatgtctgtggggagatgagagtagggtgctgctgtgtagcgggtgggtaaggggacagcctctgctaccagacccacagtttccactctcccccaggcactggtgacctcatggctgtgtctccaagtctaggaagcacctggcacagaggagagtaatgaacagctatagaagagagtgaggaaggaatgaaacgtgcctgtgttttgctgactctggcatttgcacttggttt

SEQ ID NO: 67729 - DNA, 1430 bp, Homo sapiens
gagggggccagcaacagggccccgagagcctctatctgcccagctcacatatggtgtcgaggagccacagggaagcaaacagtcctacttctgtccttgtgccacccacttttgtggaagccattgggctgctgggctcagagcaatccgtagagctttccaggcaggaagagaaggtgcaagacagagcagaggaactccccagaatgaatcacaccaaaaggcctgggttcgtccagctgagaattgagggtgtagccaagcacaatgagcacagcctctgagaggacagacagcaggaagatggtaaataatgccagcgctgctttgtggtagggagctcttttgaaggccagttgtagaggaggggccccacagcacaaccttcagcatctcagccttggtgggactccacagaaggactgatgggctcagcggtgggcggggggaagtttcagaatcattttaaaatttacttttatgctattaattttttgctgacagattagaaagataaatcaatctggcagtgggtcctgagtttagggttgttttctatgtatgcaagaaccatttgttaatgtgctttgttagctgtgtgagggagagaaggcaggccagcagccttgggtagaaaatccaattttagcactggaaggagcctcagaggtcctggtttagcctcctcattttacaggtgaagaaacagaggcagagaaggaaggtgacttgctggagttcacaggctactttgtggcagagttgagacaggacctgtggctcttgactcccaggctggcaatggcaaccctgaaagagggggtgttaagcctgagtgccaagtgtttctcatttggtccccgcacagtagtcattaaaacatgttcactgaattgaaaaaaacaaattgccaagacatagtcttggtacaccctaatcctgccctggttataaaaaagggatctacaaactagaaatctcttttttttttttttttttttttttggaggctggggatgtagagtctcgctccgtggtccaggctggagtgcagtggtgtgatctgaggtcactgcagcctccgcctcccggattcaagtgattctcctgcctcagcctcctaagtagctggaattacaggcatgtgccaccgtgcttggttaatttttttgtatttttagtagagaaggggttttgccatgttggccaggctggtctcaaactcctgacctcaagtgatctggccaccttggcctcccgaagtgatgggattacaggcgtgagctgccacccccggcctggaaacctctgtttctatcattctgttacttcctcatctagaacacaggctctccaaagtgaggtactctgtgttccatttaattaatgtcataataatctattgatgagctattttgtaatggatgctg

SEQ ID NO: 67730 - DNA, 1080 bp, Homo sapiens
aaataaaataaatggccgataaggctgccaagcagactcccataagcctgtgctctgagagggaagtgattgctttgttgggttctgcatagagtccccaggagcccctccctgccaggctctgggtgggtttgggggaagggcaggtttctgggcccaggttctggaggaagcagacaagtcagacacacagtcggacagccacctggatgcaataaaagcagaccatgttcccaccaggaaacgattctgcaggtttctctagaccttctgtgctgacttgacgtcagcagcatcttcggtgaagggcctgctccttcctcccaagccctgctgggcttccgggctggctcctgtgctcccctcagcagcagtcctcggtgctgagtgggaggatgatcctgggaagcttctcccggtgaaggttcctggatctccttgccaaggctgctgtggtatgtcgggaggggatctcaggaatctgtaccaccagcttgcggctggggggtggggagacaccctctgaggaccctcttccaaggtgtgagctggaggagctattaatagtaagatgccgggtgttccctgcagggtgacagggcagctgtgcaccccaccaagccctgaccagcatcctcccacaacctgtgaagggtctcgtgcatcctcccacaacctgtgaagaagagatcaccaacttcttgtgaccagtgaggaacagacactcagggcaaccggggcctgcccaagtctgtcagccagggagcaggaggtctgatttaaaatctagctcttcagtctcaaaaggctgctgtttttaggaagagatccctgcaaatgaagccacaactctacttgcagagttttgaggcaactgggtcagagcagaatctgtaaccttgctagggaagccacgtcagcagagcccccccatgatctgatactgacatctggagggacagagccacagccagagtcacacagcccgccaaggtgggcaggcccctgtctaagagctgttacaaaagccatagtgaccccagcttgggtgggaaatggagagatccaccccttccctga

SEQ ID NO: 67731 - DNA, 1042 bp, Homo sapiens
gggttgtagcgtgtgtcaataattcatttcctttcatggctgaataatattccattgtatggctctaccacattttatttgttaatcagttcatagatatttgggtttttttccactttttgtctattatgaatgatgctgctgtgaacattcatgtatatgtttttaggtggacacatgttttcgattctcttggatatatacctaggagtagaattgctaatcatatggtaaatctatattttatcctttggggaactccagactgctctccaaagtggctgccccgttttacattcccaccagcaatgtatgagggttctaatttctctgcattctgtctcacatggttttgatttgtatttccctaagtctaatgatgttgaggatcttttcatgtgcttactgaccatttttatatcatctttggagatctgtctgttcagattttttgcccctttttaattgggttatttgtctttttattaagttgtaagagttctttctatattctaggtataaccccttatcatttatatgatttgcaaatattttctgtcattggtaggctgtctttttactttcttcacagtgtcctttgaaggaacacatctgaatccgaactgcaaacgatgtcagtgttaattacaatgaaacatcattaatttggactctggtaatttggaatgggtcagggcagaggttcaaagtttattctttcaacagttattgagactgtctatagtcaaagactgtgccaggccctgggggtagagaggtgaacagagctgagtcctgcctttacagccacagtgtgtggtgaggagaacacaattgcaccatgggagccaagggcctgagcgctaatggcagagccaggtgctcagggagccctggggaaggaagagctaactgtttaaaaagcatttactcggtggctcacacctataatcccagcactttggaggccgatgtgggaggattgctagagcccaggagttcaagatgagcctgggcaacctagtgagacctcatctctaca

SEQ ID NO: 67732 - DNA, 1026 bp, Homo sapiens
ccatggccttggggatcctcagccgcctcccttccggtggccttctctcccactccatgtcaccatcacagctgcattcttgagtcatggcagcccttgatcctctgcttctaaaaccatacatgtccaaatcccatggtctgaaaacagcatcttacccaatctcaccatcgcattcccctgctccgctcttctgcgtatcctggtatccacatattccacaaatatgcagcctttcctttctgctggggctaacccattggacagctttttctgggtgttactccctttcctgtccagtggaaaaggcccagtccatcaccctcgccaggtcccaatagcaccttcactcatttgtccccagtcctgcccacccacctgatcacctcctactcttagttgtgacatctgcctgccttgcttctggctgtgccctgaggctgctttcagaaacacaccaacatctcttcatttcaactgggtccaaacagaaatgcatgtacatatcagagcagctattccaagccctcccctgaagccaccttccttatctttgtcagtcttgctagtggaagatgaagatgagacctttcctcttttccgagaaaatagatgccatccagctcagcctctctcaacaccccccacctacagcaaatatttatttacagctgtatctgtcagcatcggttagacctgcattacgcagtgctatagccattagtattgagcccctggaacgtggctcatctgggtggagatgtgctttaaatataaaatgcacactggattttgaagttctggtatgaaaacaagaatacgaaatacacaaatgatttttatattgactagagattaaaatcatagtatttgactgggtacaatggctcacgcctgtcatcccagcactttgggaggccgaggcgggaggattgcttgaggccaggagttcaaaaccagcgtaggcaacatagtaggactctttttttttttaacaacaacaaaaaaaatacgaaaattagccag

SEQ ID NO: 67733 - DNA, 1031 bp, Homo sapiens
atcttcatttttgtaacatctccatcaagagaattaagaatctctatagctagatttattgagtgcctcctgtgtgcaagatcctgtgttgatcccatgccatatcttgtaatcttcacaatagcccaaggctctctccacttccttaaaagcgaggcaactgaggtcccagagctgtggagggctgcagctgggactggaagccagttgtctgtgataccataacatttatccttaacactgctcccagaagttgggcaactgttggtattacaccactgcagttgtccacactgaataagtcacactgattaaatctgtgtgctgtgccacttccacacattatcttagtgaatcctcacaccaaccctgtgaggttgtcctactctttctaatgttcagtgaggaaaagaggttcagagaaactaagtagctcactttggtggcatggcccatcggtgtcagagcctggggagccagcattcagcagtgtctggcagctgctccttgaggccacagccttccctcacagacctggcatcctttaaccctctctcacctcagggagagtttctcatatgttcagaatactatttcaaaggacagccactacccgcctcactttgcacaatgcctgcttgcctgtgtgcatggagacaggtatccaagtatcaggatgcctggacccggggacttcgtgcagacaggacccctagtggcctgctctggtattacaggattcccgaggcgtgcatccacattagaattcacttctacacctggctgcaaaccaagacccttaagcttggagagaacttgttctgggggacggttctgagcatggcaggatggagaggaacttggggtgctgcctggaagaggaaggtggcagcagggggaggctggagaaggaggagggtaacagtagcggtggagtaccaattgtctccatgtggttgcctgcccacagctgctatcttggacgaccccatggagtgcagcagaggggagcggctctccatcaccctggc

SEQ ID NO: 67734 - DNA, 1129 bp, Homo sapiens
catcttcgcagactcttggcaggataagttgtgggccagagcaggcagagacaattcttcagtcatttctgaataatccattctggaagccaatctactcaccaccaggaagttcttcctgctgtctactatcgatcttccttgctttaacatctatacacactgatattcagcttcagctcgctcagctctggacaccaggggtgagagtggaagaataaaatcaaggtggatggcagattattacattgtaactttcctattacctaccaaatagcctaagccgccaataaagcagccatcacagcctcttaagatcttttcctgggagaagagaggcagaaggcaggacagtgggtcctggaaatgtcagtaatagatgcagagggaagctgacactgtcctaatgaagccaaaccacgtatttatttacctggctgtgttcagaggttctctagatggtttctccgcctgcagggcttccttcctccatgtgcgcatgtgtgtctgtgcgggagcccatccccgccccacttcctctccctgggcattccccactgaagtttgttgggagctggttactatacacctgttggctgggctgggctgatgggactcttctcttagtcccagggtagcgatttttctctttctgccgtctctgctctgatgtattaactacaaataaaatattctaaggattatgctttcaagagccaactgtctctctgccagcagcaggcagttcctctaagaataaagatagattcttttgccttctcaggaccacagaccccagcttgcagacccacggtgcattcatccgggtctctggacaaatagttttctgtcctggggctgcttctttgaagcatcatcagggatgtcatcgctcgtcttcctcccacggagtgggtgccctgggagctccttctcccattggtgtctggcgaaggtgttacataaaagaactcaccctccacaacctcagctcactcatccctctttcttccttttcacccacctggatcctccctgctgtccgtttttgctcctcttgccaggtccctcacttcaaagtggccccagaggagttcgtcaagttccagttccagagattcacaaccct

SEQ ID NO: 67735 - DNA, 1120 bp, Homo sapiens
atgaagtcattaagggtagaaaagctccaccaagtttcacgagaggagaggggccctctttagggaaggttgggagcaggcagtgagagcttcagcttagtagatagatgtccctccaccacccttgtggaaggtagctcagaatacacaggttccccctgtggtagctggagcctgcctgaacagcccccaggtagaagcttctgggggccagccttgtgccctccatagctcccagcatctgatgttgcactattattttttttattcgaatagcattactagttcattgttgaaattttggaacatatagaacagaaagcacatagaagaaactaaaaattattcacaatcctatcacccagagctatttaaccactgttaaattttgatgtctgtttttttctgctttacagacacatttttcccccaaattattgtcatactgcacaaacttttctgtaagcgctttttgtccacacttaattctatgccgtgcattttccccatgtcattaaacatttttctagaaatattttaatggctgcctcatttcctatcatacagagttcccataatttatttaaccatcactttattgttggagatacaggttgtttcaaatcttttgctacaataaataatgctgaggtgcacatctttgtacataaatctttatacacattcatgaatatttccccagcatacatttctagaagtggaattactgagttaaaggtacgcatgcttttaaggattctgatatgatttgccagattgcattttagaaaggctgtaacagtttacactttcgccagcagcatataggtgtcttatagcacccttgccaatactgggtatgttaattaaaaacactttataggtgtgtgtgtgtgtgtgtgtgtgtgtgtgtgtgtgtggccatgcttttgaaggaagctctgcctgtagtgtagtgatcattattagcaaatggttctgctcgatgcctcagggctgtctttcctgagctcacctgtcagccccaactcctgtgacattggagccacactgatcaatgagcagcaaggcttcaggaaagcctgttccctttgcccatttgccttcccaatggcccagg

SEQ ID NO: 67736 - DNA, 1055 bp, Homo sapiens
gtcaaggggcagatgagctggctttggcaggatgtaacctgaagggtgttttctctcctgccttcctggcccatgtaagtctggttctttctcccaaagcacagggacttcctgcttatcagctttgatggaaaattcactgactgcagaagcttattcacacatcagccggcaaacaaattagagctacttaaattttcaagctgggggctgcttttgggcagaagagcagggttttaaagtgctgcattttaaatgtatttcttataatgtgccccatcacgcttctgcctgagatcagtctggggaagtttgccagttcccagtgactcttttccgtgcctcttcagccagctcatgcctggaagagctggaagaggcggacctgctaattcggtctcaggaagcagcctgcgtcagtcagctctgatgggaggtgggccaggccaccggccagaggtgtggggtttgcaggcaggcaggcctggggaaagaacaaaggtggatccagggaggtgagggagccacatgcagcagcaggcagcgtggggcactgggaagggcataaggcttcatggtcaaaggctcagggaagagtcccagctctcccagtttctgttctagcattctgtttctcaatttcctcctcagtcaagcagggatggtgatcatcatcatatctgctttatgtgcatcataaaattattgtgagagcaaaatgaaacattgtttatagctgtgctttgaggattctactatatttgcaaattttagttctgtcatctcacccagagatgactatctatgtatctgtctatctttgtgtgccgtattcccggagtctcgcttctaggctggctcagggcagagagaagaacaaaacgggggtgagcgagacgcccagggccaggtcactctggctgtaaccacgcaaagaccggcccatgccagccaggcggggtgcacaccagctgtaccaggctggccactcagggcttcaggatggcctccccacagcctctccctctcctgcctctctccttcctccacccctg

SEQ ID NO: 67737 - DNA, 1074 bp, Homo sapiens
gtgtctgttcactttgaatatgtcaataagttttaaattaacttgagagtagtgagtatttggggagaagaatttgtgacaccccttgggacaatcaaagatacaatgggacattaccagtcctgagatggaaacccccagccatgccctgtccaggaagccatttgtttgcttcttactcacatgatcggcaagtgcttaatgctgagccaggtaggggaaccaagcaggtgacgagtctgtcccaggacccactcccattctacctagagcaggcgcaaatcggaaaacattggagggtgattgtgtgggccctggcatgagagcaggggagttctgagacatgggttggcacagaaggaggcagtgtgactctgcggacaaagatgactaggtgaggtggaagatgggggagtgtgtggagagtttgtgcagggagaagcccttgtgctgaggacggcgtgtgtggaaggcaggctgaccgttcctatctcattgacgtgacagtggactcatccagaatcagaatcacgtcaccttccactcagagctcccgctccctgacacatgacctttgccttctggctgcccacttcatcacgcccacatcctgctctccctcacagtccctccatgaccttgtgtctgtctggccctccatcttccccagcctagaagtccttctcagaacgagctcagcccatcaggatttcagtgctttcctctctgggctcctagaatcgtgatgtgcaggtttctccatgcacacctgtacccaagcccgattgtccctgccacccctgctcccagctgcctgtctgcatccagcctcccctctgcagccgggccttggtaatccctgagcccagctctcctctgtccctgtcgcatcccctgagcggctctgctgaaaatcttcccacacaccaagactcaagcctatctgccccactttcagcacaactctggggccagcacgagctcccttctctctgtgaacccacccataccctctacctcacctccaggctcaggcctcaacctcaccccgccccaccctgcctccaccctgca

SEQ ID NO: 67738 - DNA, 1012 bp, Homo sapiens
ggttatgttgcttagatgcttggtcagatactagtcaggtgttgctgtgaaggtatttgtagacaggattaacaactacaatgaattgacttcctaaaggagagtactcttgataacgtgggtgggcctcatccaatcagttgaaggacataagagcaaaacctgaggtttcgtgaagaaggaattctgccttaagtctatcacatagaaatcctgcctgagtttctaggctgcctgccttttggacttattagcccccacaatcctgtgagccaatttcttacaataactttccctgtctctcccaatatctctatctctgtccctctctacacacacacacacacacacacacacacacacacacacacacacccccctgactgtttggtgaggattcctctcctcttctggcctccacactgaagcgccaggatgccacgtggctgcctagacctgattgataacagggggccaagcaagaaatgagtgctgggattaacagcttacactaagcagaactgacagtttctacattttttcaacaaatatttattgagtgcattctgtgtgtgagacaccatgcttaggaagtaccaaaaagtcagctgaggggagaacaatcccaaattgactaacccaggggagatatggttagaataagtctgagatgaacgttgttatgtctgaaacagaggagggccttaggaagatctgctgtggctaaaggatgaactggtagagtccaccccaagagcctaattctaaacttacatagagactctatctctaatatcatagtgttaaggtaatgaaattaaatactgggtgttcgttgttttgcaatttttctctaattgttatctgtgagcaaaaatatgggtaatttaatcacatttatgatctataaggatcgagaatgtctatgttagttctatgtttatgaggtcacctgactgatgagttattgttaccaaaaagtgagcatctggtggcaatcaaacctgtgtgc

SEQ ID NO: 67739 - DNA, 1144 bp, Homo sapiens
ctgctttaaatggctggccccaggtggcttggtcactgttccagagctgtgtgagaaggggctcagcgcgaatgcaagccgccgtgacaggcctgtgccagccccgactccaggtggtcactgcgcttctctcccagcacactaacagttcctagttcttaaatcagggcctcggtttggtccgttccatggaggagtgggaggtcagaagacagggccatcgtggcctacctcgacctcctcacccagagcacgtgatagaaaacaccatgtcgctggagagaatgccagtttgacaactgaaaatgccctttgacacaggagcgaggctccactgagccctccggaagcgggcatcattccctttctcagcagagccgatgggtttgcactgagccgcttgtgccctctgaccagtttccttgtgaccaatggcctaaatagccacctggtgtgtagccagagtgtagccaactctgaagtcatgtccacacctagggctcattaacccccagcacacaccaccacagctaagcagctgcagagtgctggcttcctcctggggactgcccaccccaggtctctgtttagggatggtcatgagagcaccttccaatagggcagaagagctgaggcaggagcagggagagcagaccttgggcatggagggatacctgctacttacaggtcacagatagggaaggcagaaggaggcagccaggtgattttcatcccatattcagtctgatggtctctctatacatttctctatatctcacatccctctagtcctttacagattgctgatcactcatgacatattacttcattttatctcacaactctccagcaataggcagagcaggcatgattatccccatatatttattagacaagtaaatgagctcagagaaggcgagtggttttcccccacattctcacagtggaacacagccagaaccaaaacccagctcgctcatggtggtctgccatgtagacatgcccactgagtcagaggatgcccctgttgcttcactcctggggaggcagccagcaagtgttcttggtcacaatggcaaaaggggcaatgggacctgctgctcttgaaaatctacacagcagtggcaagttgccaagttctgtg

SEQ ID NO: 67740 - DNA, 1029 bp, Homo sapiens
ctcagcaggcagtgctgagagtgaggaacacctggtgacctgattctcacactctggggtggctcttctctcattgattggtgacttctctggataaacagttgtcaggtgtaatgtagtgagagttacaagtgcctaagaaattaattaatttatttatttttgaaacggagtcctcacattctgttgccgaggctggagtgtagtggtgcaatctcagctcactgcacctccgtctcccaggttcaagcaattcttctgtctcagcctcctgagcagctggggctacaggtgcgcaccatcacacccagctaattcttgtatttttagtagagatggggtttcaccatattggccaggctggtcttgaatttcttgcctcaagtgatccgcccatctcagcctcccaaagtgctgggattacaggcgtgagccaccgtgcctggctgtgagaaattaatttaaataaagtagaaattggacacacctgactaaaaggtttgtgtcacagaaacacaaactttggcttcctggaggtggatgggatgctttgcagccagcgtcctgtgtgtcggtgggcaggttgtttaacttggatagaccatctttttaatttagaaagtgatggtgcccggctggggaagtggatggcacaactgcctggaaagccgtttcttgacccatcttggggtgtttggccatgggctggacctgccagtcagcatggagagaagggaagcagaaaagcctgagaacactgcgtgaagccagaatgccccgctcttccgggggagccccagtggagtagacagcactggccccatgggctcgccccacccgctgcatctgtctgtcccctctcgaggtgaaagcaggcagggtggccaggaggtgtgccgggaaggggagcagagtgacacctaacagggcattcacaacctgtgtcctgggctctcccgtaacccccgcaggctcggttttccgggacgagtttgatctggccattctccagctgcaggagaacaaccg

SEQ ID NO: 67741 - DNA, 1047 bp, Homo sapiens
attgtagatcagttaatgcctataaattatttctagacagtgttcattctcaaagtgtcctggtttagacaataaatcatatggtcacgtaccatatctactactccatctactgcagccttgttaaaatatgcaacagatttacctgtccacgctctgcccgaggaagacagctgaggagtaggatgaaggatatcatgtgcttgtcttttctgctcagcatgaatgattgtccctgatgagacagtgaatgaataactatgtgattctcagtgtctatacgtggatctctatcttgcaagaagaggtctcaagaatatggatatacggagcaagtattttttataatttaaaggaaatgctgccctcagaggaactgagtgaggccacacacttcttggctcttcactccccaaaggccagagctgaccatggggaaagcagtggacacgaatggacacagggcatgggcagacctcatttcagtctcgtctctaccagttgtgagtctgtgagtttcagcacattagttagcagcactgagccctcattcctttatctgtaaaatgagttcagtaagtaacacactgtagggctgctgtgaagggagagtgaaaaagcacagagcttggctcatccctgggcccagtgtatcacagctgtgactgatctgcaccctagcaccgtgctctgctgctctcagaacttcagggcagtctgattccatcagctgcctgcagaggagttactttcaaggctcagctagccattccatcaatagggatatgctgagtgacagtgaggtatcccagcacatcacttcacactcctgggaataagaaagctctacaggcttaccagcaagcatcttaaggtgacttctggaaacaaaattcacttacttgaagtggttagcaaacaattcttgacacttgccaaattacagttaaatactggggggtgaagtgcggagattacttctccttgttcagagtaaaagaaaatgggggggatgcagaaaaaagtgtcaaggcacttttgtggatt

SEQ ID NO: 67742 - DNA, 1057 bp, Homo sapiens
tcagaatttcctggaagtcttctgttctgtcctaaaaatacatgtgaattttgcatcttactctgtaatacaggcatatttatttaatgtaagaatttttttcccacccaagccctaagtaaaatcagtgtcccaggaagatgccccatcatcatgccacagctttgtcagactcctcggcacaccaacagtgccctggactgggtttgggagcattggcaatagccgtcaaaggttctggggtgagatgtggcacacggaaagctggtgtggtgggatggaattctgagctcttggcggcattcatggtcccaggggatagttattgcctcaggagaaatcaagtcaaattattggctttaagttccaaaataagttcttaaagctcacagcagagataatgtccttggagagcgaggtttttgatttgccagagaagtattttggaatacagaaggttaattcctaataggatctggtcaaaaagttaatgctagaagttagagtgaaaaaaaagagaaagaaatagaagaaccaggccaccaagtctgcaaatcagataaaaggatgccctggccaggacaggagcttctgagcagaaaaggacatgttaaaatgtggttggtccctgcccttctgggagccggagagaggcagatatcactcccagaattagctggatattccatgagttctaaatagatttttacttgtgcaggggctgtgggtggtacatgtggagcagagaagaatttctggagaaattcttctggagagtttggctgtgtaatgggcttgtactgtggtatgacgcatatttctggagtttggcaaaccccagaaatatgtgccatgccttagtgaagtgggggacgtaagaggcggcacgtagggacccaaggcagagggcccagtgaaaggcctgagttttccttaactccagacaaagatattggaaatctaagtggactacggcataagaccagacacctatccccaccccaatacaatgacacaaccgcaaacctgaaatacatcccgggaagaagagggaatg

SEQ ID NO: 67743 - DNA, 1141 bp, Homo sapiens
cccatgagtctgcaacaaagcaggtcacaattgttaagacttcagctcactgttgtctggaaactgggccaagattaagccaacaaatcatcgattcaaacatgcgatgtcatgttctgaaggacagaaggggattttataagctgagctgtaactcacacgtagaccccctcacctctaccctgtgtccctctagaggttcccaggaatgtgttcagtcattaggatgccaggatgagttctgtaatcacccccctgcagcatgagtggatgccgagtgactgggagagatggtgtggagtagacgggaggggactggcatcagtttagatccaggcacttccacttgtcagccgtggaaccttgggcaagttacctaactcctctgcaccttggtttctgtgtcaggaaaaatggaggtaagagtagtgcccatttcacagggtaactgtaaggattgagttaaaacatttagcatgctgactttgctcatagtaaacactcataaaggtcagctttatatttatacagagcattcgctttggaatcaaattgatctagaattcacgttagttatgaaaacatgaacaacctaagttctctgaatttctctttctttaactgtaaagtggggacaatgggccttctctatggtgtttttaacgataattgaatgagatagcaaatgaaaaatgaggcacttgagctcatattttgatggattataagcaacctcccatagctcgtgtttggataaattgcaaaatttatcacatacctctcccatccctcttctagtttgagttccttttgcctacttttctcctattattctctccagaatgtgctaggtctagtcaccagatgccttggtgaatacaagaagaaatggcaaacttaccgtttcaacatgatgaatcactttgaattttctgggaagatcatgtaggtcagtttatatcggggcacataaagttgctatttacaataataagtccctggagatcggactatttgatacacttgcatggctataggtgaatatagttctgaaatagaaagtgcttgaaagccatatggttccaagaatccatgttcttgtccaatgctcttgatgagccagtgtggcacagagcttcag

SEQ ID NO: 67744 - DNA, 1025 bp, Homo sapiens
tgggttggtcggcatcctctttatgccaggacaatcagttagggctgccgtcctgggggccaaatggtaccctgattattcctgtgagggatactcgttttgtcctcacctgacctcactcatgaatttgaatcctttatcttttttctctttaaccatcaaatgacaacaagctgtgcaagacacttgtgtctttttttaaaccttgccttgatcctcgtggagaaacgtggatttggtgggaagggcacccgaaggccagctgacaacaaaccccaatggtgccactctgctccaacctgcagctccatcctatgcttctcacagacaacgtggttcctactgtcagatcacatttggggcgggaagggtggttttttaaaaaaactcgtttttatgagcaggctatcttgatcaatagcaaactttttttaatggattagtgaaataaatgtccccatgcatcatttatagtctgtttctttctccgtgtggaatcaagataagactgccagcactagacggtttctgttagctgctgagaccagggcctcaccttgctcaagctagtgggtgaatttgcaaccagctaatactcttccttggtttgtttccactttttatctgttggttgttggctttcttttccattctgtattttctatctgactctgtatactgtataaagcagttttttcttgtctgtttatctttcttcaactggaatatttacaataaaacagaaacaaatcctgaaatgttagtgatggatgacagctgtttgggtttagaaagtatggttcagtgtgtctaatatccaggtactagacttgaaaagcaaataaaatcataaacccactttttgtcttcccctccacctgccctctctgtctccttctctccacctccctctctactcccccacccgctttggctctttgttcagatcccagaaaagtctaggtggcttctttcaatttttagtcctaggagcctgagccaatccacccccccatccccaaaag

SEQ ID NO: 67745 - DNA, 1413 bp, Homo sapiens
gccgggcccgctggctctgccgggctctcgaggcccgaggcgttcccctctggagccgaggcgcggagggtcgctcctgcagggtgctgggataggacactcggggaagggtgaaagccacatggggcctgtctcgagcagctgtggggatgggagacctgccctggggctagagggaggatggggcctgcctggcctgggctatggcggagctgggagggtcttgggctgggctgggctgggctgggctgggggactggtcccgggttggaggagggcgtgttggggagcctgcccgggttcctgggagaatctaggcgtctcaccttgccccagcgtgggggatgggtagatgcctcccagctgttagaagagggagacgtgtctgggactgctggggaaataggaaacttgtctctgaactactgaatcccagaaaagaggacatgtccccagggaggtttgctgggggaaggacgggcatgtctaggcccttgggacattaggcctgctcttaccaggggctgataaaaggatgtggatgtggtaattgaataagggcttttgggagaaaagatttgccccaaggttgggagactgagaacgagggtgttggactgacaggcgggtgccttgtcgtgggatcttgggggaagtaaggatctgtgtggagcttctctgttgagttctaggtccgctagtaggaagacattctgggaattggtgaagagaggagatttaatagtcttttcttgggacacagtgattccagaagttgtagttgaggaaagttggttggaagtgttgaactgtatacagtcagtggagaaaggaggagctctactgtgaaggttgctaggctacaaagagcttgtaggcaacgcctagggctgttgagagaagttggtaatgctttcaagtccaaatacaggctgagctggggcttgtcccttgttcatgtcatgctgctgtggagctcttacgtttccagtagtctatcttgagcaaagagtatgaataggtgctgaggactaaggaaaacattcactctttgggtcctgagatgcattagacccagatctctagggtggtagctttcaaacttaaaaaaaaaaaaattatgccccacagtaataagtatgtcttacattcagatctagtacatacgtaggtatgaagggaaactttcacaaagcagtatttacccttattatatgtgatatgttctgctaatttctattatattccaccctcttgcattaaaaaaaatgctggctgacatttactaaattgatgatttgtgggtcacaacttgcagtttgaaaaacactgtttctgaagcacatttatttggtgtcaatcagtgtcctcattctgtaagcttctaaagagcagggatgattctaaggagat

SEQ ID NO: 67746 - DNA, 1618 bp, Homo sapiens
taatgttaaatgttgtaatgttaaagtcctttgaaaagttgttacatagcctattgctgcaggacattgagtgtcaaaggatgttgtctaatttcagtaggtacacagggtatgtatttaagaccagtttaatagcgtttctttttttgaggatgagttcgtattatttgtaacatagaattcaaagacacggtcatcaggacagaagtacccaagttaaaacttcatcagtggggccacattcttgatcaaatgctttacgaaaacattctatcatctttgaactttgtgtgttataaatctttcttgcctttaattatttattaggtactgatagaggcgttatgctggcatatatcagccatcctttaaaaatgacctcttaatcagggaaatatttgttttaaaatatttagctttaatgaatgtttaaagaagattttgttttgtaggtgcctggaacattaaggaagattcttatttatttcatttttctgggaatcatatgtacttgtcaataaacagttacggagaagtgaccctgagtgattgtgtgtgctttttaatagtttttgtttcttctctgatccttagactcttaagcctgtccacctgtagcaggctcttttctccttctaatttttgcctccaaactactatggttttgaaaatcagatatttatatttgttatataatacttttttttccttttcttagtgtgtgaactgtgtgacatgtatgttggctacttagagaccagtttacttagtcctgggctgtgttttaaataagtgaactctttatatattttgggcctggttagctgtataagaagtaatgtgaaactgatagtgatacaatttgggcttaaagggtgaaggaatccttatttgcgattgttgcctttctcctacacgtgattagttattgagatttactattcctccctttttcatgctacccattctgacttacttctttggaattagaatggtaataactggactgttcccattgtcttttgcttgcatagcttcatgagagaactcttccaaaggatattgctatgattatttcatttccctcctcaaaaaccattagctgctttccagtacaggcactgaataaagcccatggtgtttagcttgatatttagggccttctacagacttcctctactttttttctggcatcatcattacactcctaaatgcagttcctctacctgccaaggcctctgctcatgtaccttcctttgtgtgtaaaattatccctgaaagtctgcatataaaatgttccctttcttcatgaaatcctactcactctcatttcatttcagatgacccctcttctttgaagtctttgttgcttatgttgtctgtactgcctttgctatattgctttgtattatttgtgcaccttatttttatcccttttagattataaatgcgtggtgaacaggaggctcaaatatccatgaaaaactaggacatctagcacagggtctaccagggcgtagttcatagaccaagtagatcagaattgactgaacgtatggttaaaaatgcagatccggcaaggcattgtggctcacacctgtaatcccagcactttggg

SEQ ID NO: 67747 - DNA, 1776 bp, Homo sapiens
ggaatctaggaatctgcattttatcaagctgtctggatgattcttccatacagtaaaagttaaaagtcactgacctagcctgatgctttaaattacagtaggtactcaaataacttttcagcaagtgatgttaatgaactgagcaatatcataattcagcaaactggtttaattttagggccttgaagtcagcctagatttgagtcctggctctgtcactagctctgggcccgtaacctctctgcttcagttttctgatctgcaaaatgggataatagtaccccttataaaagtgttgtgataactaagtgagataatacatataaaacaacacagtacacaacacataataaacttacaatagattttatctgctgtcatgatgatgcctagcacaacagtggtcaccgcagtaataataaaacatcatgaagagaggttccagatcagtcattgttaacaaacaaattgctcatatggttttaagaactaaggcttaaaatattttctattttacattaacagattgtggccctatgtggtgtttaaagtcataaaggtgtttccgccttctttagaagaattggtatcaaattagcatgttaggatttttccccttcatctccccactgatggaagaataaagtgcaaacttttgaatggtggaccttagccccttaccatctggccctaccaattctttattttctagccgtcttcccacatatactctatactctacaccaactacactacatttctcactttattttgcatttctcactcatttgtgtttgtgcagatgctttccccttcttttcatctagtacatttctgctgctgtcttgtaaaactcagttttacatgtgactgacctccttagtgaagacagtcactccctcagtgttctcaaagtcctttgtccatgcttcttatatattacctttgtgtacatttgtctttttggagggaaaaacgatttaatcctggcatgtattcccacctctgccaaaaggggaggatgtttgtttatttgactcatatcagctcctccatttgtctggacgtctcagctttcacaataataactagtttattgaccacttacttcatgccaggtacttaactagatgcttcaaaaactttatttcatgtagtcttcacaataactgtgaaatggctattaatagcttcattttacaagtgaggaagcaggcatagagataggtaagtaacttgttcaaattacacagtagtcataagtgaactcagaactaactgaagaccatgcttttaatcacagtgctcttctaaaaatgaaatttaaacaggtagcccatttcccaaattcaggatcttaaaactgtgtgaaactttgattaatcactaatcattcttaggaatgtgatccataacaagtactattgtgaaaagttatttaaaactgttcttggaataatgcgtttccggtgattttcaaaatttttcttctcattctgccattggtgagcttcattttcatttcactgtcagaaggtgttgcttcatgtctattgataatgaaattcacttttccatttatccaatgaatattttttaatcatatgccaggcactgctctgcacaaaactgaactggactgacaaatccctgcttgtgtgggacctatcttctgctggagaacaaacactgaactaacggattatgataagtgctataaagaatgacagagggtgaagtgactatgagtgatggtggcagtagtgctatttttga

SEQ ID NO: 67748 - DNA, 1065 bp, Homo sapiens
gacaatgtctaccattgccaggctgctttggcaacatcagatattttgtgcttactcatatataccataatacattttgactacagttccttttcttatgatatcccttcttctctgagtactccagagcctgtatatccttctccctactgattattttagtaaaaaagcctgatacctaatagttgaaattacagaggtcaattttagctgcctatattttgattaatatgcatcataggccagccccttaagtaatgagttatcaggttgttagaagttagcgtgttgtttaatattacctgttttaatgtatgcatgagtccttctcagtactcatcgtctcagatgctggaatcattcagtgtttggacccttagctgatgctaaacagaaaggactctacccaaactcagaaccaaaagagatgacattttgtattatttaggattaggtccagttataggtaactaaaaaattgagaagaacaatggcttaagcaaaataggttacttatctgtcattgaaatttccagagatatgtaccagtatggcagctcagttacatgaagtcctcagggatgcagagccctttcagcaattcgtcccacttttcttagtgtatattccttgggttcattgtctggtggcatcagttttctaggcaacagatggaggaagaaacaaaggagggcaagtggcacactctggtcatcttttaacgatgattcttagaagctgccacagaatacttggtttctagcccatgagctagaacttagccagcactcattcccaaatacagttatccagttatccagttaaaggttcttttactatggaagaagataatggattttagggacagatattaaaggattcatccaaactgtttagcctgatgttcaatctgtaccttctttttcagacctttcttcaattacttatccacatgaatcctatgtaccagccaaaagccttctcattgcccttggttggaagtgatcaactcctcttctaaatcttgtaatagttttcatctgtattgcagatatatgctcaact

SEQ ID NO: 67749 - DNA, 1047 bp, Homo sapiens
atattcaggttgcaaccctgaagcttgtcccacctatgaagcttctgattcagtaattatggtggaaccttggaatcagcatattttaaattctgtcagtgattccgatgggtagctaaggttgagataatggttcatattatgcttatgttcataatagttacatttattaaatgattttttgccattaagttattcaataaataagtgtccactatgcagtagtgaagtaggtaagtactatatctgcttttatagagcttacatgctagttgggggtacgtagggaaacaagtttcaaaaaaatgtgtcacttgctatgctaagcactttaatgtgtatctcatttaatcctaccaacagatgggaactattttccctattttacaaatgaggaaactgagatttggaaagattaagtcacttgtctgaaatcacacagctaggaagtgttggaacctcgtttgaacccaggctttttgactctaaaactaatcctaactactcttttctccttttcttatagcttttacttaccacattgcctggttgtttgatgcttaatacatttgctggacatctagcatttatttcatacttgtttaagctgatccttctcgcagattgtgccaactagtcttcagttttctttattcattttttctgcttatatttatgatgtataaatatggtatattggaaagaaaaatggctctgagttttaaatcccagacgtgacctttgtaactgtaaggccttagtcaaattattagtcagattcctcatttattaaaatgaaagtagtattatcttgcaagttgttttgagaatttaatgaataaactatatcaaagagactagtaccatgcagaccaaatagctaaggtcagtaatgctcattttctttttttcctttttgtctaccaagttgctagctaaatcgttgataatcttgttttccctttcgttatatagttacggattttttttttgtttttgagtaaacatattttaaagtttggtacatctttgaaccaaattgaaact

SEQ ID NO: 67750 - DNA, 1032 bp, Homo sapiens
cataggaaatcttcctttttaccattaagttctgttatgtaccagtcagttatgccactatttcattgaaagattaaattatttgccaaggtttgttgaaatcacttatgtccctctgtgagtaccgtcactaaataataggactccttgatgtaaatggccctttgcctggagaccagctcctctaggctttcttgagcatgattgctatttaacagctctgattactgcctgataatgcttttctttttttctccttaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagagtaagcccagagagcatgagggcgagggagttatgttgccatctgtgttagtacataggagtactgctgatctcccacgcaagaaatactagaactgcagattgagtggagaaagaggttagaaaaacgaagttattggaatgagaatgtgagggtaatctagtagcatttccagtggaatacatgttcagtgttgagtagcaccaagacatgggatatgtcatctctgagctagaaaatacccctgagaagcacttatcactctaaatcaactcagccttactctgttttaatcttctgatatgagaattgagcctcagcccttttctttgggaggaaaagtcatagtatcactaaaatgtgttaacattcagatgattaagtgcctagctgatctgatgggaaaattgacctagtattgttttcaaaaatttaagaaagaaattttatttttgtcaattaaaacatgctttattatgtttcgtttgtccctatctttgtatttacatgtaagtgtgcaaaggaaatttaaagaggctgtagtttctttgactgtctaaatatggaaattctcaaagccctttagaat

SEQ ID NO: 67751 - DNA, 1397 bp, Homo sapiens
aatctacacttttggaagttttacttgtatttggttttagtagtcttagattaatctactttttaccactagtcctggtaataccaggagataccaccagggttccatccacactcgtatattacccctcttgtatttctccttgacagtcaagattacttatcttagctgacaagctcatttttaagtggggcttgtgggtaggggatgatttttcctagtaatttgtagaacttaaattcagtacttggaagtctcagcttccagttggaataattgttgtagcactagtgcagacatgcctttgggttctaaagccgctaaacctaggaatatgaaataagagttttgcaagttagtcactagatgtaatcatgagctgtattgtgtttttcacatttacccttgagtttgcagacctgtctactcttacaaaggataactggtatcacttttgttcttcaagacccgtacttaatgaagagttaaatgggaatatgataagtagtcatcatccagtttttagtggtggcaatgtctttctgtttccttttagggaagtggtgttgcttttgctttagtgtttttgttgaaacagattcacagaccacctatttattctaatcctaaagattccaggaccaattagctattggaaaagattcatgcattcagactattttacttactgttctggccttgctatttatataattatgcctactttcctatgcactagtggttcaatgccactgcttggtctcttccatccttcattaaattgaaatggcaacctgatttcagtgtctcctatctgcatccctgacctgtaaagtgttttcagatatatgggtgctctacttcctaatatattttcaaggtcttggagtaggaaatgtcttctgggtccttttaggatttgtaacggagaacaggtagaaggacatgagtgacacaataataattataatctccattatcatacttattttctttttaatttttttttcttttgaggaggagtctcactctgtcgcccaggctggagtgcagtggtgcaatctcggctcattgcaagctctgcctcccgggttcacaccattctcctgctcagcctcccgagtagctgggactacaggcgcccgccaccacgcccagctaatttttttgtatttttagtggagacggggtttcaccatgttagccaggatggtcttgatctcctgacctcgtgatccgcctgcctcggcctcccaaagtgctgggattataggtgtgagccattgcacccggcccatacttattttctgtacgtttttccatataaataactaaagccttgcaattattttggtgttttgtaattaaccctactgagcatgctgttatctgagcta

SEQ ID NO: 67752 - DNA, 1751 bp, Homo sapiens
ctatgtgattagtcattttggcaataaaagactttaaagaggatccagagattcacatacctgttttcctatcccaggatgaaatgcaaaatctgaatcatttgaatttttatgatgaaaagagtaaaatgtttaggagactgaagggagacatacttattaagagctttataatttcttacaggtgctcaattatcctttttattgccttctgataggtagagctggaagtttagcctctctgctctagctgcttatggcaataatggactaacaaaaaactgagcaatcagccatatgtctcatgtttatttactttgtgaaacaagagaagaggaaaaatctctgttttctgattcttggcctttgaccatcatactgtttgcttttccagtcaatggactcttttcttttaaagccgtcatctgtgccgtgtttcttagtggcttatatagcagtggtgtgatatgctgtttccagataagttcagtgtgtactgcaggtagctggaaagatgtccttactgggctggtcatatttcagttattagactctcaggccttaccaggagaacttctaggaaataactctagattctagctgggtttcaaaggacagtttaatttatttactgaatacctactaaggaccaagaggcactgggcttcaagctagagataaagagacaaaaacagtagtgtctactctcaagaagctaagctagagatatatttcctttgctgggccctcttcatgttcccaacctctaaaacttgagttaccccaggacttagtccttggacctcttctcttctgtactcatcccccacacacttttagccagtcccgaggctttcagtgctttctgtattctgataactgccagatgtatacatgcagctgtgatctgcctctaaattccagacggcgctttccagctgcctgcttgatgcctctgcctggatgtttaaacctagtgtgtccaaaactcaactttcgataccctcccttttcccttaccctgcctccctcacccctagccccctgtgccatagctactgctctgccagtttttctccttttttcaattattccagttgctcagggaaaaaacactggagtcattcttgattttttttctcccacaccccacatctggtctgttttttttttctttcagttctactttcaaaacctatgtatagaatctgactactgcttcctatcattttagtccaaatccttcatcatatcttacttgtgttattgtagtagcctactgaccagtctccctgagtccacccttgctcccttaaggcccgtgcatctcatagcagcctgtttctaagaactcaagttgatttttaaaaaaacaacagaggctgggcgcagtggctcatgcctgtaatcccaccacttagggaggccaaggtgtgcagatcatctgaggtcgggagttcaagaccagcttgaccaacatggagagaccctgtctctactaaaaatacaaaaaaaattacttaggcatggtagtgcatacctgtaatcccagctactctggaggctgagggaggagaatcacttgaacccgagaggcggaggttgcggtgagctgagatcacaccactgcactgcagcctgggtgacagagcaaggctccgtctcaaaaaaaaaaaaaaaacagacaaaaaacagaaactgtccttactgttcctgacacacttcaagcacactccctcctcaggcctttg

SEQ ID NO: 67753 - DNA, 1002 bp, Homo sapiens
aggtcatctttatctttctcctcacttgacagggaatgcatctaaagtttcaatatgtagatatgaatgctgacttttgctatagggttctgataggttcaggtggtttctatctctatttttctaagagtttcttttattacgagtagacattgaattttgtagaatgttctttttgcattgagatgagcatattttcttctgtaaattttaatatgatacattttcaggtattgaaccatttttgcattcctggtatattcaacttggttgggaaatattaaattttctttttaaacatgtagaatttaattttataatgttatttgggatgtttccatctattttgatatgtaaaattggtctgtaattttttgtggttcttgtctggttttatgaaggttgtactagcttcaaaattgaattgagttcgtgatttcatattttctctactaagtaactgtttcattcagatttaaaatttaatagtcacttacgatttgggggtaggtgttttaatttttgaattgttatatttaattttcatttggatgggcaatacttccacatggaacctgattggaaattttaaaaaggatgtatactacaaagtaagtcttcttcccatttgtatccttagtagctaatcaagtatttggcccctaggcagccactgatactattttcttgttatagtttccatcgctattttgtgcgtaatttttgtacacaagtgttcacaaaacaatacattctgtactctatgttttctttttcatttaaccatagatcttcaatagcatctgtgttgagggtctttgtgattttaaaaatgtactatatcaatattcatctttttattcataataatgtctatttctgcctttccattttttcttaatcagccctgctaatgactatcttttagtagtgtcctttgtttaaagtcagattgattgaagtatgtgacataaattttaccccttttagtgtacattcctg

SEQ ID NO: 67754 - DNA, 1016 bp, Homo sapiens
atcagggtgccagcatctggctgtggcttttctactgtatcatcccatgatggaaggaggaatgacaagagagcaagagagggctgaactcactttaccaggataacgggtggactccctctataacagcgttaatctattcatgaaggcagagcccttgtgacctagtcgcctctaaaaggtgccccctgtcagcactgttgcactgggtattaagtttccagcacatgagcttggtgagggggagcacattcaaaccaaagcactaggttaggtataataattttgggccattctttctgattcatttatttgggtctgtggtggtggtggtttgctcctcagtttgtttctttagctctacagtctccattttcatctcattctgcagtttatcatttgtctttgagcgctggtttttatattcaagtacttactaatttctagacttttgagttttgtggagtgttttctttttcttcagttgtgttttctttcaaattgagttctgcctctgtcttttacttattatgtgttcctctcctttattctttttgctgtgatatgcgctcagttgccattttgtgtctcattatcttgcttgtgcttgaagtggtcacttgtcttcatgtcatctctttgttgaaatgtagtatgagtaaattctctttgtccactttgacattgtttcttttgttactcctaggcaaaatttgagagctagggtattacaattttacttttccatagtctgaaggtaaaacatctctagagttgggttcagttcttatttgaccactgggttctgctgtcttttctgagattttgttaaattttcataacctagtttcagttatttgaaggcatatactaggatatggggtggggaaaagatacccctagactttgaatcatcttaccttttcagtttagagccttggaaaatttcaagtcctggcagctttgtctttgtttgttttgctttgttttgttttatttgcctttgctaaaatcct

SEQ ID NO: 67755 - DNA, 2101 bp, Homo sapiens
tattattatttttctaagatggagtctcactctgtcacccaggctggagtgcagtggcacaatctcggctcactgcaacttccacctcccgggttcaagcgattcttctgcctccgcctcctgagtagctgggactacaggcgcgcaccaccacccctggctaattttttgtgtttttagtagagacagggtttcaccatgttgaccaggctggtctcgaactcctgacctcgtgatctgcccaccatggcctcccaaagtgctgggattacaggcgtgagccaccgtgcctggcaatcttatattttttaatggttgtgtgtgctttaaaataagcttcagagcagcagtattttatttgtttatgaacatagaatttacaaagtgtttactcatttgttattttatttggttcttatgactgtcttatacagtaggaagggcagaaattattcctaattttactaatgaggaaattgagatccaaaaagacagtgagttgccaagtcacacagctaattataaaatggagtcaagaccctgaagacagagccagggctatttttacatattccctgttactccacttattggaaatgattacttccatctctaagcacagcaatctttttttttcttttttcttttaagaggtgaggtcttgctatgttgtccatgctggtcacactcctgggctcaagtgattcttccccttgggcttcccaaggtgctaggattctaggtgtgagccaccacacctggccacagtggtcttactgtatgtttaatgcacccacaaaccttattatgacactgattttaactgagttaaagctgaaagtggtgtggaggaagtagggggataattttatgtgacttgtattctgatccttaattaaagtgacttcgttgtatcttggttttaataaaactaatattaatttttttcagcattttttccctttctggtacgtaggaaacttgtaagtgtccttgataaaatcagatctagatcctccagggctggcagtgcagacaagattttctctatgggaaacatgactttgtgggccctattctcatctctgtaattcactttcctcttggtatcttttcctttgtattccttccttgatcaagaaacatgtatcccttacttaccacttttttccaagaatgtattcttaattcttccataaattctgtgtattacacctgaaattagattggaacgttcaaacaaggcatctctgaaagagcttggttaattagtaacaaagaactacatgtttttgtttataagttatggcttctccaggcctcagaaactgctggcctccttccatctttccatctattcccaaggggtacatgcctagatacctgcccttcttgatgatgacacccaagaaagcaagttctacagagagattgaacttctattgtctttatagtgtctacttttctaggttccatttttttcctaagcctgttcttatgtaataattgattaacagtaggcatagtgaccatcttcaggaaaaatgattccccagttttactgtggcctccctagggcactcatattagatcacagagtccataggagtcatgtgatagaataagattttttaaagatgttgagcctagtaatattgtttatctgtagttgggaagaagtccacagtacatgtgctagtagtttaagctgacagtgttgtttttaatccttctaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcag

SEQ ID NO: 67756 - DNA, 1034 bp, Homo sapiens
aagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacagatgggagacttgagagatacttagcataactggggcagaaagtgtgtaagtgaagtatttttcaaagaatgcagttattatctgattgcatttgaccttttgacctttgttacataattctacccctcctacaaatttaatttttttatgaaatttttaggtgacttgtaaattcttcatgtatgaggagttgtgtttattaatgctactttttaaattttcctgtgccatgtggcagatgtttattctcttaatgcact

SEQ ID NO: 67757 - DNA, 1015 bp, Homo sapiens
caaatttaattggaattttgccagagttgaaaactacaaaacaaagattcataagaaacgtgttatggcttttctgttagcaaaatcttatacttctgacatgctgtttatactccttttttatcctttgaggataaaccctctcgagatatttggcatcaccttttatgagtaagattgaaaaatctcatttgttgaaattaaaatttgccagttcttattcaggggctgcttttttccttagaaaaatagttttttataagtattagaattttgtacatttgaaccctgcttgcttatcaataatttcttggtaagccattatgaattaaccttgcaccaaggattaaagtctaaggactatactttatatctgtatttaagagacagagtccattcacttctctttcaatgcctcagaaatacataagtatcatgacctgtttaagattatttctgcctgctattcaaatttcaaagaattgtaatttaagcctctgtgctacattttatttaattactatttagtatgagcttcttttgagttcctgcaaagtagacatgtatcaagacatccaattactattggactggaaaatgctgtgacttcctctagttattagaatgcatttaaaacaagaaggttgacttctgaagtcacatttctctttcagttcttctctggaaaagaagttcctgtttggtctttacaacaaccctacgaggtcgacactcttatctccattttcttactagtgaggaagttgatgcacagataggttaagtaataccaaaagtcacatggctggtaaatgacaagaccgggatgccaacccaagcagtttggttgcagaacccatgcactgacagctgtactgtagtgctgactgctaaagttccccagcacacacctttattgttagtcttccttttcatggaaaaactaaaatgacatgtcctcaatatccatttactaaattgattggctctgtaacagaatcactgatgtggctga

SEQ ID NO: 67758 - DNA, 1133 bp, Homo sapiens
tagaatccaaagaaaaacaaataaatgtgagtcatttggaaagaagcagtcatttaacatctgtaagtaaatatgtgtggaggattcataataccagtgagagaataaacaatgtgggaaacctactgaattatcacaggtttttggaaaaacacggagtaatttaaactaaaaaaatttagctcgccaagcactcttgtccattttaagacaacatgcttaaacccagaattatatttcttttgtacagttggcatttaaatgtctggtcagagaaaatttgcagtaatttttaaattcccattgatgtgcagaagagtttttttttcctgctacagtcaagttacttctttcttaataaattccatttaaacattttgaatagtagatttagcttatgccttagccagttttgctcattccacatctactggatgcttggaagcatctaaccgagcacgttttcctcttattcacatgccttttaaactatttacttactgcaaattttttatcagaaggggtttatctcccccctctgcctccagtgaccctcactgggtgttagggaaggtttccaggccacagtttgagatttcccttgtggaagatcgtgtctagcgctaggtcccttgttagattttgcctggaaagtgccctgtcctatctcctgcagagcggtgcatcagagagaaaagagagggcataaaacctaaaaagtttggaaattttctttaaatacttcatgcatacctgtgaaaaaatagagtagagcctatctgtggcgactgttgaaaaccagagaaacaaaaaaagactttaatagaaaaccaacttcatttaaatgttggaggcagctgctttgtttggagttttaatcccatgctggtggatgctaattctgtaacattatacagttgccttcttttgggtacaaaggtagaaggggggttttcttttgtgtttttcagtgcaaagtgattctgatcagaaaggcccaaggtttcagctccaagtacctgacatttccatctgaatctactttttttttcaaaggggaaaaaaaaaggtctagtttttcaggaaaagaacctctctacgcaatcctgaaactgatctttagatttactttt

SEQ ID NO: 67759 - DNA, 1043 bp, Homo sapiens
aatatatggaatgatgctcaactttactcataataaggtaaatgcaaattaagtatacccgagatagcccttctttcttgatgaatatgtgaaagtttgatgatatcccctgctagtaagattgcagagaaataggtaaggtactgtcctacatcgtttgaggactacaaagtagttaaactcttatggagagcgatgtagcaatatctaccaaagttatgagtgtataactctttcgctcagctcttcttttagaaatctgcctaatgagggcctgtcattgtagcattatttgtaatagcaaaaaatggaacctatccaaatatctagatatgtgttaagtaaacacctatataacagtgaattagacataattcagttgaactcacagaaatggacacaggtccatagtccctagtcacaatttggaactctggaaagccctgtaaaaccaaaaagttgttttctttttgctttaagttcggctctcaaaatcatttgatgacaaattctcactccatctgaccgaggtgcccattgtgtcttggcacacctaccaggtattcctggtgttttttattgttttgttaatttgggtttaacgtggcagtgtgggaactaccaccacatgtgacttaaagaatagaaaaacagatcgtggacgttttatagtggtagtaaggactaagaattgatgaaaaatagggagacattgcagaggactgaaaatgaagattctaaccatgtttcggttaagtggatttcacaataggaagtaaacagatgccactcattgctttgttgatgatggaaaaagctggcatatatgaagacctgctactgaaggatgtatttagtattaacaaggaagaattcagaaacttaggaagcagtgtggtgaaaaatatctaaaagtatgacaagagttaattgaaaatttactttctagacagctcttttatgcattctcctcaactgtaggttatagtttttaatcatttacttttacttcactgtgaccagaatacagcctttttctttgg

SEQ ID NO: 67760 - DNA, 1065 bp, Homo sapiens
tgggagtgtcagaagaacagatagtcccaattctatggttgtggtggcagcatggatatcttttagggaatttatcttaggtgtcagtgctgaagcaaaaatctctgaagtatgaatccttgaaggagagagatgagctgaaacttgtagctgaaagaggaaactatttgtctgagtacctagtcccctgcattcccatctttaccacttgccatgctgccataggacgcggtagggaatgacactgaaatggaattccatctgggcttgtgccacttagcagcttgatgacctttcctgggcctcagtttctctaactgagctttagcatccccatacatagtatgaagagattggactagagatgatatctaagatcccttctggctctaaagatggcatgtaggggattctgatagcagcagatgtactgcatatgactgttcttaaatcaggaacttgagatatagtgtttctgaaaaatttttgcctggaaaaatagagacatggtaactaattgtcacacatgcttattttttaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaaggtaagaaatgtttttacctattttctaacgattaaagtaaaaataacaatatgatatatttctgagatttttagattaagctgattatatgtaaccattaaataaaattttggagaccaaccacaaatgggttagatattttcatgagggttaatccctgctctccttcccttagtttaagcaaatctaactttttaataaaactataagtctagtatcgtatcttgctagatgcatattggagcatttttatgctgatattgatgagtaaataaatgcatacatttatgtaattattttaata

SEQ ID NO: 67761 - DNA, 1050 bp, Homo sapiens
tcacaaactgaaatgtgtttttttaccatgttttgttttttggctagataggggattcaaactcagtagttttaaagttgtttacaatcatttttaaatttcggttgtttgtacttgtcagtgactccaaggactgaacagcaaaaagaaaaaatagagaggattggggatggaagttaattaggaaagaaatggttattccataaatagaagtttagaatgcagattttggaggaaggaaaaaaggtttcagaatttgaaatacttattgcattttctcagtacaaaaggaatgattttcttacatacctatttttatgtatttaaaattttaatagaaacagtttggaggtaagccccttcatgtaaaagagattttaaaaatccagtccagaacagttttatgctagttttgtttaacatggattttgtgatttttaagtattggaaatttcactttcagaatcaagtccgtcgagagattaagtttactgtccaggcattgccatggataagtattcttactgttgcactgttcttgctggagataagaggttacagcaaattacatgatgacctaggagagtttccatatggtaagtaaataacacgagtgtcaggaagagagtagtctaagcacaggttagtttccttaaaaaaacaagtctgcccttttttttttcatcttttaaaataattacaaattattcagttgttttttaatgttctattttcatgtgttcatgtcttgccacatgtgcatttctttagtttttctatcaatctgaaagtctgctgtagatgagattgtgtctggcggaagattggagtgatcagagatgggtccttgcatttgttttctattaattattgaattcaaccttctaaaaaaaacttgagtagcttatgtcattgctgaaagttaaaaacagatttttaaaatgcattattctgcttcttagaaactgtaactcttctggcatacaaccacccacttttctgtgcctgtatacttcattgtttacattacacaaatgaagtcctgaggtg

SEQ ID NO: 67762 - DNA, 2773 bp, Homo sapiens
gattatgagttaaaataaagggagagaggacattttaggttcttgaacccctatgatgaaagatacagaggtaaaacttccaagacagtgggaggacattgagtaaacctgcctggttagagtagaaatacaggagtgatgaggttggaaagatccgaaaggggtggagtatggaataaatgctaaatttaaagtatttagtggaaagtatattttaagcagggagataatgtgtaaagatgggttttaggaagattaatatgaaggaagtgatgattcccagagatttaaataataaagatgtcttaggagtatcctgtctcacaaatatctttatagtttaattaagaagtactttaggtagaacatttcaagtacttatgcgagggaaatgaggaaatgaccagattccaagaagccaagagagattagtttataatatactgaattagccagaacagatcatttataatgtttgagtctaggatcccattttgcactcagatggacatgtgaaaagtgaactctaatcccaggagctgagttttgattcttctgtttcccgttttcttttctaggattgtttgaacttgtcgttagtataatatctttcctctttttcactgacatgttcatctactggattcacagaggccttcatcatagactggtatataaggtaaagtcatttgtggtgaaaagagaaaaaaggttacacatttcagcaatgtatgattataaattctgttctctatttccaagaatttcctctacccatattaaatgtctaagtagccataatcataacaggtacagggtgcattttgttcatattcttctttatgggtctaaggggctgtcttaaaattcgtctgttccggtaacaggtacacatggacttacagagggaacaatagacattagagactccagaaggtgggaggatgggagaggagtgagggatgagacgctccctattgggtacaatgtgcactcttcaggtgctaggtacactaaaagccagacttcaccactgtgcagtatatccatggaacaccactgcacttgtactcataaatccatataaaattatactgttttagggcgaagaaggacattttatagaataaataattttgctgatctctacaggatttgttaggttgtttccaacatgagtgtgagaagctaagttgaatgttgcacggggtaaagtttgcagtgctaattgtgtccttttctcctgcagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaa

SEQ ID NO: 67763 - DNA, 1071 bp, Homo sapiens
attacccagttgaagatactttgttaaggcagtacaaatggactaagacaagggggaagaaatttgcattcctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccactcatccttaacaaatgcccaagccatggttaaagttcaataaatactttgttgaatttattaataaaatggcagaaatgtcattctcttccatatatgtttaataaatccctgataggtgctaagcactgcactaggtaaaaattctcttctgatgctgtctttttggccaaccatttttttatcatttattcattagctgacatttgctaagtgctttggaggggtcaaaaggggaagtaatgagaaatcaaagatggtccctacatcaaggataaactatctttttttagtcactcaaagtcataaccctttggaaacaaaacccaccagtaccccagattttgaccacagatgaatcagtactacaaggactggttagagggttgaatgaatctgtatactcagcacttaacacagcactctgggtaaaagaaaaaagatcctcaaagatattagttggttacatcaagaaaggacaaacttaggttaatctataacttcatctcagaggaacaggaactttggagataaacagggctctgccacttgcaagttgcaccatccctggtttctccatctgtaaattgattaaaacactgcctatctaataagattaaataagttagaagcattcagttaaatgtcaactgaaactattgttcatgtaaattgtgcttgatgctttttctttctagattcaatgattattgtcattttacctccataggccctcaatagaaatcagttgcagagggcagaagcctagatattttcaccttaaaattggagggtgaaagacattgaggtgaagtagagatagagggtacacagaaaaatc

SEQ ID NO: 67764 - DNA, 1004 bp, Homo sapiens
atttgtaaattccaattatcctgaacatttaataccatttacatattttattaatcacattttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtata

SEQ ID NO: 67765 - DNA, 1043 bp, Homo sapiens
cttttaggaaatttacaatttaaggaggagagcaagcagatgcagatacaggcatgtcaatgtaccaggatgggaaccaggaaacatggtcacaagaaaccagccacaactctacaatggtgtgataacgggctgtgtgacatgcagcgcatgggagatggagagataaggggtggtgggctcagacactgtccagcttcttgccctctgacctttgagtgaggttaagaggacactggcagcacaggttagggctggaagcagaagctgcctgaaggaagcaggcctagaggcgatgttaaggccaccaccttcagggagaagagaagggaaggctttctaggggaatacttgcatctgagaaagagccctgtgctggagtcaatgtcggtcctttttcctctgcttcgctaatgtcttgggtaaactaggcttggttattttgaccattttcctcctcagtttctctaaggtggggagaccggcttctgccatgattacttaaaggcacatttatgatactgaaatgtgattgtaggggtgaaaataatttgctggcagatatcaggacttttctgcccatgttcaaggctcacgcctgtaatcccagcactgtgggaggccgaggcgggtggatcacttgaggtcaggagttcgaaaccagcctggtccacatggggaaaccccgtctctactaaaactacaaaaattcactgggcgtggtggcagatgcctgtagtcctggctactcaagaggctgaggcaggagaatcgcttgaaccccggaggcggaggttgcagtgagccgagatcgcgccattgcactccagcctgggggacagagtgagactccatctaaaaaaaaaaaaaaaaaaggcaaagtttagaagttgagccccttcttaaaggccaggtccaagaagagggattccctaattcatgccacactgaatttcctcctgatttctcataagctctgtctgtctgcgccatcatacctgctttttcctctgcctgaaatgatcttccccaactcttgtcct

SEQ ID NO: 67766 - DNA, 1039 bp, Homo sapiens
attacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggactttcctatgcattttctaggtatgccagacactgttggcagatggtatagtcagtctagccacgtacatgcaaaaatcaatttccctcaatttaaaatgagccacagttaatttcgacctaatttattggcttatcgacctgtgaaccctgggccttcgaagaagtggcatgggcggccttcaagcgctgaagtggctgatgaagctaaaatccagaaaaggcagggtgggctgctgagcaagatcaagatttgagtttcctcctgtgttattgtgagatgctcagttttttttaactgtaacatgaccaatgctttgtgcattttatggtgggttccgtaaaaataggactgcgtaacgatcacaagtacactagtgtgttaaaaaataattacaaagttctgttatccactgggtaactgtttattataatggtaacatccatgcccatagcactgctactagccaagagctggaagatcctatcttcctggccgcgtcctggaccctccgatgtggcactgttcaatagatctttctgtgatagtgatgttttctatctgtgctgttcaccatgttcactagtcagatctggccattgagcaggtgaaatgtggcaagtgtgactgaagacttgaagtgtctttcatttaattttaacgaatttaaagttgaaatagccacatgtggctcttggctactgtgtagacagcacaagctttgacaaggcctcttcttcccacctgtaggcaacctctgcttcacccaagagagaagttcctgcaaagacctgctcgtgtaggcagggcaaacagggcaataaaagcaagagtggagggcttgggtctagaccctaggtattggtggctgctgactgc

SEQ ID NO: 67767 - DNA, 1029 bp, Homo sapiens
tcctgcataagcctcaacaactatacagatttcggtggttttattggaaacttctcatcattggcttagacttgcaaccctaattcccccagaagtgctctgtgtgagctaacaggtaagaaatgattaaagagcctacagggtgcctggcacctagcagacctcagtgcctacttcatccgcaagtgaacgcatgagtaatcagtcccttcatccaagccattgacttcctcccctctatttataacaacccagaacttgaggactgggtggtagcaggtccttcccctcactctgaataataggaggtgaatcatttcacctctccgggttgccagggcacgcagggggctgagggacaacacttgtggggtgatatggacttgttcgatgaagatgccgaggcgagtcaaggtgtgggtggcatccactgttgtgagctggcggtggatgctagccttgggcctgcggctgtttctccagctggggacagggaggcctgtgcggatgctgtggctctgcagatgccgctgacagcactttgaaggattggtttggccagagacccagtccacagcctgcctcctgtatgactcattctagctgcatattttggtagcatgagggcttgagatgagataaaaggagcacttcttaagagtggaagctcctaggttcttgattagcacttgagaaatataatgttctctgcaggtcctagaggccttaaaaaaatttgagtatatttcacattacataaaattagccattttaaagtgaacagttcagtgaacttaatatcgccgcaatgttgtgctaccatgatttccaaaacatttccatcgctctgaaataaaaccccttacccattaagcagtgattccctcctctccaatctcccagcccctcgtaaccactaatcagctttctctccctatggatttacctattcgggacatttcatataaatggtgtcatgcaatcatgcaatatgtgaccttttgtatctggcttctttcacttagcata

SEQ ID NO: 67768 - DNA, 1049 bp, Homo sapiens
aaagaaaagaggactgcatgggggccaggccgatagtggccctgatgacttctctcacattacacctgctggaactcagtcccaggccacaccttctgccccacagcctggaccagagtctgcggtgtcctcaggaagcagaggaaagagattgagagagtagctagtcctgtttttgtgatgtccttacttggcagaatagaagttgccaaccagtcctctgttggccttcctcatttttattttatcggtttaccaaatctaaaagtctgagaactaaaatatttccttatttgagacctttcaaaaataattttgaaaagcttcacaatgatacttctctcatttctcattaccagctgaaagtgaatgacagtaccaccaagccagaaaaaacatagttggaacagaagtttgaaaagcatgtgatctttctggcctatgaattttttttgaacaagggcaatgtttccatgctttggtttaaaatcttaccagtgcatgtcatacatagagtaaggatcagagtaaccagagattggtatcataaaggatgaaaataatcaaaggaattggttatgccaatgagagcccaagaagcttttctacaatctctttacatccaaaatagcaggggactcatttctttgtggggaagttgagtgtgacagaatatgcatgaggtgggaggggaagaggccaccttggcccaaatgctttagatggcagaatcttcatcatttctgcttgacaaaggaggaaagagtcttgatttagaatgtgtgtggccatcacttatcgtgggtcctaattcctacattgatctctttcaggttagtctgaatgattcccacaatcagatggtggtgcactgggctggagagaaaagcaacgtgatcgtggccttggcccgagatagcctggcattggcgaggcccaagagcagtgatgtaagtgttgtgttggctctgggcacaccttggtgccatcaacatgcccttttctggtccactgggattatcatactggaaaaagtagtgggtaattgg

SEQ ID NO: 67769 - DNA, 1035 bp, Homo sapiens
tctcccatttttcttgaagtctgtggccttgttggacaatatatgtcatttccacttttgatggagatgcacattcaagaaacattctcccatatcttaatttgaacatactaatggatacttggttcctgtgttggagagacgtggggaaggggaagggcctttggggaccgggagaagcatgcttccgaggagcattgactgtcagctccaggctctggttgccgtgcaggatgctgggcccagtgttgccacatcttctggttttccagaggaacccagaggtctggagtttcatgtgaaaactgctgagtcttacaagttggcagccagtgtatagtttttacagacaccgcgtgagccaggtaaaacacatgtaagggccaaagctcgcccaacggctggtcccaggtctgcggcctgtgctctggactcctccttgtgggtgagaggagcagcccctgcctcagcctggggtctgacactgtggcagcgcgaggctgcagacggaacaccatgctttacagcttcggtcaccctgcattctggccgggggaaccttctgatgaatttgccagcactttcacactagccttaaggatacatttataattcttgaatgcggatttggtctctgtgaggtccctctctgtatatccactgtctgggttgggtgtgttgagaagcaggtgttgggaagttgtctcagggactgtttccagggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggcctgctcccatagccccagctactcagcaggctaaggcaggaggat

SEQ ID NO: 67770 - DNA, 1029 bp, Homo sapiens
atctggtaacatctgtcatttcctatcaggcacctaatgggagccacgttcaggatccaggatgggatgtttgaaagagatctttctgcttgggctcggtggctcatgcctgtaatcccagcactttgggaggccaaggcaggcggatcacaaggtcaagagattgagaccatcctggccaacatggtgaaaccctgtctctgctaaaaatacaaaaaaaaattagctgggcgtggtggcaggtgcctgtaatcccagctacttgggaggctgaggcaagagaatcgcttgaacccgggaggcagaggttgcagtgagctgagatcgcaccatggcactgcagcccgggcaaaaagagtgaaactcagtctcaaaaaaaaaaaaaaaaaaaagaaagatctttctgccagtttctcaccaactctttctttttcatctccttttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgtagcatgactggtggctagtgagtttttgtgctaacctgggcatttgtgacagactgctgttctcagggttggtctctgcacaatcaggcaggccaaggactggtcaggcaggatttctagacaaacaatgacaggttaaaccacagaaaatcagccaactcttgtaataccttgcccgacttgcagatggcaaaaatgtttcccaggtacactgagaataaccttgcaatcaaattcatgttttctaggatactatcagtgtgtctgcttgcgtgcttatgcgtgcttgtatgcgtgtgtgtgcatgtacgtgcttgtgtgcgtgtgagtacctgtgtgc

SEQ ID NO: 67771 - DNA, 1302 bp, Homo sapiens
gcaggcaggagacttgggacgtggggagggagaattgggttttgttgggaaagttttgaagaactcaagttttgcgtatagtaaaatatcttggcccatcaaaagtggagatggtgagaaggtaaacaaaaatggaatctctgtaagaattgagggttagactgtagatttgaaagtcatgccatgcttcttcttttgtttttgagacagggtctcacttcatcacccaggctggagtgcagtggtgtgatgtcggctcattgcaacctctgtctcccaggttcaagcgattcttgcacctcagcctcctgagtagctggaattataggtgcacaccaccatgcccagctaattttttgtatttttagtagagatggggttttgccatgttggccaggctggtctcgaacccctgacctgaagtgatctgcccaccttggcctcccaaagtggtgggattacaggcatgagccaccccgcccggccccatgcttgttcttaagggcggtggttgaagctttgtgaaaggataagccaaagttagcagcaaaggatggaagaagaatgaggttatatgagcgtagggagtggggaggaccaaggagccagcagaggagaatcaaggcttgagatgatcaggggctggggatggagaggtgaaatgagagggtgctgtggattaggagagaaggcacacaaatgagttaaatggtacaaggtaagacctatgaatgaagttcaggaaatgttgccgttttgttaaaagagctgttaaggggtgagatgtgaacatgtgaaccagtcagatattgacgtcaatgctgcctagtcctgcgtcaccttgggcagtaaactactctcagtctcagtgtcctcattattaaaagagtgtataacggtaatatccaaagcattgagtcactgtgaaccctgaatgagatagggcatgccaaacttttagctcagtgcctggcatataggaagtgctcttgaaaacgtttagctattaccatggacaataatacattctatgacggggtgcgtgatttttggattctccaatgtgagactgcaggaagccatggaacagatttctggggaaatcttttcaaattgaggatgcttccttccccaataacctaggtggtttgggagcaggaagatggactatgttatttctggggaatacttttatgccagaaattatgatgatcctcttaggatcataattgttttttataacattgcattttattgtagtttttgctttcaaaacatttactaccttttccagtttgattt

SEQ ID NO: 67772 - DNA, 1006 bp, Homo sapiens
atttgttcataacattttcttgaatgtctgttaaatataaaacctactagattcttaagggtataagaaattgaataatttatggatatagttattaaggagaggtaaggaaagacatttcaggtacgtaacacacattgtgaaagaggcacagaggtaacagacatagtatgagaagctagagagaggatttatccttccagatgggaggatcataaacagctgtgtagaggaggtggcccttgatccaggatgtgcacaacaggtaggatgtccctgtgtggaggtgtggaggacaggaattccaggcagaggaacaaagtgacttgccaaaggcacagggatgcgccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatcgtaatttactattacagtgataaagtagtataggatcttgaattatatgaatttgtacatgtgcaggcaaatgtgtaggacagatttctaggagtgggtatgctgggtcagtgggtttatctaacagctatccattcactcacatggatgactgatagatattgcaaacttgacccctcgcaaattgactcttgatcttcaccaccccaaatcagctccacctataacttttctcatttgctcaggccaaaatctttggagtcatcgttgatttcacatttgttttatgctttacattcattctatcaggaaatcctattggcttcaccttcagtatatatctagaatcttctactcaggtaccacttctagtgccagcctccagtgtcattgctcattagtctcccaactagtctttctgcgtttactcttg

SEQ ID NO: 67773 - DNA, 1033 bp, Homo sapiens
gggagttaatgctctaagaaaagcagtaattaagcttccagctgtcagtaagtagcttaactctcagcctttgggaaaatcttccccttgatttgatgtgttggagccagatgccgaaatggtgggcttgctcattcaaaaccagagttgattacttaacaggacttgtcttgaaattgtattgagttcagtctttatcaccctggttgtaaaggaaaaaaccaggcccagtcaagggcaggtggggctcttatttctgggaggctactagcttgctttcctgatggtgcccttcccttgttgactcagggtctgttgaaggcctttgctaactgggaggttactctgttgtctttcactgttaaccttagagactgaaatcagacgtaatcttttccttcagattctcatttacttctataattggtagcaggccaggtggaagtaggtcaaccttcttagtaggattttagggtcaagagaggatctccccagcaggaaaagcagggagtaaggacagaatgagaagagagatgtgggtggctaaaggctagaggcatttccagttacataccttgcaaaatgttctgaaaaaccattagcctatggcagtttttcttgtcaggccatttgcattgacccatagacattggttcagtgccttcctgccttgactgtttctttatctttctcttaaacacacatgcacaaatatgtacagcagcccagaaacataagcatcctcgaatggctttgggcagggatggggtgatgggaacacacagataagaaatcaggcccaagcactggtgccttgtgacatcagttggacagtcttgagttttcagtatggtctaaaaccttgtcttcagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaa

SEQ ID NO: 67774 - DNA, 1128 bp, Homo sapiens
tatattaggttgctggtaatagactagaaataaaaattgcttaaccaagtcaggagtttagttttctcccccttgctgcctggaggtaggctgtcttgggctggtatgttggtgtcctgatgttcttggggatccaggtttctgtcttaatgttctgccatcctgactagtgatttccattctcaagattacctcatggttcaagacatccatactagccttcaagtccttattgcagttaagaagaataaggaaagacagcaagtaggacctcttcccaccaattctgtctgtttaggcagccttctcagaaatccagcacgaaacttctgtttttatctcattgactagtacttagtcacgtgacttcccataggtgcaaaaatggtagagaagtgcagtcatttattctgggtggtgtcagagtcccactgctcaggaggaaagggataatgggtgttgggggtaggtgtagcagtgtctgtcactatgtacatatgcttgcatgtggtggcacagtacatttctgaaaggatgcacaagagctgttagccactgggcactctgcagggtagagtgggaggagggatgtggagatcagagcagagcttctgcatttaccttatacccatctgtgctgttggatattttccatgagtatgctttgctttttaataatagtgataaaaaacaaaccaacccaaaacctatggtttattaagaaaaatctcagagccttacaatacatcttataatcactagtgtgccatagtttaattgttaatatatttcttggtggaagtaaaacaatacagtaactctttaaaaatccattaagaatgaacctgaattgtccaggtttaggaataattctccaagaaggtagtgggatcgatgcattttgagattttttttttgatgattgtagtattctgtgatttttgcatttatgaggtaagactgacctgtgaaatatattcttaatactcaggcctcccagcagcaatcgttaagtatttttaactaatgatgggcctgggtgtcattgagaaatcactctttttaaagttatactcacagttggaagtcgtaaaaaacaaagcataaaaatgtatatttcattgatat

SEQ ID NO: 67775 - DNA, 1022 bp, Homo sapiens
atatgaataaactgaaagctagagagatttctatcattttctcagttggtagagctagctcttaatctatgcttttatacacatttccaagattcttgctgtgacttaaaaatctctaaaatgcaatgtgatgtggtcaacatcatgttgaatactctaccaatgaatatgtattctagcaaaagaccttcctcaatgagattattcagagatggaaaaccagaatcaatgaagattctctcaagtcttggtgcaaattaaaaccttgtgactggagcatccttgtaatctaaaaataggagtagaaagaagaaaagaacatgttttgtgtgcatggtgtgtggctgatctcaccctttagtggtttgggggccgtaggctcctccctgcgtgtttcttcagcctcatcacacaatcctctttctatctcttactctgttgaagtgttggcagcctccaaaaacctcctctagtccaagttctaccatcataccatttccttatctaatatccatggagtgtctagtgtctgttgcaaaccgggtatctaagatgaagcagtacaacccaaactgcccagtgatggcagacattgcaaaaacatgaatttgcaatcacagtctctattttgtgtttccagtagaactggaagaatctgactcttctatttttatttttgctgcttttgaatgactgtaatgtggcaccattaatttttttttctcctcttccttggcagcatctcttgggcagtgaacagcagtcttctgtccagctctgggtctcctttggccggaagcccatgagagcagcccagtttgtcacaagacatcctattaatgtgagtggggtctgcttgaggatgggaagaagtatcattgtctttatgcagaggtcagaggaaggttgttgcagggatggcctgctggagtggatattttatggcgcctccctgaagtcaggtctctagagagtgcagctatgctttgggcatcgtggtctgtggttcccacttcactgaa

SEQ ID NO: 67776 - DNA, 1028 bp, Homo sapiens
agtggcccattattttgtgccccatttgccagtaaggggcccgctaagctgcagatctgcctcaggttctccaaagggaaagtcgccaaagcttctttgccaaggttagggagcttcccgtgggctttaggccaacattcatcgctagaacatttgaaagtcattgcttccgtgtgtatagtaaaagcccacagggcacatttgttttttgacgtatcttttttgacttttgattccaaaggaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtaaggagactgtgagtccttctcctgccttcttaggccaacacaaccattagcttctctctggttctgtggttttcaacattagctgcccatgtggatacacccggggagctttcggaaacccgatgcctggctcacgtgcgcagagatcaccatgggatgggtttggggtgtggccaggttatgaggatcttaagaagcgccctaggtgattcttacgtgcagccaagtctgagaactacagctctaggtaacatttagggtccgagctactgtgttaatcacttccttgagctgcttttgttcagttttctggttttgtggtttctgagcagtgaaaaacagcacttggtaaatatcagtcagtgagagctggcatatgcggccagtggatcaggttaattgatgtcattactctttttaagagataatcggacggtgttttgtaaagaaaggcaccaacgtcattgatcctttgtctgtaaatcatgtgtttagagctgttttgtagtccagcagtgggcggtctcggagcaccacacccatcaaggggtggtggaggagttgggggtttgggagggatgaattggttcttaagatccgttcagggccattta

SEQ ID NO: 67777 - DNA, 1048 bp, Homo sapiens
ttgtgtggagatggttgatggaggacagcgtttctcggctttattgtgtagccggtggcttagaacccctgaagtaaagggcaagcttccagtcttttttctttttctttttttttttttttgagttggagtctcgctctgtcaccaggctggagtgcagtggcacgatctcagctcactgcaacctccgcctcccgggttcaagcgattctcctgcctcagcctcccaagtagctgggactacaggcacgtgccaccatgcccagctaatttttgtattattaatagagatggggtttcactatgttggccaggatggtctcgatctcttgaccttgtgatctgcccccttcagcctcccaaagtgctgggattacaggtgtgagccaccatgcccggccaagcttccagtcttaacagccacctatgaaccctggttacaatttctcagagatccgctctatttgtaatgcgtgtatcattttagcgcaaaaccacttccctgtggctgtggcatcagggtatccgcatggtagataaagcctgggaaacccatattctctctctctttttttttttttgagacggagtctcgctctgtcgcccaggctggttggagtgcagtggcgcgatctcggctcactgcaagctccgcgtcccgggttcatgccgtccatattctcttaagaatataaccccaagctttctagagccatccttgctatatgtacagtttctttaggaaagaatcgacaggttctgctgagcttcctgacagaaaaccctgtgggcttctatctgatcagggtgttggataattaggttgtaagtacctggagaggggctgtgtaaccctgagctaggttcctacagattgggttgaattttaagcctcagcactgttattaatgtcttgcaagtctgacttaatgatttctgtttttgaaggctcactggaggatttggagtcaatttcgttagtgatgtaatagatgtgactctttcgtcaacttttgtatgttatattcatcattctaaaccccctgtt

SEQ ID NO: 67778 - DNA, 1033 bp, Homo sapiens
acaagccttttgaccctaaaagttgaaaagaaacaaattttttaaaatagcagattatctggctggacatggtggctcatgcctgtaatcccagcactttgggaggccaaggcaggtgcatcacttgagctgaggagttcaagaccagcctcggcaacatggcgaaaccccatctctaccaaaaaataaaaaaaattagctgggcatagtggcacacacctgtagtcccagctacttgggaggctgaggtgtgaggatcattgaggatcatctgagtctgggaggttgaggctgcagtgagccatgattgcaccactgcactcctgcctgggcagcagtaagactgtctccaaaaaaaaaggaatgaagttctaacaatgtgctataatgtggatgaaccttgaaagcattatgctaagtgaaagtaaccagatacaaaagaccacatattgcagattccatttatatgaaatgtctagataggccaattcataaacacatggagcagatgagtggtttccagggcttgggaagggaagaggaaatggagagtgactgccagtgggtatgaggtttccttttggaatgatgaaatgttctggaactagatagtaatgatagttgcacaacattgtgaatgtgcttaatgccacaaaattgtatacttttaaatggtcaaattttatgttatttacaataacaagcaaataccaattcaggttcatagctgtttattttcatattgtaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgaggtattgatgctttaatcttcttttgctttttaatataaaggaaagagccctgctctgtggtagtttcctatgtctagtatttattgaaaaaa

SEQ ID NO: 67779 - DNA, 1234 bp, Homo sapiens
ggtcaggctttagttaaatcgaattaatggtatcattcaaattcagctttctgtttccctgactaatcagtttatttatgaactgtcgttcatcagctttaggtataggtttcttcttctgagtttaggtggtggaaggaatgtataggaaatgggtaagtctgattacctgaggttacagaaactcttcaatgaatagacttccttgcaggcagagaagcatgagtcagaaagaggagtgagcaaataaatatttctttgagacccagcctaatttgttccagttttcattggtcaaactgagactctagcaagacagatacttgttagagatccttttatgacaaaaataagtagcaaataatccagcaaaccttgctaccatttttacctgaccataaccacataagcacatagtcctcctgtgcagaaccctggccacatctgagtaacattgaacaagctctttctgaccaggagaactgagtgtgaccatatggcaaagggtgttgtcctgattgcttgcagagctatgaaaatctggacatgagtgatggaggccagactgaatcgcttgaagccttgccctgtatacctacacctttgtgcaaatgtaaaatacataggaaaaaatttagtgctaatcctttgctttttatatctcattgatactgtacatcaggggagcttttccatgagacttatgacttctgattcttggtctttcttatgacagaattgctggaatcatgtttgaaatatgtctctgacttagaaagtgaatatgacaaaatcatttcatttctctttagttctgagtcacttgagaggatctctgagtgataggatgagatgatgactttcccatctacttgagttgacactgatttctaattgttattccctgagagtctcagaaggcctttttaagttgtaattgttctcttcttccacgggacatttatgtgggttcagatgatcctctctgtctggggggtgtggggacagctgggctgtgagtctggtttcccctgggccaggcctccttgccccgtgtcagctgcactcccctcacacaggccgcagggtttacagggaacgctaggcatggtatcatgtgctgacactgcctgaaactttggttgtatagctttcccagggctgttcccttcatctggctcagcgcctcagtcagctcctcaacctccagctccggagaatgcccatcctgtcc

SEQ ID NO: 67780 - DNA, 1046 bp, Homo sapiens
tctaagattatgagttctatgagggcaaagacaatgtctgttttactgacttctttatccttaggacctaagagtgcctggcatggagtgggggctcagggcatatatgctgcatgtatcagcaaattatagcgtagtggtattagccctgaaatgggctgctattattattattattttgtatattattgaagttgagatgaagcctgtccttgctgggctatgttgtataggcactttcgtctcactctgtgctatggaagtagactctctttttgccttaaggttgtataactaatatcgatgctgattataccaattcctaagacagggctagttccctagttccaaaatgctaattcatcttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagccggaacagcacgtcgggagtgatgtggagttctcagaacagctagcagacatagttcccatccacgtggtgctttactgggaatgcaccatgctcaccttgatatttgaataggtaatatgtaaagcagtaataaaaataccaacattcatttggcaccttgcagttcacagaggcctgtcacaagccttctctcactgtggcagggcttcccatccctcccgaggagagagatgaggctcagacactgtgtactgtatgtggtgaacgcaaatatgtgttcagatgaggcagattgttaaggccattgtagtcagagtgcaaacagtttgaatggaaattttcgggttgtccttgtgcagctcccaagggaagattaagcagctgctttcccctttcgtggagctggacgctccctttgaaatggggtatcctcttctctgcgaataggcctgtggt

SEQ ID NO: 67781 - DNA, 1030 bp, Homo sapiens
ttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttcatttgggaaaaaaattgagatactagaacttgctccacctgtccctaggattgtgtggaacagatgagataatggatgtcaatgtcttctgtaaacggaaaaattgttttcaagtggttgtcattgctgttatgtctatgtgcacgtgtgtgcatgcctgtgggcatgtgtacatggtttctgcacaattacctccacagcagtggtgtcaccatggatttttcctcttcaggcacttcctggacctcactactacacatggggagaccacggcggaatcatcacggctattgcccagggcatggaaaccaacgagctaaagtaagtgtctctgatgaggccttttaacatcaaactttctcccagaaatttacgtctgtgattataattggattatctctctatagcactatgttgttgacagcacaatttgtgatctctggatatgagttaaacttttttttttttttttgagatggagtcttgctctctcccccaggcaggaatacaatggtgcgatctcagctcactgcaacctccacctcctgggttgaagcgattctcctgcctcagcctcctgagtctgggattacaggcacctgccaccacgtccggctaatttttgtaattttagtagagacacggttttaccatgttgatcaggctagtctcgaacccctgacctcaggtgatccacctgcttcggcctcccaaaatgcttggattacaggtgtgagccactgtgcccaccccgatttaaactctttatctcccaaatgggaatataagaacctgtcctttc

SEQ ID NO: 67782 - DNA, 1090 bp, Homo sapiens
ctgccagaaaatcataaagccttccccagacattttgaaatgacttgggggttgtagactttgggggattatggtcactgtagcattcctctatttgtataggtttcatttggaggtgtctgtttgaatagttcaaataaagcatttgaaaatacgaaaatacatacaagcctcctattgacaggtgcatgtgtcccacataacaacctgagcttggcctaaatctgtgtagccacctggcatttactcagtgtgttgttcacagaggtattttgcttcttcccctgctgctctgaaaagcaagaaataatattcaagttagttgatattctcagactacaatggtgatttactgtgacacccatgcacaaggacaggtggcttctgacaagactggatatctgttgctgggctagggcctcaggccccttctaagtttggcctccccagtcacagagatctcttttcctttatgactcgtagcatgtataggctgtcccattcatttggcattgatcatattctgactccttatgttagttacctttacatgatgcgcctgaattctgcaactcgttagtaaggtctttgtaggtaaatatttctgctcgatgtaggttaccaggcacttagcaaatatttgattgaaataggtcatgcatacttaatcatccaagattgcttatggtttttttttttttaactgatttataaaactagaggagaccgagctagtgtgccaattgcacagctccaaggggaccactgccactgtgctccatgtcaatgacaacccctagagcacagatgtgagtggaggctccctggatgtgtgcaacccggtagtacccaagagacaccagagatgacctaatctactttccttagttttcacatgagggaataagagattagtcaggagttaatgcccacactggaacttgagcatatttctgttaggaatcatttcaggtccattacacagacaactgtcgaacatctacaatgaagcggatgctgtgctggataccaaggatgcaaaggcaagtggggcactgatcgggagctgcctgtgcccactgtggctctg

SEQ ID NO: 67783 - DNA, 1010 bp, Homo sapiens
ctggccccggcatttattatattatttatacaattagccttttaccctttgcaaatttggcagattcgccttccagatccctatccagatcattgacagatgtgttgagctctgtgagaactagaagtcttatcttgggttgagatcaaaccatacgtcagcactcttgggatgtgcttattttaccatcagtgaattttatctgactgcgtggtccacaaagatcttcatgaaaaaaagaatgttctgtgtcattgtcctgtttttcaaatcaagaattaccacgaggaaaggaaatggagttagtctgttgtgacttgtgtgtgaaaccatttgggttcttagccttgacctccttttcgtctgagtgctctcaaataaactgtttcataatccattcttgaaaccaccttttcttcattaaggaaataaaagtattttccctattctagtttttgagatctttgttcttcataattctcctagagattattgaaaaggatgctataatcatcctatctttaagtctttcagttccttagaatttattttgtactgattttcctttaacttaaatggtttttcttgtccaatttgaagattattttccttgataaagataaaagcaaaatagaattttttttctattttttttagacccagctttactactatgttgttattcaaagatttttttctttttttttactaacgaagtctttatttcttttgttttcagctttccaatcagccagaaaacataaagtattttcaattcaaagttctagtaaagataggaagaactgggtgatggttttcataaatgaatgaatgaatgaacgaatggatgaatgtgtatcaagtgctctgtttttttaaattgatacatatgattatgtctgctattatttattctattggccatcagagcaatgatcctattcctttctaattctttatagaacttgccagataaccaatccactgacccaccagtctgccaattattt

SEQ ID NO: 67784 - DNA, 1036 bp, Homo sapiens
gcagagcttgtagtgagccgagatcatgccactgcactccagcctgggtgacagagtgagactccatctcaaaaaaaaagaaaaaaaaaaagaaaaaaatttctcttttgctcctctgtcttttagtatcattagagacccatgtcctattttcattcaatgtgtaatctgttaccatcatttttcttttttatgtttgaattctcctaaattcggccagttggagccccatcaggctggttcctgtgttcttttgagatgactgcatttatttctgagcatttccttaaactttccctgccttagcccaggatcagccatttctccaaggagccctggttcctgttcctggtgaatgttatatggaaaccaagcctttgccttagagactttcactgcaaggattctcttacttgcatttgggcagatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggtaagctgctgcctccttggaccttttcacatggatatgcgtggacttcctgttatgtgcaaagcaccagcttagatactgtgtactcagaagagcctgacattcattgggggagatgggcccataagagttagcaaaaagcatagggaggtaattgaaggcctgctcaattcttcttagtaagactgggtgctattctttgtatcttagtttcctcatgcagttcctggcacataagaagtttaaatatatgtctgctgaatatgtagataaatgcatgaatgaaaaacatatttccaaatcagcagtgccaattggacgtattcagtgagtgtgcctgactgtctgtaagtcagtgtgccaagcgacacagggtcctctcaaagccatctaggatctagttgtgatctgctaatctagatacaggatg

SEQ ID NO: 67785 - DNA, 1048 bp, Homo sapiens
tgcgtttcaggtatccttttcattggcatagggctgcccagcttcaaaacaagctgattggagggtctgtgtgcttgcggggtggcaacagatagacaggaagtgggggttgaggccaggcaccttgaggcatagcaggaaaccctacatgggcctgcctctaatgcttcgtgctgtgttcctttttctttaggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttatgtgccaggaactgtgctaagcatgtttcatgtaagttgttttctttagttcttatagccaggtaatgcggtagaggtgtctaggagagctgcagctatttctacaggaatagatagctctgggatttatttctattagggtaacccaaaaatatgctgaaggtttcattgtttttaatccttctccttaggaccctattctagaggggatttatttctttatctgaaacgaggggatgttagtgtgtgtatatgtgtgtgtgtttgcatcatttattattccttaagcaaaatatccaaggcactgctgcgaatgctaaaagtaggagaagtgatttgtgcatggctaattggcacaggagatagaagagagcaagtgcctcagaggaggaactggtacttttattgtgactattgaaaggaaggagagggctgtggattgctgttggagaatgaggagatttttggaagaagtgctgtttgagctgggctctcagggagcatcaatatttgcagacagcagtgtttt

SEQ ID NO: 67786 - DNA, 1745 bp, Homo sapiens
acagtcacgtgaggagggagaacagggcgattggtgtaattaggttggcaagtgtgacttgaagactggcaggcttagcccagaagtatggttgttgaagcatgcatattgggagatttagaataaagaaaaacataacaagtaaaacacttgcagatgaagaaacagattcactggagtttaagtaacttgcctgaggcagaaatgtgattccattacacacctcctgagtcttgatttctgtgctcttcacttggtccacaccacatgccaatgaatttgaggtttgtgtatgagaaacaaataggtcagatgtgctaggacctcttcagcatcccctgggtccaacctcccacgtgtcttgtgtgtctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccaggtgagtcagcgcttggtctgactgtgggagctgtgcatcgtgactgccctgtcctgataagctgcatgcagaatggcctatggaaatgggcagttagaagtttgtaagtgttactcatctcagggctgacaggtgaaagtttccagtcttctgtgttagtatttttctttctctgtcttcatctgttcatataggaaggataaagaaagccctaaatccacagacctgcttgaaagtgaggtcttgcttttcctgctgggaaggtgttgggactagtaatgtaggatgattagttgcccccctattgtgccaactgcctcttgagcatctttcttcccaagccatgatacagtaacacttgacttacccatagctcacataattatccacttcagctgttctgaacacaggtaagaaccaggaagtaagcattaaagagccctggacaggccaggtggatagccatacgctcacacccatgcatttaaaggagagctctttgatctttattcattgtctacttaatccttttagaaaagcaattccaacaaatttttatctagattccaacccaacagaaatttcacagtgcctgggtatttgaggggcttggggtgggggatggcggtgatgctgaatggagctgtccaacaatagcacttgatggctaagagcctcacagggaagaaagagtataaaagcagacacaagaactgaaatgtaacagcagtctggtttcacttattttaaaagcaaacagactcatacaatctcagtaatctctgactttattattgccatacagcataatttagtaaccagtgttcataatgataatgcagagtaatatatatgattaaattctctttattctgctttaaaaaacaaaaatgtagtatattttagaaatgctttcatgaaaacctggcttcatgtgtctggaaagtttactaacgtaaaacatctcatcccttgccagtcctgccagttgaataaagggttacccttcatgggactgacttggcagggggtcgtttgaacagttcctagcatttattattacttttctctcttaagcgcctctgtttgaatggaagcacagggcaagaggtgatcatcaattctggcctggagacagtagaagctttggcttttgaacccctcagccagctgctttactgggtagatgcaggctt

SEQ ID NO: 67787 - DNA, 1067 bp, Homo sapiens
cttggagaagcaagagatgaccagcctggctgacgggaaggagcaagaatatgagtcccacctgtggactcttcattgcaaggctgtgacattgagaatttgttttatgggagtgtggagtcatcgattgccttggaacgtggagtgacacgggatggtgaaataagtaaatgctcatttgcttatttacttatttgagtaatttacttattgatactgctttgtccagatcatcatgccctggaaactggggcttacatggttctagctcctctttcagaccacttgaaaattgtcccatgagtcagaggaaggaacagcgcattgtgactagaagttggggcaggtttcgcagatgggtcaggtcagggaaataggcaggcatggagggggcatgtctgtagcagaagctgagtagccatctttggcaatgggggtctttaaggagctccgatccatctcagcctcttttccccctgtttttgtcaggtagctaatccagatggcgacttccgactcacaatcgtcaattcctctgtgcttgatcgtcccagggctctggtcctcgtgccccaagaggggtaagtgttgccccaaaaggaaatcagtcttgcgtccaatgctacactaatagattctcatggaaacacagactgcgggacaaaaactctgtttctcatgatggtggttgaaatggtctattaactgagaagtttgagaccacagcttagtcatcgtggtcaggtaactccgttcgctttttgttagccagtgtcagagtctctttaggcatccagatgtcttgcatctgtgggttgtttctctagaaaagttgatgttaaaagagagcttctgtagacatagacaggcctgcttggatattgtgagaactttctcttgagtttcatgcatggtacaaacatttaattcattccatctttcccctgccttcccagcatgtgtaggttttcttacgtacaatcagtgtgcacttggggaaggcaaaggtgctttttattaactcattaactgaaggaaacataattaagagggaaattctggatttg

SEQ ID NO: 67788 - DNA, 1088 bp, Homo sapiens
ttaccctcacacttcctagtggtaatcattgttaataatgtcttgtgtatctttcatgattgcttttacttatgtacaagtattatctttaaaacacacacatatacacacacatgcacgccaaataggattgtagtgtagttactattctgtacctttttaaacaaacttaatatgtattgaaaatagttctgtgtgagcatatatagatttttaggtttcacagtattctattatatgtaccataatgtgtcacttcctctgctgattaacatttagtttaatatacatacatatacatttctttgtatattatctttgcataatttgattttatctatagataaattctagtaaaggaatttccaggtgaaggaatttaagtagtttcaggtgttgtcattacatattgttataataatgctgaaataaccagccggatcattcgaaaggagtttctgaccttttctggagtagtatttgagctcccatttctctagtattgatgaggtatgtgttctgtccccattttcgctagggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaaggtgagtccatttgttgctgccggacagtctgctagagcgggtgaggagcatatgagatcaggagcctgcatccctgggctttgcagagaagctgtttaacttcttaaaggttgccttttttccaaatttgagataacttattttcagcctatggagggatgccaggcagaggcgccaagggtccaggctcccctgctgttcacatttcaaaaggttaaaagtgaaggctcttcccatgaacattcccagtttgcccctcagtgtcagtagcctcatttcagggtggtgtcttcattttttgtg

SEQ ID NO: 67789 - DNA, 1325 bp, Homo sapiens
agccgagattgcgccactgcactccagcctgggcaacagagcgagactccatctcaaaaaacagaaaaacaaatctagtctctctgactgtgatctcaagcactaggacacattatcttacccagttttactgttgagaaaacagccgtagggagattaaaattaatttccccaggaagaggtagagccacgatttggtacccagtcttgactgactgcagacagagcctatgttcctactgtagaattctacctccatgctgcctttaccatctgtacaatgaagtgctaacttcttgtgtgaaattgagcttctctaatcgtagtttcatagataaaggtatttctgtcacttatttaggaagacacttttcgcgtctgaagggatcttaggaggtcacctagcctgtcactctctctcgccaacagatgacagtttctcacttttccccgtcctgttccgatctggaagctgtccacagaaagatatgcccttatctctcttggttgtaaatttcaagctctcatgtaatttatgtcttctgtaagtctaggtttaatttctgttgctacaattaatacctgctttcttctattttttaattggttttccagtaggatgtttacatttgtgggaaatcaattgtacctaaggaatatgttgtctttctatcccattttagctaccaccatctgtgacctggacacccagtttcgttgccaggagtctgggacttgtatcccactgtcctataaatgtgaccttgaggatgactgtggagacaacagtgatgaaagtcattgtggtaaggggacatcacatcctgaaaccctgctctggagaggggggtcattgtgctccctcacagggctgtactggtatgtactggttttctgatagccgtctcaggatttatgatattctagctgaatggctttctccatccacatggtggggttgagtcatttctctgtccattcttaaagagtttgtttgctgcttttcacgaggattcagttcgctggagacacttgcgaactgggaccctagattcccattaactctggatgggaccctagattcccattaactctggatcaagtgtctccagcagaactgaatcctcatgattcatggtcagaaaagatggagcctggactcagctcctgtcacttactcttagattagcctttgttttctagtctgaaaaatggggaaatggaccctgctttgccttggagagatgctataaggatgaaaggtgatggtaaggaagtaaatttctgaatgaattcagggggttattaacagctctacaggcttg

SEQ ID NO: 67790 - DNA, 1022 bp, Homo sapiens
tagttaacagtccctggtcccagactcatagttgctgacctccgaaggagacattatgcaatcagcatggtgtgccagattgaggcatgagagggaagtgagagtggaggtcagacgctgacccagacgtggtgatgagttggcggggccctactgtgccctctctccctgtccacggggggcaggtccagccacgctgtgcttacgcacatggacacagcctgcttgattatgagcaggtggtttgactcacagcagctgaaataaggggagcaagggcagcttgtaaatcatctcaatgcaagttaaccagcagagcagagcctaggccatttccacacagaaaatacccctagcctggctcttggaaggtttttaaaaaattcccagttttccttcttcaagtgcctgaaaacatgtccttggaatgtgcaactatttccccttcatccctgccatttccttcccagcactcttagaaggttgaaatgtgtagctagttttgccctagtaagaaggaaacttcacgtggttccctctttctggtatcattgagctcacgtactgggtacatgtttgactgtgaagcagtttcagccccctgatcctctgttcatggctcattcttactagtttgtcctgaattcatcccagggtcccggttagccccttcctctgatgcaggtcctcttcgtaagtttccacactcttcctcaaaaatatctgatttactagctttgccatcaacaagcctcttggcgagaatgactgagacggctgccttgggccccacgcttggctgctcctgttttctgacgctctgtaaactccatgtgaaagttctatgccacagtctatttgggctgtgataacaaaatacttagtgtaggtaatttataaacaatagtattttgtttctcacagtactggagactgggaggtccaagactgaggtgccagcagacttattgtctagtgagggcctgttcctcatagatggtaccttcactgcagcgtcagat

SEQ ID NO: 67791 - DNA, 1081 bp, Homo sapiens
atctcacggtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagaggcaagcagctctaagggtctgagggtctcagaatctcagcccacctgtaacccatttgcagcacactgactggaagctgttaaatgaccttttgtccctggtaaaagtctcttcgttcatggtctctgtggatcattggtgatcacgggtccatctccatcctttatgagagctttgacaccagagacaaaattctgaacaagcttttgtcctcacctctctgtttatggtctcacctgcagaaatgcaccagtgccggagtgacgagtacaactgcagttccggcatgtgcatccgctcctcctgggtatgtgacggggacaacgactgcagggactggtctgatgaagccaactgtaccggtcagtacttcctggactcagttgacagcactcatccgttcatgcagtggttaacattatagctttaaacgatcggaaaatctaggctctgagaattagcttggaccttagaaatcagcgagtttcatgcttctcaaagagctggtctttgatgagataaggaacctgtgccagaatgtaaatcaacaccctgctttcaactgattaaacagtgttctgagtgatatcgttgatttatgttctggctcaagcttcttattcattcaggaccagtgttaaacagttttcagaccagcccctcggctggggtccatactttgagtaagcactgaactagctcatgttttttaaaatggagcatcagggggttccccagacaaggaaaatgtaaactgtgtttgtacccgttttgggtaagattttattaaaagtaaagatggaaacaacatgaatgtgctaggtgctataaggtaggggtagtgttctcattcttttgttgggttcgcttat

SEQ ID NO: 67792 - DNA, 1063 bp, Homo sapiens
cacacaaactatataaaatgctgccacgtaaacaaaatatataaaatgttttttgaaaccaaatatgtttaaggttctctatccttttgccaaacattccaagttttcaggggatgttagttgtctacatgttgttatacattctactccttaagtaaagatgtttatgcaactctgtttttgtgtagtaagcattttcatggaggatgcatattcactttatgctaccataacctagtttacatggttgcttcctggttgggtgtttgaggtttttagatttatactgttatgctagtaccactattcgtgtctttggaaatggcctgatttttctttgagatattttctgagaggcgttcttcagtatggagttgtaaggtgaaaggttctgaccagtttttgagtctctctgttaccaaattgggtttccaagggattacatcaaatgtgtctctaccagtaaaacgttgcatgtttccccaagtctccttgatattagatttgtatctttttagttgcttccactaatgtaatatgtgtgtttgcctcatgtagttttgatttatacctcttttaaaatactttttctacctagtgacattaaccatttctccaaatagtggtgcttgtttactgtttctgtttgatatcctttggctaatttcccagaaatgattactttttacaggattaaaacacattttcatacttatacctaatcctcaaggaactattctacacagagctcagtttgcaaaggctatctatgactgcctcattagaagtgattttcttttttttttttgagatagggtctcactctgtcacccaggctggagtatagtagtatgattgtggctcactgcagctttgacctcctgggcgcaaggcatcttcctacttcagcctcctgagtagctgggaccacaggggttggccaccacgcccagctaatttttgtatttttttgtagagatgaggttttcgccatgtggctcaggctggtctcaaactcctgggttcaagtgatctgcccaccttggcctcccaaagtgctgcg

SEQ ID NO: 67793 - DNA, 1043 bp, Homo sapiens
ctttcttttgttgcttaaggaatcctgcttttcagttgtgggtgtatgtataaggggcaggatggcgagtgaccagggtcttggctcaagggtcgctgaaagtgagaggcctttcttgccagtactgtatcagatggcactcccagcgtgccgtagccccttaccctgcttcgatgatcctgtcacaacttgccccaatttggacctgtctgttcattttgctgcctgagctttacaggagcaggggcttgttttgtgcattgctatggccctctcctaaaatagtgcccttcttggagcagctcttatatttgtttcctgggactgctgtagcagagtaccacagaccagatggctcaaacaacagaaatttatttcttgcaagcctggaagctagcagtccaagatcaaggtgtcggcagggttgggttcctccgaggcctctctccctggcctcatagacggctgcctggctgccttctccctggctcttcacacggtctttcctctgtacacatctgtgtctaaatttcctcttctgtaaggacaccaggcctattagattcgggccacccagatcacctcattctaacgtttcctctttcaagcccttatctctaaatacagtcctgtttctgagagactagaggttgggacttaaacacatgatttttgggaggataaactcagctcataacacgactcggtaaagattcatggaatggattaattaacaaagtgtgtgctctgtttagattaggtttggcttttgctttcaaggcatggtttagccagacagtcctttgccagaactcactgctgttcccccttgcttctgggcaccactgctgcttcgacccctcagcatggaagttcctggacttcatggatgtttgttccctctgtagcccaagatcctgagttccacaaggtatgtgatgagttcggtttccagtgtcagaatggagtgtgcatcagtttgatttggaagtgcgacgggatggatgattgcggcgattattctgatgaagccaactgcggta

SEQ ID NO: 67794 - DNA, 1356 bp, Homo sapiens
atgcagatctaggatttaaactctagtttgtttgactccaaagtgctcactcttcccgaatgcagattccagttgttaatgttagatgagatggcaccttagtgccggtatagattccaccactggtcattccagaggtgtgttttgaagcagaagccaattagtactttgcctaaatgggaataaacttgggcccagcctttagtaccatacggcccctccccgtggacttaagaagcctctctgtgtttcagccacacacagcaccttgacttgcatgagcagggagttccagtgcgaggacggggaggcctgcattgtgctctcggagcgctgcgacggcttcctggactgctcggacgagagcgatgaaaaggcctgcagtggtgagtgccggtccacgggctgggctgggctgggctgggctgggaggctcgcttaccccagggcccctcctgtgtagaccttgagctaggacccttttgaactgttgctcaatctaaggataaaacagatttgtgcctagttttggagccccaagtgaggtgagccttggccagactctgatacaacatgcagctgtctcctccctgttagtgaaatgctagtcttggatttttttttttttatggacttcccacctcatgcccatacaccatggctctcacagtctcaatctgctggtgggattaactcagttcttatctctggagtgtctagtaatggaccctatgacatggtccttggacttgtagcattctctatggagaaataggcttaaattgtcataggcaggaggaagatgaaattcgagggaaaatatcacgaccggaaaagtaggagaccctaggagggattgtatagggaggtttcaactacattttctgagatttcttttcagataatgattatggcctcctgataatctagatcatggtagttctgtttaaaagcaggagtcctttgaaatctaaggatttgtaagatgtaacttttttttttttgtatttttagtagagacggggtttagccacattgcccaggccagtctcgaactcctgagctcaggcaatttgcccgcctcggcctcccaaagtgctaggattacaggcgtgagccaccacgcccagccaagatgtaactttgtttgtctttttctcctttatctctctagatgagttgactgtgtacaaagtacagaatcttcagtggacagctgacttctctggggatgtgactttgacctggatgaggcccaaaaaaatgccctctgcttcttgtgtatataatgtctactacaggtaggtcccatctttgtcatgggagatgaaaatgatgtcttcattgccccaggat

SEQ ID NO: 67795 - DNA, 1049 bp, Homo sapiens
gactccaaagcctgtgctcttaaccactgtgctccacgcttctctctgggctgagacacatgcggcctactggaccgccctgcttgccgggggtggcgggctcagcatcttgcacgagtgcctcatgagggcagagatctggtctgtttttctctactctatcacgggcatctagtagagactaaggaaataattgatgattgagtgaatcgaagcagttaaatgaagggttctggcatactttgggagatggactacaactcattttccagagtggttttcctgaccttagccttgacactggggacttgcatttctggacttccaggtattaaaaccagatggacactgtggcatgcaataggactggaagattttactttaacctaagcctgtgaggaataggctctgggtcatggagagtcactatctagtcccctctaaaatctggagcctttgagatcagggcccaaggcggccaaacgtagtgccaccagatggtctttggagctgaatgcttgcaggtattagagaaagcctgctgaattcacactctcctagaatttttattgttgtatctcttctctctacaaagtctgtttcaaaacactgaccacacataccaagaagggatgttggaagagcaaccaaatacatgtaccttgaattccgaaggcacaagtcacaactgcatttgaaaatctcagtggatggttggttctctttaacttcttttctgtgattttgatgaatctcagctgcttgcatatatttgggctaggatttgtacagaaggcagctgtgtgccacatccaaaaagtgtttgttgtaaaatatctgtgacatagtatcataataacgttttaagataaaggacaaagacagcagaggcatcagccagacgcgccaggttaattggtgaatgtagtggattagtaatgacaatgagaaaagccaccattccctgagcacttcttatacactaagcaccatgctattgttgctcgtgaatggatcccttattaatccttatgaatcctatgagataa

SEQ ID NO: 67796 - DNA, 1045 bp, Homo sapiens
ttcgaactcaagtttgccagcttccagaggccacattctttccattttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaaaaaacaaaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatc

SEQ ID NO: 67797 - DNA, 1144 bp, Homo sapiens
gaacggccactttcaccaactgcagctccgttatggaggactgataacttggcagatgatcacaagtatagataaatcaaaaatttttatcaggttccacttctaggaatttagcctacatacttttatgtgtgtgccaagatatatggagaaagatacatggtacgttattattcttatgatagcaaaagatgtgaagcaacttaaatgtctatgaagagaggactggttaaacatatcatggtttattcatgcaatggaatgcaggacagccgttcataagaagtatgacaactctaaatgtactgatatggaaaaatctctacgctatattattatataaaagaagccaagagcataatatgtgtgccattttctcagttgtataaaaaatatttgaggaagataggcttcatatacacgtgcatatatgtgtaaggatacacgtacatacatatccttccttatatatgcataggggatttctggaaggaagcacaaaaactcttaccagtggtacctcttggaaaatgatttggggtaggtgggaaattattttatattttatggttttttgtactaactgaattttaattgttgtcattattttgttgaaaaaatactttaataaagattgcataaggccatgatgtattttttttcctacgtgtgtgcttgggcttcaggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttggtgagtgggttgggcttccaggcctctttgtttattcctggcctggttagggtggggtgggatggaaggggatcctctaatggggcaagaaacacaggcctggtttctggcgctcagcaggaggtctctctcccatttcagtctgaccaaagatggggtccgtacagggacctcttcttagttggcacttctccattattcctagctaccattttggtttgtccctctttctcctccgctgctgatatttccttccctgaccctctcacacagggattagcaaacaaaggcct

SEQ ID NO: 67798 - DNA, 1073 bp, Homo sapiens
ttgaatttcctgtgcttactatatgccctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatctggtcactccaaaggccttccaaagaatggagtcagatttcgggactcaaactcttgttgctgtgggtcccagctattaatatactacattgtccaccattgaactacaaagagtgaaaaatgtcaactttctgattatcattcacttgttcttttttggtcctagttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacaggtaagcaggagagaggttagaggtcttctcacacagcctgccctcagtgctgtgccgctagacctccagagacagacttttcattaggcgtttgtttcacagggagtgcaaacgctgcccttcaatattcctacaggggcagagtagtgcagaggctccagggtctgagccgtggcgtggtggccagggcacagtgggctggggagtggctatcgttttctttattttctaagtctttttaactcccctcgctggttttgatattactaaaggaaaagaggagggatgcccaagagaggaaataaaactgaatagttgccactaagaccaagtgctgtatctgagaatctggatgacaggttctcagtggtccattgtggcaatctgacatgttgaaatggagggag

SEQ ID NO: 67799 - DNA, 3298 bp, Homo sapiens
gaaggtggccaggagggacagtgggaagctgggctaggtttcacagctgattatggtggctgcctggctatggcattgaccttctcagctagagggttgtggtagggttgaggggtgggtagagtggtgggatatggggtcaggtgaaaatgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatga

SEQ ID NO: 67800 - DNA, 1008 bp, Homo sapiens
acattagtccaacacattgcaccaagcgaaatcccaaggggagacctaccacctgggtgagcctccttggtcatggcctcatccttaggttttcaggcttagataatttttgtcaacacatgatagtgaattcatctctcatggccaaacacaccttaaccaaactcaggatgttgatatgcaacgtcataatgtccatttgttaattcaccctgggaaagtgtcctgtcccttacaatgtctgcatgaccagtgcattctctccctgtagggagatctaccccaggagccagtcaccaccagaaggttgcttggagagcaggggcaaagagttttaaaagtaggagggatctgggttagcatagtggttgcccaataaatactgaatgaatgaacaaagacttgacactccacaacaggaataatctactccatataaacttagtatttgaagccgtcagattgcaacaccctggatccatttctagttaaaaagatcttgccaataggatctaatactttaagtccatgcactgtggttcccctggacagggcttgggcactcccacatcggtcactctgactcatctctacatgtcctgttgttgagtaaactctcccactcacgaaaacattctatagcaaaattaatgcatttggactgagtttgaatcgaatcttcctggctaagagccagattctgactacatccgtcagctatgattattgggttccccagcccatagcaaattgaacatgggttggggctgctaagggcagctactccgaggacaatagaagagaagccacgagttagagttagactgctggaaaacctatgtgagagataaaggaactccagcaaatatacttattgggaatatttggcataaaaccagagtcctacacagtaagtagcccatccaattagaataattatcattcccttccgttgaacccctgttctttggtagtaactatgctaaactctctctctctctctatata

SEQ ID NO: 67801 - DNA, 1017 bp, Homo sapiens
tcattgtatgtatcagtaacttttttctgtttattgctgagtagtatttcatggtatggatgtaccatagattgtttaaccacgcagctgttgaagggtctgggttgtgtccagttttctcctgttgtgagtaaggctgctataaacatttgtgtatgggtttttgtgtgaatataagttttcatttctctgtgataaaagtccaggagtgcaatttctgggtcatatagtgtttgtaaagaaactaccaaactcttttccagagtgactgtaccattttacctccctatcagcaagatatgaatgatccagctttttctccatcctcaccagcatttgatgggatccatagtgttatctaattatggttttaattttccttgccttaatagctaacatcttttcatgtgcttatttgccatctatatattctctttgatgaaatgtctcttcatgtttgcacattttctaattggattgtttcttttttactgttgagatttgagaattctttatatattccagatactaactgtcaaatatgtggtttccaaatattttctcatcctctgtagcttgtctttttatcttcttaacagatcatttttcataaagtagaagtatgtaattttggtgaacttcaattaataaatttttccttttgtggattgtgctttacctgtcaagtctaggatctctatctggccctaaatctcaaagattttctcccattaaaaataatcttatagttttacgttttatatttaaatctgtgatttgttttgacttaatttgcttaattttggcttaaagacaaaaattgaggttgaacagcttcctcctccttccctccttctcttccttaccctcctcctgtcccttcttctctttcaccttcttcactttgccctcccctattctgcccccttttctcctccttctccttcttctcctccttcttgtctatagatgtctaattgctccaacacagtttgttgaaaagcctgtctttcatcc

SEQ ID NO: 67802 - DNA, 1073 bp, Homo sapiens
ttttctatacatgctgctgtcaaactctatttccctcatcctaaaattcaactcatcattccatctcccaatattttttttatcctaagacatctgctaaattaagattgtttttcagagtcatcttattcaaatgtttgactcaaacttacccaaaagagatcataagaagctgagtcaagtcacatactgaagttaggattccaaatgtcattccccaaagctatcagtctaataactaacaaagaaagaagtgaagttagttttgcatggttagttttatttgtttgttttcattggcctcatatttacatgttttttttttttttttttttttttcttaacaactactgatgctaggaagaagctatctagataaatgatggatagccagagaaagttgatctgggatcaacattttgcttcaggtaatcaaaaaaggcaacattttgtatgtgaataattgagattactatagtgcatacactgatgttttaaataactggatttttctctttcttgctatcttattgggttgataattatccttacttgaaagaggagatttagggtaagtagagtaggaaatcttctgtctatactatttatggatattaacatgtctatatatcctcaaaacttacctatcccacaaaataaagtaaaagtaaatgtgattcaaaaatatatgtttttggcttctcactatagtaacaatcctctatataaggtgggtatgatctggcacctgttcaaggggcttatctaccaaagtgcctaaagaaattaatagtaaggaatttcaactcaattagaattctttaaatgaattgaaattcatgaaaaagcagtttcacaatctggctcctgaagacagaattcttagcaaggctccaatgtactatgctgttgcatggtgatgtgtattgggtcattgaaagcacccttttcattcctgccctcactcctgtactgagagttggtgattctttctctgtattccatttgcttttgcccttccttctttcctttttctctatctttccttttctcattggtatttcatgtttctt

SEQ ID NO: 67803 - DNA, 5136 bp, Homo sapiens
ttttattttacaaaccccagggctccaccttcccggcccaccctctttctaaaaccacttactgagcagaacaaaggaaacagctaactatagaggcatcattaagtgtgaactgcaacagcatgataaagtatgtgatatgacaacatattttattgcacaaaagtgcagataattaaataattctatagtaaccctgactaattagccgaaagatcttgaaggaggaatcaagaaaatggatccaatcaccttgaataatatgcttcgttctccaagatcacaaatttattttggttatttgatgattgattaactcatatagaaagatgaggacaaaagcctgtttctcaaagcagagctttgatctggtgtcctctttaggacaaattaatcctatgttttagaagtgctgaatttaatgtagggctttctgttttcagtcaaagatataacctgccattctgttgaacatttctctattatcgagtgatctaagaaattatcaacccttagcttcttatatcgctgcctcaaaatatagatgtagcctcgttcacattttctaatgagtctcctgtttaagtttgtttcttattgcttgaagcaaataaatatcatgggcacagaaggaagagaataaataaccgtgctgaatattatgtatggtgaaaccctccccccttcctttatcaaggtaatattcctagtgttcattgttcattggtcctttaagagagagctttagcttttacttgagggttgtaagcacattagaggaataattccctttggatactatacagaaggagccacctgcaaaatgttgatgctgttattgaagtctcaagtggaatcagctttcaaaaaattagatattagatacatccgatataatttgcaatgtgtaattatactaatgtgcatatagttgtctgttgctttacatgttgcctacttgagtttttttcttttcttgtgcatttctcatcattgaaatggttcctgagtagaatctttttaaaataagcttattttaaaaaaattctttgttaattaatatagggatacgaggactctacgatctgtgttcttatgcaagaataaatatgtgcgacctagatgttggaaattaattatctctgaaagggttatcattgtggacacttgcttaatttgtaaaatatttgctactcttgattgatttagtctttttctgactttagacaacttgaagtaattgagaatattagttcctttgttggaataacaaaatagaatgccagggaaatgaccttaggcagagataataattttaatttaaccaaagtaatcaaaacaataacaataatcagcaatttcttttattgtttttcactgttttgcatggcacatgttgaatactgaaactctgccttaggttatttgtgcactaacatcaacttcccttttaacgtcttgacatgatgtccaaggtctactgatggccccactggagagcctccttccagggaactgatccctgaagatctacctattaaggaatagcccagtcagagcaacagcgagttggctggtcagcctggtagttggctcagtaggtgaagaggctcttgatgcaaatttggagaatcattaccatcaggtcacagaaggaccccgggcaaggcaatacaagggtctcgatttatgcttatgtgtttgggagacaaaaaggattccaagggaggcttatattgagatacaagatatgactcattgcaattgagtaggcatagagcccaaagaaagctgatttgtagaacagttgactcatagtagacacctagaatatggtcattcacatatttatactatctgtttctcaaaatttgttttaatgatggagtccctattagaaagagacattttgcgtgatgtatagctacctaataccaaagcaatacaaggtttacttttcacctgctcatgtattcaaggatttgccatcattagatatccaaatgagccataaaaaattgtgcaaaatgttattccttaatacataatattttaatttattaaaaaatgagttttacaaatgagtatcaaaagcttagcaccccatcatccctgtcaatgttcacaaaataataaattctaaaatctttaagatgtatatttaattactcatccaagatcagttattgcatgcttaatcagaaaaatacctattaacgtttaacacttagttactttacagattaaaaaacatattatacctgccatctagggagccagcatcctcggtgtatcaaaagtgtttagggcagaaagcagtgatgtgtcatagtgtaccccttttggtgtgcctgacttattagacatcttcattgtgtaagcatgatgaagaggctgatgataaggtcttcagttaaagaaacatctacctgagaagtatattttattcataacaacttttataaaaaaagagaaacattaataacaactcttctcaaatacccttatctttaaaatgcatgggttggattagttgggctctaaattcttttacagctttaagaatttttgaaggtattctaaagtatggaggcataggaacaactccagaaccggtggatctggagctcatttgttccaacagtcgtccttcaaagttatatttgattccacctccacgttctgtatttactaacatattttgcgttgatgctaaaacagtaaggactggagttcactttcaggaaggggcagtagcagaaaagaagaacagctgaagaatgaaaaaagctacacagtgggagaagcaaattcttgatctgagttctaagcccatttctctcaattaacattaacatagaagaaaccccgacaagcacctgcctttctattttaagactatattctttaggcctgccttcatttaatttcttgcagtatggttcgtttttttccattggattaactcctttgagtttcacgtttttccttccacttgattcatttgagtcatcttaatattcctctcagaagcctacaatagttacagtaacacatcatacttcccaaattaaatcttaacgtgttcaaagccacctggaaattgccctaccccattttctaaaaccactcagaatgtgtaatctcttcttgaattaagtgagcctgctttctctggcttctaagtcattgaatatgctccaggatatgcttttcctttctgcataatctgtccccccacctcttctacactttgaaaaccttcttctttatttctctccttccctccatccttctcggtttttctcctttcccccttcctctctctttttctttcttttctttctttctctctttctttccttcctttctttttcgttcttctttttccttcttccttccttcattccttccttccatctttccgtctttccctctttcttttttttttctttttttctttccataccatgttctgtgccatgcgctgggaatacaaagacaaatacaaggaattgacaacacctaacaattctagtgacttcattcagccctgcattcctaagcagttatgtacccacagctatcttactttgttttcactccttggatttatttgaatctgtcctcaatgtcatgtgttcttttgttctttccctatgtgtcccattttagtaagttccctgttggataaacctgaagcttttcttacacagcattttctcccagagccattagagtggtgtctcacacacactcaggcaatgccattgctgactgattctttagcaaggggaacaatgtaaaacaacagcatttttctagtgatgcagcatttcatctctagtgagacttagcatggtccccaaagtatcattacatttatttattattattaaagagtcaatgtgataactttctgtgacatgttctgttatttttttagttgtgttgatgttcctttcagctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaagagacaatcttttcaagaaacagaaaaactcaataatgacatctagattttcatgagccaagaactttcccttcctcatgtgtattcctctgtttgtacttaaattcatgtgacattcatttttttcctagtatggatatgcttattaatgcacttgtttcaaaatcccaaattgcacaaatgtgttaatattttaagaaacaaaatgaatcctacaaggagaatgatttttagccacacatagggttggatcttgagagtgacctacagaataaaagtacttttaaaataaagtagtcagaggctattcaaagggtaaaataatcatagtaccacattggtccacttgacactaaccaatcgatcatttttttttaatcaagaaagctagattctatcagataaaatcactgcttctaaagagtttaaatctagttagaaaaagttatagaaatgtttgcaaagataagtaacagatagagtcagtagaggataagatcaaaaacaaaaccaagcaaaagatgagttcaggggagtttgccatcaagttggcaaaactgacttacttagggaagaaagttataaaacaggaaaatatgagatgaaccttgagtgatgtggaagatttagataaatggaaaggaaggagaaaatggagttctttaggtggttgtaattggaggaggaaatgaatacacacatcttgttgacttaaacccagacattcagcagctctctatacatatctggaaaagactgcacagtcacctcctgtctctcaccccaggtattacttagaattattatcatatttcccttcctttaaagtaagtaagggtgattggtgacaatatggagaactatgatttttccattaacctaataataattggtatttattgagttctgttaagcattttacatattaactcacttaagcctttcaacagccttgcaaaataggtattattatcccca

SEQ ID NO: 67804 - DNA, 2085 bp, Homo sapiens
gcaggactggcaaagtgcacgctaaagaaagaaggaagaaatttttcaaaaagcagctctggggaggtttcatactccccccccccccccgcctttttttaatttttaagtgaatattttccaaatttgatcagttccagcccctccctccactcccacccaactgcccttttttctctcgtcaaagcataagctacagagttacagtctcgagatttggtgtatcgcttcctgcccccgcctcccctccccgcccccgttctccgtcctctattgaaacacctcgcccagcctagcgcactgagagctctcattttccccccttgctcgggatggtgccacaggaggctgtgcgggccccgctccgcttcgaatgggtgagttcagaacgctattcgtctttacacttctatagcctccgaatcctacttcttggtcttctcctttgaaaacccgatttctatgatttttgcatgcggcatacttgccctgggggaaagagatgcctcctattttctcttcagtcatttgtgctagtcgtaaattaaagctttgaaaagacactaaatccttattgtagactatggttttaaaaacttgggcatttctgagtctgtgcatattattttccgttttagtgaactattttgcccaaatcttgaaagagttttctctgatgtactcgtgatcgtatgtgtatgtgcgtgattgtatatgcgcccccagatactgcgtatgtgtgtatatatgtattaggcttaaacggaatctcaattttgtgaaggaaaggagcttagagaagaaataccataccacctgtttgttgcatcttagttatgaacctcgaacagaaattgcctgtcattcttgttttgctttgctttgtctcaagaaagaaaacattgttgcgctcctctcagtccctgagaccctaacttgtgatgtttaccgtttaaatccacgggttaggctcttgggagctgcgagtcgtgcttttgcatcctggaaatttggtggaattttattctttaaagcaaaaacaaaagaaaagaaagtttgtctgaggtgattgagtatacctctgaggttttcattgttagatgggatcaggtgaccagagagtggcagctcctggatttctgttaaagtaggtatatattttgctttaatagcgtgttggctgctatgtgtatgtatgcatgttattgatgcctgaggcttgtggaactcatctgcctggtctattccttgagagcaacacgcagtagtatacgagcgtaacaagaacagctcagtacctggtgcttgacctcagaacatctcagctgaagtcccagcatgccccatgtctccaactttcaaactccacagttaatcttaaaattgtgcccaattaaaatgggcatgtgaatatattatatattcagtgtccacacatgtgtatcatggatggctagacagtgaacatacagacgcagataaaggcaaactaatagtttggagtaaaatattaataggttaaaattctattcttgcaattccacacaaaggatggaagttatggtattaataaaaattaagtttgtatgactttgcaagattttttaaaaataaaaggagggataccacctccttgcttggtatcttttacaaaatgttatactttatggatataaaggtgataaagattggaaataaatcttctaaatatgtaaaatgaaagcaacagcaacagcaaacacaattatcgtattctttgggagtaacaaatactggttttcattttaaaactaaggaaaattttatcagtacttaaattcaatccaaaaaaggttttataacacccaaactgtacatttaaaattatcctttcttaaggtaatggctagcattacctagtttgtagttttcttgagctgtaactttttataactgaatcatttcagtgatttagggctgtctcgtagttggggaagagaaacagtaacttacctttcctttgttgtgaaaaattctagtataaaatatcatttaaacaattttcgtattattgggccaacatttctcttctatgtttgaaaaaca

SEQ ID NO: 67805 - DNA, 1072 bp, Homo sapiens
ctgggaggtccaagatcaaggtgctggtgggttctgttgtctggtgaaggctacatcctccagaggggtacagcctcctctgtgtccccacatggcagaatgatgcgtgaagtctcttttataagggccttaaccccattcatgagagaggacccttcatggtctaaccacctcttaaaggccctacctcttaatactaccatattggcaacacctgaattttggagaggacacattcaaaccatagcggtgagtttactagaattatgacaaatgtttaaatagcatcagcaatctaggttattggtagactagcttatttccagatgtcttgtttaaccgtgacctaagatttccagtgaattttagagtttagccccaccgtctctactatccatactctattaaccttttttttaaagtctgttcccacttttaaaatagctagaagcatccaatcttgtgttcatttagtgcatatttggtacttgctgtgtgttagacagggttctagaccctagtaattcattagcccaaaatcactaccctgtgttagcatcaataattttggccttcccttataagatacatttcaatgtgtctctgagtctttagactccagcttttgataaaaggacttataataaggtttgtgatttgcttttaatttctaaaagaatatggagcacagttgaataacatagaaactctagaattaaaacaatttgagattttcaagggcatggccctttaaatagtcctaaatcaccactttattttgtcaggctcaccggcaaaggcaaggcagggctcaaggggcaattaccttctatgccatggctaaatgaagtgtgttttcttttcaatattgactgaaatctcaatccatcttgggcacaaggctaggcactgtcacatgctatttctttgcattgttccaatagccttgtgaaatatatctcatcgttattccaattttacagataagaaaattggggctctaagtggctaaggaaggcatccaacaccatacccctaataaataaggtagagaggactgaaatccagattt

SEQ ID NO: 67806 - DNA, 1050 bp, Homo sapiens
gtgaacacaacagacatattttatctcccagacactgagtaatgtaactgattaggttttcttctttgattggctgccagccagtttagagctaaatttttaccccctcaacacctcctgcaaatgtttaggtcttggtggcctgtatttctgtattggctccattcctgtctccattctttagtgttatccatatttttctcctttctttttctcttctacatctagtttatcttatcgtttctggaataaagcaagatataaataattaaaatgtaattaaattgccttagcatagcatggaatttgagagttttgccttgctctctgctgctgaggggtgtattttcatgtcagcccacatactttcactcactctttcctaggaccccagctcttgtttgtgagttggcagtccaggctttgtgaagctcagggagcagaggacatgctcagattctagtcctcacaaatctttgccaataaccttggtctaatcagccttgtgtgtctttactcttgagtttgttcttcagtcacactgcaggtttgccttatcttgccttcataaattacaacaacttttttgtttaaatgcagaaacttaagaatgctcaaagttatggaatactgggtactttctgccctgaaagacacacatgcaatttagtgtaatttagagcaaagtgatcggattaaatttagtaaatctctctagaagtggaacatcaaaaatatgttctatcttttagaaaataaggtattctttatatttcttggagatatttatttaaatctgttgaatatcaatatcgggcttggggctaagggcagtttagtgtcaagagcctggggcctggagtcacattcaactctgccactaggtttgtgacatcaggccaataacttcattgtgctgtttccttatttgtattggttaaaagagaacactacctcctccctagaggattcatgagataacacatgggatttatgggatattgtgatgattcatgggataacatatggaattgcttgtctgagtgcctg

SEQ ID NO: 67807 - DNA, 1073 bp, Homo sapiens
gatttgctgcataatcctgggtaattcatttgtgccatcccaaataacactcattataccccatgatgtaccaagaactgtgcttggctgctggatatgcaggaataaacaaggatgcctctgtgtttaagagccgtagtgtcataaccatgtaattcaggctgtgaagaggtacacgaggtactaagagacctgactaaaagccacgtagcccagaaagcacaagactcacaggatccaggaaggatccactctaaggaggtgccactggagctgaggttgggaagacagggagttgggcaactggacatgttgagggtgaaggggtggggcgaggaggggatagtgtaggtgaagaggtcagtgcgtgcataggcacgatggatgagaaatcctggtgcaccaacgcagtgtatttgggggcagaggagctggagaagctggcgacaattgcatggtactagggagtctcagtttattttgaaggccccggaaaggcaccaaaggatggtgagcaagttcacgatgtaaccagatttgtctgagagagcatagcctcgccactcaaaatgtggtcctcagaccagcccttttggtaccaaccaggagcttgttagaaacatagaatctcagctctacctcaaacccactacgttagaatctccactttaataagatccttaggtgattggtatgtacactgaagtctgggacaccttgatctctagcaaggaccagcaaactctgtagagggccagagagtaaatatttcaggcttggccgaccatatggtctccatggtggctactcagctctgctgttttgcaatagcagacatggatgatatataaacaaataagcatggctgtgttccaatgaaagtttatttgtgggcactgaaattttaatttcatataatttccatcagtcacaacatgtcattcttcttttgatttttttcttcttttcttttctttttggtttgagatggagtctctctctgtcactcaggctggagtgcaatgacacgatcttggctcactgcaacctccgcctcccaagttcaagtgatt

SEQ ID NO: 67808 - DNA, 1061 bp, Homo sapiens
tatcagagctggaaggggcccttgagatccacgtaagccccttttcatttttcatgacccctggaaggttggaggacttgcccaaggtcataccgctagtgacagagcaggactagacccctgactctaccaccagctcggtcctcctcctagagctgcacgatagtcaaaaggggtggaaagaaggctcacgttggagcggtggaatgggcacttgacacggacttaaatgtaagctctgcgccaagtcactgggaccttaaagaagccattgttctctctaagccttggttccctccaccatgcaatggagagaagtcagactacacggttctctcttttcatggttcaacgctgaataatctctgtgtgggtttcaatgatgccccagagctcttaagcatatgtagtgaaagctaatacccactgtcattctcacattgcacgtcaccaggagttcagtttaatacatgagcacaaggacgtgcagctccactcccatctctcagagtctcggtttcccacctcgcccatgcagaaggctccggtaacccacatagcagttggccttttggcttatagccttctgtggaaaagacttgaacattttcttctatcttatggaaagcgaggatcaggttatcgctttggcaagcagagggaacaaccgggacaggagggtgtggccacatggagtgctggtctgacaccgaggagctttgcctggccaggttcaaaaaagcctccaccatgaatgaaaatggctctgcagggaaaaggcatgctctctgctcctgggttgtaccaaagcggctctcagccctgagctgcttatctctccctcccactctgtgagggaggccatatcagtaaggaggaagcaaggcagggagaattgactcatttcggatcctcctctgaactggggacagaagtcaaattaggctttgtcaactcaggctttgtcgactcaggcccgaggtccgataattttaagattgggtatctattaagataaaaaagaaaacttatggctaaagataaccctggcataaacatag

SEQ ID NO: 67809 - DNA, 1067 bp, Homo sapiens
gtaacagctttcttgaagctttcaagaataaaaataaaaactttaaagtacatggctgtcagaaagtccctcctggtagctaacttgagccctttgtgcttattttatcttggccaagcctccccggagcatgtgtaccagatacgataaccttccaccaaaccagggacctctcagatctcggcttttcagaacaaagaatttggatttccttagcctttcatcatcatctcatcacccaaacctttcattatctttttcaattttttctttgaactctttccaaaacttgtcttttgagttacagagaccatcacttaattagatctttcatttccaggggatactcctagtgcctaggaagaaataaattaaatttcactcggatatatttcattgggggaagggtgtagaaaaaaagaaattgaattccttatataaatagcacattgtctggtgccacaaatgcgttttccttttcccagttgtttttggaacaatgggtccttttttggtgactttaattcctcagagattctaacctctaaaaggtcatgatttgtgttgttttgtgcatacacggcttctgtactgaaaaaaaaaaagcgagatgtgtggcctctgattgtctagtaagtcgtgaggaaacagacaaggctgcaacccagcagcagttgagcaccttgtcaaagtgtgggaatgagcgtgtgtgggtctctgtgcttccagccttttctgcaccagctgttccaagcggagcagaggggtctgtcttgcttctccgtaacttcatcaacctgtaagtaggcttgccttttacagtgctgttctcattagctgtgcagacttccttatcctgatcatttggtatctgtgcgcagactttcataggggaaggggatagtctttaacttgtctttctgtggagcagaacaacagaggctggcctttgctcagccatcaccccagccaggctgctttaagcgcatttcatcacttctttccacctgagtttttctttgtgtcaaatgaagaagttgggttcacagatgacctctgaggtccct

SEQ ID NO: 67810 - DNA, 1030 bp, Homo sapiens
ttctttatcctgaaaccagtgtaacaggaccctatgtgctccaaactgggcttatcttgtatgctttatccaaagaaatatacatgattaccccagagaccttttctactatatcaatagtagggttacttgtctatgtaatttaaaaatatggtgcctctattggagaatctgcttatcaactcaatgagcaaaacattgcccaactagaagaggtgaagcaggcttccatcaaacaaatccaggatgcaattgatttggagaagtcgcagcgctcactggttcagaagcgccattacctttttgatgtgcagaggaataacattgctatggctgtggaggttacttactgggaatgactgcatagagtgtataaggaagtaaagaatcgcctggactatcatatatctgtgcagaacatgatgcgttgaaaggaacaagagcacatgataaattgggtgcagagcatctctgcacaacaggaaaaggagacaattgccaagtgcatttgggacctaaagctgttggcaaagaagactcatgcacagccagttatgtaaatgtatctatcccaattgagagagccagaaacagttgactgactaaatggaaactaggctatgtggcaaaatctttctgtattgccctctactgaagtagatagtttatatctcctaaaaatgaaacatttgttccctatactgagagaactcaatctattggccaatcagatgtttcccatccttcttactcagcatttgagttgttccatgatcatttttttattgttgttttttttgctgttgttgttgtttttagacagactctcgctctgtcacccaggctggagtgcagtggcacaatctcggttcactgcaactccgcctcctggattcaagcgattctcctgtctcagcctcccttcaagcaattctcctgtctcagcctcccgagtagccgagattgcaagcgtgcactaccacgcccggctaatttttatacttttagtagaggcagggtttcgccatgt

SEQ ID NO: 67811 - DNA, 1041 bp, Homo sapiens
gaatggcgtgaacccgggaggcggagcttgcagtgagccgagatcgtgccactgtactccagcctggacaacagagcaagactccgtctcaaaaaaaaaaaaaaaaagactgaagatggattattctctggagaaaaataaaatagaaattgtacataaaaaaaattaaaattgtctgggcacggtggctcacgcctgtaatcccagcactttgggaggctgaggcaactcccaacctcacctgaggtcgggaattcaagaccagcctgaccaacatggagaaaccccgtgtctactaaaaatacaaaattagccgggtgtggtggtgcatgcctgtaatcccagcttcttgggaggctgaggcaggagaatcgcttgaacctgggaggcggaggtcggtgagcggagatggcaccactgcactccagcctgggcaacaagagtgaaactgtctaaaaaaaaaaaagtaaaaaagaaatgggggttataatactcaaccattattttgttatgaggatgaaattagccagtctttgccagactctcagagatgctcaataaatgggggctattatcactattagattgtaataattagtattgtttcctaaggttgctgtagcaaagttccaacaactgtgtagcttaaaacaacagaaatctactggcggctagaggcctgacatcaaggtgtcagtagggccatgcttcctttaaaggagggaactgtccaatgcctctctatgagcttctagtagcttcaggtgtttcttgcatcactccagtcacatggctgtcttctttctgtgtgtcttcacatcatctctctgtacctgtctgtctctgtgtccagattcccaccactcccctcccctctttttttgagacagggtctcactctgttgcccaggctggagtgcagtggcacagtctcggctgactgcaacctctgcttcccaggctcaagcaattctccagtctcagccccctaagtagctgggactatagacgtgagacacctcacttggctaatttaaaaca

SEQ ID NO: 67812 - DNA, 1033 bp, Homo sapiens
acaatgtctcaaatgaaagtgtagaaatttttaaaaaaataaaaaacaggccagcacagtggctcacgcctgtaatcccagcactgtgggaggccaagatgggtggaccgcttgaggccaggagttcgagaccagcctggccaacatggtgaaaccctgtcgctactaaaaatacaaaaaatttagccaggcatggtggcgcatgcctgtaatcccagctactcctgaagctgaagccgacaatcctttgaactcgggcagtggaggttgcagtgagccgagatggcgccactgcattccagcctcggcaacagagtgaaactctgtctcaaaaaaacaaaaacaaaaacaaaaacgaaaaggtctggacccagcagaatggctcttgcagagaagggcggtgagaaggaccattctgccatcagcggaggtgatcatctgagactccaccatcaacatttacatgcgtacccgtgaagtgggcttcaaaaagggtgccccttgggcactcagagagatccggaaattggccatggagatgcggactccagatgtacacattgatatcaggcttaacaaaactgtctgggccaaaggaataaggaatgtcccatactatatccatatccatgtgcacagaaaacatgaggatgaagattcaccaaaaacagcgctgtacctatgtacctgttaccactttcaaaaatgtatagaccgtcaacatggatgagcgctaactgttgattataaaataaaagtataaaactaccaaaaaaaaaaaagcccagtaaacccagcacagccatgattattccattctttgagagtaagaatcttattttttttttctttttccttcttttttgtggagtgggggggcggacagagtctcactccatcgcccaggatggagtgcagtggcaccatctcagctcactgcaacctctgcctcccaggttcaagccatcctcccatctcagcctcccaagcagctaggaccacaggcatacgccaccatgcccagctaattttt

SEQ ID NO: 67813 - DNA, 4643 bp, Homo sapiens
cgcggactcgctgcgccccaccctccctttccccggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgttttttttttttttttttcctcccccactcaatggaggggaaggggatggtaaaccaagcttgagctggatttcagtgtagggtcacaatgatgaatggtccaaaacattcgcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcagactgctgagaaggaagaatttgaacatcaacagaaagagctggagaaagtttgcaaccccatcatcaccaagctgtaccagagtgcaggaggcatgccaggaggaatgcctgggggatttcctggtggtggag

SEQ ID NO: 67814 - DNA, 1483 bp, Homo sapiens
cagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaaaagtgaaaaatgagagaaattcagtattttcccaggctcagcatccagaagtctagctctgggctggaagaaaagggtactaatatttagggaagagatgagaataagtagtgggtggcaggagagggctgagctagtgcctgctaacattttagttgtatcttggaaagattt

SEQ ID NO: 67815 - DNA, 1054 bp, Homo sapiens
tccgaaagtgctgggattacaggcgggagccaccgcgccgacctccaggtctttatatctatcttcctgagtagtactgcattactctctcttattgtatgaccaaccctcttgatatatttgcagttgtagttactgaatcacagacttcgccagcaagtggccagggtttttgtttgtttgtttgtttgttttgagagggagtctcgctgtgtcccccagactggagtgcagtgacgcgatctcggctcactgcaagctccgcctcccggattcacgccattctcctgcctcagcctcccgagtagctgggactacagacgcccgccaccacgcccggctagtttttttgtatttttagtagagacggggtttcaccgtgttagccaggatggtcttgacctcctgacctcgtgatccgccctcctcgttctcccaaagtgctgggattacaggagtgagccaccgcgcgcaaccaagtggttatgttttagtgaataagtctgggtgggttcagatggtaaaactgggctgggagagaaatcatagcatgtctgaagatttgtctgccttaataggataacatttgggcattcctctggctctgccgacttccctgttttctctaacatctctcttctcccaccagtcatataaaagggaatgtaagaaaatttttttggctgggcacagtgcctcaggcctgtaatcccagcactttgggaggctgacgtgggcggatcacttgaggtcaggagttcgagaccggcctggccaacatggcaaaaccccgtctctactaaaaatacaaaagttatctgggcatggtggcacacgcctataatcccagctactcgggaggttaaggcaggagaatcacttgaacctgggaggcagaggttgtagtgagccgacatcatgctactgcactccatcaagactctgtctcaaaaaaaaaaaattttgagtagaataaaagttgatttttaaaaatggaatataacctataatgttagactctgtggaatttgacattggatcctagaatttaaga

SEQ ID NO: 67816 - DNA, 1097 bp, Homo sapiens
aaataataatgtccttgttaactatgagagggacatctgggcatggagggaagggatggtcaggaacagggctagagtattaatattatgcggtaggtaccagatactggatcatggacttcatatacactattttgttgttttaatgtcataactgttagtttcatccttatgaatgaagctaaagttgtaataggtcaagtaaattgctcaaggttttagacttaccatatggtggagctgggattcaaacttctccctactttcaggctgtttttagcagcctgtttataccaaggttagctacgtgtttggaacactccctcctgggggatgccttgtcatcagagggcagctgacagatcagaagatgctatggtggatatgaggatccttccatcaggctggtaaaaactggaaaagttgtctctggtctgaagaggtgtctatttttatcagacgcgtagcctgtcccatgcacaatgtagaatgatactgtcaaaatcgcgtttttacagtcctttttctagaactttgtagagagcatgacccttctgttacgacatcctttctttcttggacatattagaatatacttgattatgttataacattctttggttagtttcaattccaatgattctaaggtcacttttcctaactttaggagtgtattatcatgttttaaaaacatgttagtgcaaactacaaactcatttattcatctaaatgttttgagcacttactttattgaggctgacactaggttcagactgggaacaggaagatggataagctcatctcttcccatgtgagacagatgcataaacaagtacaatgttgtgtgctaaattgtcacggtgtttaaagtgctatacagatagctactctcacttgattagtttttcattcatttaaaaaaaaaaaaatcaagccaggcatggtggctcacatctttaactccagcactttgggaggccgagatgggtcaatcaactgaggtcaggaattagagaccagcctgaccaacatgacgaaaccctgtctctactaaaaatacaaaaactagctaggcgtggtggcacgtgcctgtaatc

SEQ ID NO: 67817 - DNA, 1838 bp, Homo sapiens
ttcaagagacttgagaattgaaatcctgataggcaggagcaagataaatatcactctagttccatctatccctaaggagaaccagcttaagcgcaaagacaatctctcatttgcaaatatgggcatgattcctttttttgcttttaattgcccaaatcttgcccctttgtccggcatctggtcaaggaacagggaagttctcagataagggatgtgggagaactgggaccaagtccttggaatttgaatttttcctcccacggtggttgtctgggttgctgttcttgcccactctgtgatccaagtagttgctgagttcagaattgccatgggcttttggaaacctcagtaactgctagttaactaaagtaacaggtgtgaaattagttctgtggttcagttctgccaatcttaaacccataaaaagtacagagttctacgtgtattaatcagcagtatccttctctctcccatccattttcgcctgcctgaataatctccaagaactactctaaaagaacacaagtattgactttgacaaattacacctccctttaaacattcctctgctcagcttctgaattcttctgacagtctaaaaaatagatccaataagacaatattattgcatttcctttagattgatttatcttgggagcatctcctctttcttgtctgtacacctggcactgagatggtagctggcataaaaatccaaagataaatgcttaaaaacatcagcaaccaaattaattcaggaatttatctcactcatgtgaacttaatgatcattctcatgtttgatgagatgttctgggtggataaagcatcagagcaaagagagcaaaatgcgtggtgggtgcaggaaaaaggaaagttccttaggagaaacagagttgagcagtcgccagagtataactcagtagtaacatcaccaaggaagagaaggggtctgtgatgcacaggaagccagcgccaggcctggtgaatatcaaaagcagcagatggggagacaaggaggccggctggaagggaaagggtggctattgtcctgctctgtttatctgttgcttgcttttattgagcacccaagaggacaaatctctgaactagacgtgctccctgacctcttcctgcaagtaacattcagaagagctggaagataatatacacttagaaggtccagtggctctccatttgttattcttccaatggaagaccctgaactaggaacttgaggagaaagattagccatctaaagaaaagacttgcaaaagatctcaaactcaaatgaaatggatcgccttccaccaccatgcgcttccagctgaaaagtggtcatgtgtgtgtatggcagtggctctgccaccttctatgtggctcctttgtgttttagactgagtatggaaaggtgctcagcacactctgtccttttttccctgttagcataggtatatttctgtgtccacaggtacaaagccaaggacctatgtgttctagtggtcagaacactggacttggtaatggttatcaaagctactgtttattaagcgttttctctgcaccagggaggtagtcgaaggtgctatcttacttctgaagatgctgaggcttgaagacattgattaacttaccaagaccgtggaattagtaagaggaagacctgcattggcacccaggttgatctgacttcaaagcctgcattttttttactgcctatggcaatctgtctcccagaaaccagaacaactagtttaaattcccagctctgctactccctagctgaatatttcatgactctggccctcagtctgtcaaatggaagggttgtgctaggt

SEQ ID NO: 67818 - DNA, 1007 bp, Homo sapiens
gagccatgggcaacagaaacagctggaaagggctgaaggatgtgttttgaacagggttttaacggtcaaaagggttatggcttgaaaaaaagaagggactgcaggtgcaagtgagtaaggacagcgttcaggctaagagagctcagggtatctgcttcccaatcaagtgaaacattttagattcctgcttggaggttttccctcaggccgggtgaaatgtaaatgatcactcttagccactgctgtgcccaaggcttgaattaaatctcacaggatttcagttccagaatctactgtgagtgggaaaagtggctgaagtgtgtgggaagagggtgctggtggcttttcttccttgtaagaggtatacacttaaattcagagtgcccagaacaaacttaaagcttcctcccttgtttcttctccctcttcccaagctgcccatagaatcttctggcccctgtcttgtggaccatccttttgtgtttttggcctccaagcgaatggtggtgtcctggcttcctttcttcccataagcccctgagaccctcatcttctatgtcaagagcccgcccaaaactcaggttccttgaactgggaagttatcagatcccttgcaaaacactcgtccttggaggaagtacaaggcagtgaacaaactctgtggaacttggcttagctcccgatcctgaagtttggagttacagtgcaatctcctcagcatccctggagccggaagaggtgaccttggcaggcctgacacctgatggcaaggggtttctgctttctgtgctatgtccaggagttaaagtagagtgaaaccaaatcactcctgagagggccagtggctggatttcagaaacgggggctgacattccagggagtcatttatgggagggcctggccttggctcttcagccgcagtatctctctccctgaggaagaaatatttcccttggtttcccagcctctcaaaagttgtgtaatgtcaggatgccttgagcttttcc

SEQ ID NO: 67819 - DNA, 1026 bp, Homo sapiens
tctttagattatgaagtcttgtgagttctgccctggttctcagttttatgccccctgttaatcaaaacagttcagcttatcaatttagaccgacgtatatggagacatggcacttccaaggagcaaagactaatcattcttgtcaagatgcttaatcaggtacgatctgatctgatggcagttctctcagtccctggagtaccctccactctctgtgcaaagctttctagattgcagcaatcataatctcaaaattagaagaggccacagaggtcgcccagcacagccaccttccctgtgctgtgcaccaaacatctccagaagtatactgtccgtttctgagcgtgatgtctttgcctgctcttcttctaccagttctatgattgacagttcctcaactcactttatattatctctgctgcttggggcattcctggaagagatgagtagtgctgagatgcatataccctaatacattttccccaaggacatagctgcttgctaactagagagaactctgccttttgtttggtatttgggactttacactgatataaattctattctaatttctcctctctaaccactcactcctccaaccacaggaaatgttacaaaggttctcccatctaaacctctgcccagaaaaactctctcgatttcttcccgggtcctttgttcccatcctggcccactcgcagtcccctaagctctttatggtggatggggatgttgttttgcatcaactcgctttggagagtatgaggaacagagagaatgtggtcagaagtatgcttcctctggtggtccctgtgaccggccccccctccaacccccaaaacctcagaaattggctctagtatgtgttcactcaccatagcccttccgaagaaagtctttcttctcatcttggctgctgggttccttctcctggagagaacaagtttccggagctcaaattagtctcccaggctcagctcagaactaacttacgctctgcacctaattcttcctacccagttaaga

SEQ ID NO: 67820 - DNA, 1004 bp, Homo sapiens
agtgactcccgctgtgctagtttttcttgtgccaggcagcttctctccatccacagctcctctctgtttcacctctctcctcccacttccaaccagatcagtttctctgattttctttttttcttttttgagacaagatctggctctgttgctcaacctggagtgccatggtgcaatcccggctcactgcaacctccgcctaccaggttcaagcgattctcatacctcagcctcccaagtagctggaatcacaggcgtgcaccaccaggcccagctaatttttgtatttttagtagagatggggtttcaccatgttggccaggctggtctcaaactcctgatctcaagtgatcctccagccttggcctcccaaagtgctagaattacaggcttgagccaccatgcccaaccagttctctaattttctttatgacttttctttatttccatgtagactcttactgtttttgatgacatttttctaccactctccccaaagcccctcttaatgtcggacaccctgttcggcaagtatctcctgttgtatttccttattcctctttttctatattttccttattttagtgactgtctcacctctctctttcaatgtctttaaaaaatatattaatttttttttaagagatgggagtctctcactctgttttccgggctggtcctgaactcctggcctcaagtgactcttcccccttagcctccccaagtgctgggattatagacgcgagccatcatgctcagcttgttttgatgtctttgttcacctaaaacagcaggtgggtttgactgctgtccactctacctctacaatcatcaattctgtgggggacataaaatttcctgctctggggtaagaggtcacatggattaggggaagacaggtggtaaaccactgaatgaaaaacaaacacctaactcttaggtaatatttattatgtgccagacacaactctaatccctttacatatgttatctcagttaatctt

SEQ ID NO: 67821 - DNA, 1007 bp, Homo sapiens
ctctttcattctcttttctggagttttctttgactctgggacttctccccactctcattaaagcctcctgcccagccccactgttccctgcctcctgcccagccccaacttctaggttgtctactctgcagttaacagcactctccctcctgctttgagttcagacatatgaatctctgtgtaatacacatatggtgcttctgaagccttctgcacatgttcaccagggctgtgtcacagttctttaaaaactgagtcggtagatgtttttggtcattcaggagactgggtggacccccattaacatggatctgatttctgtgtgactttgatgtaatagaacatccttctccatggatactagccttctgctctccatgtgtttgtacatttgactatcagcccaggaataaagaggatggcaggccacagcaagagccagaagaaacattacaggcctctgagcagagaagatgacgtgtagattggcttggcccccacacctttggtttgtggtgggggtatgattgattactctactgcagtgctagcaaagcctcatggcttttcaagtttattgtattcaagaccatagtctagggcttatagaaaccaggcaataggctaaagaaaaccatctattagcctaaattccactactctcatcctcaaccttttttattagtgtgggatggaataggaatgggagaagtgttgaattgtttattgtggctggaaaaaaaacacgttcctctaacaggatgtgtgcctgtatcaggatatacatccttcccccttacctcaatttgaatcagagtagttaaattaaaataaggtgaacatgagtaaattcatttaaatactttttatctaaaagcaattttcactgtacataggacataggagattggtttaaatgtatataccaatctctgaatagtcccaagattttttccttaatgtttaataatgcattttttataatttgccatcttcagtttaaaaaa

SEQ ID NO: 67822 - DNA, 1126 bp, Homo sapiens
gtctgctgccagcctgaaccggcaggaatgtgttacagtggttagaacatgtctctgggaatcatagaacttggttttctgctcctcccagccctacaggctgtgtgatcagatccgagtcacttaacttctctggacttccatctcctggtctgcacaaaggtgaaaattacacacatctgttgttttaatcagtttagatctgtcaaattctcagttttcttagaaaggagccagagagagcaaactatagagaacaggtctccctggacccattctctcctctgtctccgcttcctctctcttttccttccttccacaaacatctgaatagcccctttgaatatgaggtggtgcaaagtgcttgtactaccttgacagtgggcagtggcgaccatgaaagcaggcatctgcaactgtgtttggatcccaaactgctgcaagcagtttgctctctggtgggaacgctgctgtctgtcttcaccagggccttgcaaagcctctagtgaactagctcttgaggttgtaggtggtttgttatcaaccagctggttctcaggggatggtggtggcaagtgctctggaaaaggtatgatttggggattttggggatttattctgtggctggtttggaaaggtctgtttagtttctatttgcatatggaggcagaaacagcctgattttacttaggcccttgctgtcccttagtccagattgcacatgatctaagcaggtatagcatcagatgttagagacgaatcattccttttttattttctacaaaaaatgaaaaattagccaggggtggtggcatgcacctgtagtcccagctactcaggaggctgaggcatttactttcaggaccttgaccaagagagaatctgattggctaacagaaaccgatgtcatttcaaagcagcattgtgaatctttttttttttttttttttttttaaccttctctaatccagaccctttggaaatttacttcaggtattttcagtctgtgcctgtgaaccattcagggctctgaatggacttcaggagagggtccacgagcccccttcattggtaggcagaattttgtatctctgtacatttttctggggagagtatccttggcttt

SEQ ID NO: 67823 - DNA, 1033 bp, Homo sapiens
gatttgcttgggtcatgaacatattagacgctccataagtatggttctgtttttgagacggggtcttgctctgtcacccaggctggagagcaatggcacgatcttggctcactgcaccctccaccttctgggctcaagcaattctcctgcctcagcctcccgagtagctgggattacaggtgcacaccaccacgtccagctaatttttgtgtttttagtggagacggggtttcaccatgttggccaggctggtttcaaactcctgacctcaaatgatccacctgtctcagcctcccaaagtgctgggattacaggcatgagccactgctcccagccatatgtacagttcttgttgaaaaaataaacagctgattgacctaacagaaagagcacaaaacaatgcaaaaatattcccaacaaaatagggaaaattggaaaatttgttgacataaaggagaaaaagtagattaggagcaggaaatggagcctgtggttcctgtagtatatagtggtggttctgtggacatgggttgggaataatcacagcagtggtgaaaatgtattgagcacttacttgctcttagtgtcatccgctccgcatagcaacctgatgggtgcttgtcatcctcacctttttaatggatgaaggagttgaggcttagagaaatggagtaagttgctcaaggtcacatagctgttaagtatagatttgaactcaaggctaattctagaatcgcggtgctaaaccacaatacacaccaccgggggtggtgtcagtccctgttcaatgaagaatgcggtttttctgcacttgtcctatcatcgaacaatttctctgccaacaataaatagattcttattgtgtccttgggcagacgactttcacttttaaaatgagttaacgctcaattcatctgtatttttaaaaatggtaatactgatatgtaatttagtggaagaagcagaaatccccatttggtgggaggacaacaggaagcagctggctgtgggtgtatgggtgccccctcccgga

SEQ ID NO: 67824 - DNA, 1080 bp, Homo sapiens
ggaggtgggaggcaggagggccgaattctcccttggcttctgccactcagtggcggaagcctgagataggagccgatattgtggcatttgagttcacagcttccaggtttcccttggccggatggccctgggtgtctgcaggcaaggtcaacagcagcatgctctggtgacctcttaccattctagtccccatttatggatgagacaagaaacaccaatcatgtttttgttggattaggaaaggaacagtgccagggtaggcgagactttaagactcataggagaccaacagaaagtcaaagcagctgcaatcaaaaggaaaaagctgaactctttccggcctccattctaaacccagtaaagttcagaagaaaccgtggtaacaagagacttggagtaatacaaatcaaaccaacttcatgttcattaaattagtggactcagaaaggccagtttctgtgaaagtatagctgtgaaaatgcaggtaacacaaaatcttgtctagacccctgtgccctaccccctctttatcaagcctgtttataaaaacccaaaaggggttggtattcagttgttttctaaatactctgtgtattttaaaattgtttgcattgaatagttagctaatacaaaataatatataggggggcgcgatggctcacacctgcaatcccagcactttgagagaccaaggcgggtggattgcttgagcccaggagttcaagaacagcctgggcaacacagcgaaaccccatctctacaaaaaataaaaataaaaataaattagctgggcatggtggtgcgtgtctgcaatcccagctattcaggaagctgaggtgggtgaatcactggagcccaggaggtggaggctgcagtgagccgtgatcatgctactgcactccagcctgggcaacagagtgagaccctgtcaaaaaaaaaaaaaaaaagaaagaaagaaaaaggaaaataaataatatttataaaatatataaaaatatgtgtaaagtataaagaacaaatgacaattgcaggagtacctctcacctgttctgctccattgcatgtgactgatttatgcat

SEQ ID NO: 67825 - DNA, 1279 bp, Homo sapiens
gcaaattaaggcactacagttaggctgggcgcggtggctcatgcctgtaatcccaatactttgggaggccgaggtgggcgaatcacctgaggtcaggagttcaagaccagcctggtcaacatggtgaaaccccatctctactaaaaatacaaaaattaaccgggcatcgtggtgcgtgcctgtaatcccagctactcgggagactgaggcaggagaattgcttgaaccctgccggcagaggttgcaatgagctgagattgcaccacggcactccagcctgggcaacagagtgagactccatctcaaaataaataaataaattaaaaagacactacagttagtcttcagtgtcattatctgaaaatcatgaggtactgccttataacatggatgtgaagattaagtcagagaatacaggcaaaatgcttagcttgatgcctgacataactaaccctcaatatactcctattaatagctgagaaggagttgactttttggatttttgtttttgtagttaaaaaaaaaacagctagagcaaaagccaaaaaaatttacagttacaataatgtttctaatataatacttggaaatctttgatccaggttttctgtgttacttgtgatcagagcagttgatgggccaggatgagaatacagtattcacgtgtacctggagtactctcagtgacatttgcctcggggctggatcacatgacctggtatttccattgagtgaattatctaggtcataaaggacaactctttgtacttctggaatctgttgcatcccttcaatatctgtgctgaaagtatggcctgggtacaggctccaggagctttgaaaacataattttggatgtgttcagaagtcctggcagcatttgggtttgtctggcatggggctatggatagatcaattccacagccaagggctgctttgggaacacctttctgaaaactcagtataccttatttttttctttctttcgttttttacttgtggaatcaggtcacaaaaggttagtatatcttaaagagtgtttcttctggaccacgtggacattggagagataacatggtgttttagttcggtttgagtaaggtcacttaaacgcttgcttatagtaccctacaatccccaagccctcctcctcagtggggatatagagattgctgaatgacacacagtccttgtctccatggtgcttatcctctaaaaagaacaaagcagataataagtcattacaagtatgatgactgttaccaacgagggtctgcac

SEQ ID NO: 67826 - DNA, 1092 bp, Homo sapiens
ggcaggcggctccagccccaggctggatttgcagaatctgtcctttgcctccaagcccagctttcagctgggagagggggaagaaggggcagtggcagcagttcttctggctctttctccctttctctctttctctttctgtgttcaagtcacattacatgggattctgttcttttgggacttcgtcatcttttccaatatgtcctgggacctccggagctgtaacggggatgctaaggacacggtcagtggattatcgtgactgtactaatgaaaggattcaagctctcctggtaagtagaggagggatagggcaccttcctcttctgcctttcttcagccctgtgctcgccccagcaccctcaagaggtctccttcattgatgccatctcaccaggcatcgaggggttaagatgtggggactaggcactttaaaagttggggtactctccctggctcccccagctgctgcactgctgcactattttccttaccttcttcgaggtcgggggttttgtggaagttgaggggcagtggagagaatcaaattgcagctaaaacgttctccaacttcgagtacgtgaggagtggtgcgcacagagggaactttataataaagaaacatcccttccctttggcgaggtgttgtgcgtctgcatcaggctgggggtgcagttgtactcttccttagccctgaccaacacgtgattttgagggagggtgtgcggggggcctttctcacgtcagctgcttagggcgggcagtccctaggggcatccctctgaggggccaggctccatcttctaggatgcctggtgtccagaggcgagtggaccgctgcctaccccaacacaagcactcaccttgggcctttgcaagtgcctgttcctgggcttaatcttgggacattaaaggcatctctcgcttggggtgtgggagtagctgtattctagctacagaagtagtcagaatatttttaccttccatttaaaaaataaaacctttacctctctctgttttttgacccaataaggagattgcacgggcaggtgaattggcttttcatctggtggagaaactgcagattttgct

SEQ ID NO: 67827 - DNA, 1108 bp, Homo sapiens
cagcttaggcagcaagagcgaaactccatctcaaagaaaaaaaaaaataatgagggggtctcaggcaaaggagaagcaagactgggccacagaaatcagactgagggccttgggaagggagggagctgagcagcctggtcaggacagggatatgtggccatgcaagggtagacgtttaagtggcaaaacagggctcacctacagacaacctcaaaagtgaggcagaggcctgggctggctagactcagtgggaaaagccctcaggctcaggacaaccaaagagcatggagatgcactttccaattcagtgggcaggacgcttggggctgagaactggagtacacacgttcttagtgtgggaagagctttagaaattacaatcatgatgcttctgtgagctttccatttaaaaaaaaaaaaatctcatacaaccttaatacaaccctacaggaaagatgttttttttttttcccccattttatatgttaggaaacagagtctcaaacaggtcttaaataactagcccaagaccatataataaatggcagaactgggataaaactgaagaggtgatgctctaaagcctgtgctctcgacctccacactccttgatgagtgaaatgttgagctggtaggaatcggtagctttatatttcacaattgagagaaggtttgctgagggggtgaatcatcctttttggatggtggtgtgctctttatcagtaggtgatgcagtagaagatagtttccccagtctaccttccctcatagtgagccatggtggatgtcacagctgatctggtggctgtcacttcagggctgggttaggagtgattacaaaaaaattgtgaaatatatcatgcatacacaaaaatgtatataatgtatccatacagtgtaaagatgaacattgtctgttcaccgttcagttaagcattagaacattgcctatacgtgtgaggcctttttttttctcttttaaaaatctatggcaatatgcaaaggctgggaggacaagccccagagaatggaaatcttgggaaatgagcactgagtaggttcctgagtctgggtttcagagtctcccacttggaggtggcaggctatg

SEQ ID NO: 67828 - DNA, 1005 bp, Homo sapiens
cttgaggccaggagtttaagaccagcctggccaacatggtgaaaccccatctctaccaaaaacgtgaaaattagctgggtgtggtggtgcatgcctgtaatccaagctacttgggaggttgaggcatgagaatagcttcaaccccagaggtagaggttgcagtgagccgagatctaaccactggactccagcctgggtgacagagcaagaccttatctcaaaaaatatgtaaataaatgaaaaataaaataaaataaaatcgggttaatgacatctaccccagagggctgttgtgaagactgtcaggattcaatgaaataattcgtgttgatgctcttgggatggggcctggcacgttataaaagttagctgcccctatattttttttgttttatatttagcactatatacagaaaacatggctacagtccttgcctttcctgcacttaaaatttactactgtttttcatgccttaggtggggccagcgagttctgatcattattatttttctagtagtgcctttctcaggacacaaggtcactatcagtcagtttgacccttcctttcaagtgaacagcctccccagtcatgtgttttggtctcattgctggagctcttccaactcctgtcccacaaggttatggtcacttgaccactgcactggaggctggaacttgttctacatttactggaagtgtgactttgggcaagtcaccaatgacctcatctctaagatgatgggcaggattagagcagtagattggtctctcagaccttcgggggcttcatgctaaggatctttagtgtacaagacctttaatattcttcctgagtttccactggattctttctgccccgtcttgaattaattgtttgtttactaaactgacatttcttgagtatctactgggctaggtggcaagcataaaaggatgagtcagtactggttgttgctctagcagagtgcctgctgtcatgggggtagccagagctggacctccct

SEQ ID NO: 67829 - DNA, 1064 bp, Homo sapiens
atgttacaatgaaccataatcatgctactatactctagccagggtgacagggtaagaccctgtctcttaaaaacaaaaaactccaaacaattgggtccaattttcattcagctgtcatacaagtaacattaccaacgcttcttcaacacctgaatttgggttaaatgtggtggctcacgcctgtaatctcagcactttgggaggctaagggtagagaattgcttgaacccatgagttcaaaaccagcttaagcaacatagtgagaccccatgtccaaaaataaaaataaaaattagccagacatggtggtatgcacctgttgtcctagctcctcaggaggctgaggtggaaggatcacttgagccaggaggttgaggtttcagtgagccataatcacaccactgcactccagcctgggtgacagagagagaccctgtctcaaacaaacaaacaaacaaaacccaaaccctgaatttgattcccattacttacaaaatacagttgacaccctgaacggcatgcagggtgttctcttggctgtccccatcctgactgtccagcctcatcactcagtccattctcttattgcagctaccgacaccctcatccattgcagggcatgtcacataccgtttctatctctgcagtatttaattctgctgttcctttgcttatgcttagtgtttctgcctacggaaatcccagttatcctccagaatttagtttcagtacctcctccttgaagaaatctttgcagatttaattgatccgcgagtaggaattagttgttttctattctctgagcactatggattcctataatttcagtgtcttgggttagatatcattctgtcttttataacatattaaatcttctctaagagtaaagagttatctcaatttttctatcttccttttttttttttgagataaggtttctgtcatgtgggctggagtgcagtggcatgaccacagctcactgtacccttgacctcctgggctcaagtgatcctcccacctcagcctcccaagtggctgagactataggtgtgcaccaccatact

SEQ ID NO: 67830 - DNA, 1043 bp, Homo sapiens
tgtgccactgcactccagccagggcaacagagggagaccctgtctcaagaaggaaagataaaagaatcattaacaagtaaaaacatggaaaggtctctgaagaatggaggtataacagatgcctcttgttataacagatgtagggagcagctcctaggattgagccactcactcactgaaggacaaacttctaagaaggctccctgcacttcctccaaacccaaggctaaaattcagaacttattggagagggtgtggccattgcccagtgtatggcacagaggctctagaggttctggggactggggcacataagctggaaactgcccattagggtatcagtgaaactcattgggaggctggtgacttctgcagaaaagcaccagaacaaaaaagggcagccccttctagtgtctctctagcgccctctactgacaagatataacattgtgccagccggcaaagaagaaacgttgacagggcacagctccagcatcacaaggcagggaaaagaagggtggatttgcagctgaggggcaatacatggatacgtagcctgagtaggaacaacggaacttaccttgaagggttgttttgagggttaaatgcaatattatacaagcaccttttgccttgtagatgtttatttatggaagtagcatggtatggtgaaaagatggattttattttattataattttttgagacagagtctcactctgtcaccgaggctggggtgcaatggtgcgatcttggctcactgcaacctctgcctcctgggttcaagcaactctcctgcctcagcctcccaagtagctgggattacagatgcctgccaccacacctggctaattttttgtatcttcagtagagatggggtttcaccatgttggccaggctggtctgaactcctgatctcaggtgatgcacctgcctcagccttccaaagtgctgggattacagatgtgagccactgtgcccagtggaaaagatggatttttagaaataactgtaggatcatgggtacttaaagtacaggctcc

SEQ ID NO: 67831 - DNA, 1039 bp, Homo sapiens
gatgtaaaaccaacagaggacaacagaacctgcaattaagttctaaatgtatactgtaagggcaggggcaggagaggtacccaaccgttctcgggtgctttcacatgcttttttgacttcatcatcttttcaacagtacaaaggaggaaatatgtagtattagcattttcagatgaagaaactgagtttgagataagagtacgtgggtgaccaacaagcaatgcaactcagttttggtttcagatctgactctagtccaagatctttccgtggattaacagagaagagccagaaaggcatttcagaagaagtcggacttgagccagacaaggagggaggctgaaattggggcattgccaatatacctttctttggagctgggattcctctaggtaacggaggcagggccagacagcccagaactatctgcttcccggatactgtgcggctgctgttctatcaacgggctgcagacagaagcaatcttggaaagacttttcatgatgagcctgcaggggctggccctcccagaatgagacattttgccaacagatgcccaagaaatattagctctcagcatgagttcgagcaggatgcaggtgacatcaatggattgtaattattattcaccttcagcatgttttcctatgcagctgcagtggacagacaaaactgtctttttggaagattcaaagcatgagaatgcataagccaaacatttgctgttcagggtggtcccggaatagcaacgtgggcatcgcctggggtttgttagaaaggctgacttttgggtggtcccctagacctgctctatcagaatctgtgggtgaagaagattcttaggggattaaagtttcccaggcattgagctaaccatcatcattgttagtgttgtcggttttgtgctacatccctcaagagatgacaatggttctcaaatagttggggtgtgaggcaattagttaatcgccatgggtctagaggcaggtgatctggattcccagctctgcctctttcttgcatgggaccttcacttttc

SEQ ID NO: 67832 - DNA, 1089 bp, Homo sapiens
ttttagaatagagaaaactgtaagaggtcggtcccgctgctggcttcaatcagatgcccgtcaaccaagagaggctttagtctaatttaaaatacattcagggtacgaaatcccagggctttcccttgccacccttctcattgtctcctgctatcatcaggaagttatttatgattttaaaaagaaaaagcccagcctgggcaatatagtaagagttggtctctactatacttttaagaaaattaaaaaatgttcttaaaattagccaggtgtggtggttcacactgtgtaatcccagctacttgggaggctgaggtgggaggattgcttgagccctggagacagaggttgcagtgagccgacatcatgccactgcactccagcatgggtgacagagtgaggccttgcctcaaaaaaaagaaaaaaaaaaaaaagaaaaaaccctctgttatattgcacttaatcccattttcttttattccagctatcctggactgcaggtcagttcatcagttataatccctccctctgttcctatcctcctttctttgagtgaaacaattctacttccttaaacctattctctgaagttaaaaatcacttctcctacaacatccccacccaatctttacctctcaagggccagtcactaattgatgtgtaactcattgcaccttgggacagctctgatagtttttattttaagctcaaactgtttcctgtggcttcctaccagaggtcctatcctactcccttgtgagccatagaacaaatctaatttctcctccacgtgacattttcacgtggctctcatgccttctcggcacctgctggactctcacattaacatggcgatggctccctcagccagcgactgggctccttctcctctgaacggagtccgggtgatctcaactttcttaactgtgaagcccagacagagttgtaatactgcagagaagtggcctgagccgctcagaatagagcagaatcatcacttcacctgctttgggaatcacaatgcaaacatatattttcagtcattttctgaatcaaaagaatcaagaaattgctcactgttcctttagg

SEQ ID NO: 67833 - DNA, 1052 bp, Homo sapiens
ttatctcaaaggatatttcaaagaggaacaaattataaccatctttgaaaacactgataatgctacagaaccagtgtcagaaatcagacataaatcactttacccaaagggctcatctgcagtaaatccatctgcttcctcctccgaagctgctggggaaaaggttcatatcccctaagagaaggatttaatgaccagctatccaacttcttatagaatccaactatttcctcaacttctcttgcaccatttcctccctcattttattctagcctccctggacctttctctttcttgaacaaacccagttcacctaggatattggcacttgttggtcccaccgcctggaactcttactctaacattttgaatgctggttccttttcagccttcagatcaaagctcaaatgtcacctcctcagagcagactttcttgaagggccactccatataaagtggccttcctaaccccaggcaatcattaccacgtggccctgtttcttttcactgcccttataggagcggaaattgtcttgttttcttgttgttgttttttccttgcttaccaccaggctgagcactccatgggggctggggccacgtctatgtgtgcttccccagtacctccagcaaaatgactggcacatactggggttgcagatatatagtccatgaattttaaaaagtgggatcttctttccttttttttttttgcttttgagatggagtctcgctctgtctcccaggctagagtgcagtggcacgatctcggctcactgcaagctccgcttcctgagttcacaccattctcctgcctcagcctcccgaatagctgggactacaggcgcccgccaccacgcgtggctaattttttgtatttttagtagagacggggtttcaccatgttagccaggatggtctcgatctcctgacctcgtgatctgcccgcctcggcctcccaaagtgctgggattacaggcgtgagccaccgcgctcggccaaaaagtgggatcttcttaaagccattcattccatcgtccagccactctgat

SEQ ID NO: 67834 - DNA, 1387 bp, Homo sapiens
agagaaaggtccagggaggctagaataaaatgagggaggaaatggtgcaagagaagttgaggaaatagttggattctataagaagttggatagctggtcattaaatccttctcttaggggatatgaaccttttccccagcagcttcggaggaggaagcagatggatttactgcagatgagccctttgggtaaagtgatttatgtctgatttctgacactggttctgtagcattatcagtgttttcaaagatggttataatttgttcctctttgaaatatcctttgagataacaggaactcttgcttttttctccttggctctggcaggacccaaacaaacttattttgtttttgtaggaagggggaaaagtgggtcaggctgttttgtcatttcgggcatggagtcctggttctattgcagggccttgtctccatggaaatgaaaaatagtgtttgtcatgcctgttcctggattgaattccaaactctggactgaacagaagctgcaggaaagccaggcagcaggggggagtgggatggatggagactccagccatggtgatgaaggacctcttctccttgcctgagcaggaaaggcaaacaacctttgcccaggtccagctcttcctatcacctctctggactgagaacaccactggaagggtaactgaagtgctacttttctctacttcgccaaaaactttccgtgaactttgcccttatgttaattagtcaattaataaattcatcaacaaccaaagtcagtgctcagactttcccttgtaccaagtaattccttccaggcttgaggagatccctaatgagactatttctaggtattaaattagtcagctggctgcaaatgttttggatgggctgtcccatctttaaatttctttgtaaaaattttttaaagttttgggttttttttttaactgaaatatttatacaagacagggaaggaggaatcagtaagtggggcttgttgcccataggaagtgccctgaattatctacacagtatttacagagatagggcatgtgaggggcggagtgcagaaggaggtaggggcatgggccgtgtggacgctgagtgaatgttcggatggcccacagtagctggttcatgagcctggagaattgtcaggcttccatttgtaaggtgtctctaccagtggtctgaacccggcaacagtccagttccacctttggtccaaattttgggcagatcctgtccctgaacaccttgtacacttcacccaagatccccatttggaaaggcctccaggaatctccacaattttcccaaacggaggagaggggacaagaggttcatttctgtcaagatgttgcccttgcagcgggtagggaaggcccattctgtgtca

SEQ ID NO: 67835 - DNA, 1020 bp, Homo sapiens
tcaaaccaactttataatgtgccattcatctgaccctgccactattattaataacaggattgcattatatttcaaaatcttgggatttaagagctaaaaataaaaaagaccttacatatgctgtagggatggaaggaagactggtgttagatgggctatgggactaagactccctcccagagtttagagttagtatattcagctctcaacttcacatgtaagaaacctgagtctaggggggttaagtacctagacaaggtgatatgactttggatctggctcttcagttccacaaatatttcctgaccacctggcatatgtgaggcattcaagttcattttggtgaatgagaaaggatctgtgtgcttgggacatttccagtcaggaagagctagaggcctattcttcccgtgttaatataatcagtaggtgggatgatagaagagaataaaggaaaacaagaaatgctgccttgaggatgtggcacttgagctagattcagaaaatgtgttggagttagccaggtgaagggtacggggttcaaggagggcacggtaggagagaagagaatgttcggggtggcggacagcatgaacaagggtgaaaaggcataaaatagcatgggatatatggaacattgacagaaaccatgagtcaccaggtataacatgctcaagctgatgttttagagattcctgaaatcatcagctctcattcataataggtcttctaagacccccaccagccacctttaagccatggcaggggacccggaggtcattcattcatttccccatttcccctctttttaagacctgcaacacagactattattgctctcctcccctggttaccttgctagcaaacagtgctccctgaagtctgatcacagtatctcatgctacctatggtttgatcctacctcctatagttaggtctagctgatgtccttgagaaaagggaagtagaaaaagaggatgaggactctcttcaggctttcttcagtgactctctgcggca

SEQ ID NO: 67836 - DNA, 1061 bp, Homo sapiens
attttatttgcagcttataagccttgatgtaagtggatttggtcctgtgggaagtacaaggtacttattgggaataaatgttggggtaagggaatatggaatgtgagaacttcggctgtgtgcatctttaccctgggcagaggaagcaggaacccacatggcttccttacaaggaaataatatggtgtgggtgagttacaaatcagaagagctgcactttgtttctctcaacagtgggcatttagcttccctctgtcaggcactggtcttcattttttaacatagggattatggtacttgccattactcccttggtggaatgttttaagaaataatgcgtatgtgaaggctgtgaaaaataggattgtaattgttattttcatgaacaaaaatatctgaacaaaatatagaagctttgcatttgcagtatgtataaaatgagctgattgtattggatggtctccagtgagcctttcaggtattaaattctatatgccccagacaatttttggcatataataggggctcaaacaataacaggttggacggacggatggacggatgcatgtctagatgtcgattgcccgttggctcgtgcgtctgtgtccacatgggcactgctgccctcccgtggccaacggcagtattacggtgcggcaagccgcagcctgggcccctctctcccggtttctccccagcccctcacctggctccctgagctggctcctttgggcttgtccttggcctcgatcactgactgcctgcctttcctcctccttctctttccaccccgctccctctctccatctgccgctgcagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaaggtgagcgggaccccgttgaggcggtacctcc

SEQ ID NO: 67837 - DNA, 1029 bp, Homo sapiens
agcaccccctccctctggccctgccgattctggcccttatatcctgcttggtccctttcccagaagggccggccccactgtcccccggcaggctggcttggaagtcattgaaggcccattttcactgcacctgatgtcggagaacagaccctcccccactcccgaccctgcacccatgtctgcctgctccctggacactgcctctggctgggagtttattccctccttacatggtgcggtcgagaaacagagccctgcctggcgttagtttcattcctttggggcaggagaccccatctggttgtactccaggcccctcccctttggtggttgattctggattgcccagcagtggtgagtgaggatggcaggagggctgcgctgactggggggcaggggttcaggtcgatgagttcattggtgcagcagccacgccctcaggagctctgcctgcgtactctgttcctccccactcgagagctgctcaacctgggcaccccttagcatttctaaccactgcccagactggggttcatggtgtgcttaggatcctgaatcatgatcagaggggaaagctgttctcccagagggtggggtgcccatgcctggaggttggcaaacattggcagaacctggagagatgtggccagtgccagagtctttcccgggagcccaggaattctgaggccacaggagaacgtgcagcgagtggagggtgagcgataggtgttgtggaacaacaaggcccatggggcaaggaggtgggatgcagcccgaagaaggggaagccgaggatgacttaataatagtcccaagtctctccgtgctttggggaggaggagggtgaacagctgttccctttcctaagggaagcacaaggggcgacacggctaatcctgtagtctgtgatctttagactaaatgcacatcttggctgtgaggattttaaatggccgttcctggctgtggacagggaaggaggaactttacctggagcgaggaagccagcaggagatctctgtgggctcc

SEQ ID NO: 67838 - DNA, 1892 bp, Homo sapiens
tcttcctgcctcccttcctgagtttttcagatgagcccccagcccagcccagccccaccccttctctacccttctccatagcccccatgcctgcctcagtctccctttccctcctttgctcagttacgtcctcgtctcccgtcccactctgccttctgcctatccagatttggctgtaaggtcagagtttcctgtgtggatcttaactggtttcttcctagctgagatcaatgccccaccgaaatccatctgttttctcctgggctcctccaccccctccttctcgccatccctgggaagagggtaccacttggtcccagctcctggtgtttgccgtagagttaatgtttagcccagggtcaattcgttctctgctggctctcacccagccctgcccagcccttggcatgggtgtgggggagacaaagccttctgcgtacgggactcatctcccagggctttatctcacagggcgtatcctgtctctatctcaccccttacagctcaggcagccacttggcctgtagcaatactcaaatgtttttgggtagttactgtaaggatccagagcctcctggagctacctacagcctacatactggggtctggtgtcaccccaagggaggcattctgatcaccttggaaaatggacttgctacgtttgcctgccacgctgctcgggatagggctgacatgcagggcgaagagaagtttgcacgtgtgctggggagagtgttggcagcaaccaggtactgacacgccaagcatatagaatcagggatcttcgtgtgtacatgtaagatgcagtgtcaacaggcatcctttgagaggtagataaggaatgcattcacttggtaaatactttcttagcacctgatacagtatcccttatccaaaatgtttgggatcagatgtgttttggatttctgatttttttggattttggaatatttgcatatatatataatgagatatcttgggacccaagtctaaacaccaaatttatttcctatatcccttatacatatagcctgaggataattttatataatattttaaataattttatgcacaaagaaaagtgctgactgtgttccattcctacaaacctttgtttgtgaccggaatgtgtcacatgagcagcgtgtcacgtgaggtcaggtgtggagtcttctgcttgcggcatcatgttggggctcaaagggtttcatgttttcagattagggatgctcaacctgtccttgaaacatatcacggcaagtgcagtagaagatatgaacctgtttgaggcatagatccttcctggaggtgtccttcagacagagtgagacatgctacaccatgaatggagagctgcgtctgcatccgtggggtgtccatctagagagggttgtaggagtttgttaggggagggtttgcaggaggagtcagactcttctactttctccaacactgtttacctgggagaatccaggttcctttaaattagcgtctttggaatctactttttttgagagtctctctctgccgcccaggctggagtgcagtggtgcgatctccgctcactgcaacctccacctctgaggttcgagcaattctcctgcctcagcctcctgagtagctgggattacagacacctgccaccatgtgtggctaatttttatatatatatatatatatatatttgtagtagagacggggtttcactatgttggccaggctggtctcacactcctgacctaaagtgatccgtccgaattggcttcccaaagtgctgggattacaagcacgagccactgtgcccagcctggaatctacgtttttacatgtgttcactgggccattttgaagtacagtaaagtttgggggctgctgtattaaattaccaagac

SEQ ID NO: 67839 - DNA, 1100 bp, Homo sapiens
tgcctgttagctaaatggagatgccaagtgggcatttagatatggagtgtggagtgcacagggaagcctgggctgaggccataaacgcagcaattattagtggatagtcatgagactagctgaaatttcaagtgactcggtgaacctaaaaaggagttcaaggactgcctgggagcactcagtgagggaaagaagcagctgaagagagcttgaaagcacatgcagtgagggaggaaggccctaggaaggtttcctatcctggcagccacgggaaggaagtgaagcagaaggtattgtcactgtatcacatgctgtcgataggttaagcaagatgggaagatgtgcctgtagactggcacaaagcatgcttgagggtggaagggtagctagctgcaagcttggtggtcgtgcaagaggcatacagggaaaaaagcaagaaaagaacattgaatgtctgttgtgcttaggtctgggctcagtcgaaataatagtgttgtcgcttaacctctatgaatacccatttggttatctccaaaatgcacataaggatttccggagagttgtcaagcatctggatttgttaagtacaggtcagatgatggtgatgatgataggctgatgattgctcccttagaggaggctacagcggcatccctgaagtgttcctcgacgagcacccaccttcatctcaaggaggttttctttctaggtgtataatgcagggaagttttctagttatcatcaagaatttgggcaatgccacttaaggagcgctcatgtccagagtcctgtcttcgtcaccgtttgggaaaggaaatgcatgctcagaacccagatatttgattcagaggcttcaaataggatgggcacccatggaaaaaaaatagcttaagacaaataatcctttcagttaggtagggataactctaaggaggctgcctaggaaaggtgagtttgcagccaggaattttacatggggggcagggaggggtggggtgggatatgaaggagatttcagaagagcaatggggtaggcaggggatttttggttagaggaagatcatacacaaagcaaagaagcaggaaatctcatagatatg

SEQ ID NO: 67840 - DNA, 1046 bp, Homo sapiens
taagacgtgtatgccccaaattgtatacatgagggtgcagatattgggaacatatggttccttgcaatgttgaacaaccccagaggaagggtttgactggggctgggtcccacaagtacctcctgaggctcatgggcatccctgaggatcctcaacccacccaaccaacttcccagaatacagaataggaaaatggttctgcagagagttgcattggagggctgaaggtggcctctcctgtggtccttttgtctctgatagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggtgtgtgccaggtggggacaggtcgggtggactaagctttgggctggagctgcatgcccacaccaaggcacacacatgcacactcattttgcaccttggctataatttgtatataatttgaacgtaagtcactaaatctgaggctcccaatgctctgtttctctttgctctttaagttcctcagccccagctgaacccatatgtgtgctctaattaacaaaagctgccttagtgtttatgctttcgtgttgccctagttccatggctacctgcataggctcaagtatgaagcttccaagttcttgggaaatacactaaggagatcccacagctcagaccacagagattacctcattacacaaagatcagggagaccaagacagtccccgttcacttcaacccgcatgggccaacccaggcttgccctctcaggccgtggactcccttaatatttcttcctcttcccacccagccattcacatccttgtctttgctgaatcctggaaacctgggactctaaggggccttagagaccaactaattgagttggatatggacaggggaggcagaagaagagggga

SEQ ID NO: 67841 - DNA, 1078 bp, Homo sapiens
taaatctcttgtattggattttggtttgtagagcactgtaacctcaagttagttctgtgtttaagctctttctgcattttgactttaagtagagaaggcctgcacccctgagcaaattgtatagcatgttattaactaacttttgggttttgtaagtttagaatgatcagactctctaattcaatgctgcaggatccaggccaagtgtctgccgacagcctacacgtgggacgggctgacacagcacagcttgccctgtgtctggcaggctcttgcccccacatgcctgctgcagtgtgactcagccacctcctttctctatttcgacaactgcgcaggcttcacttagacagcacacaggggtatcccttgaccttcacttagcacagagaggattgcaaacataaacccaaatgcaggcaccaagatcgtgagcaggctgtgccaaagaggcgggtgttcagatgacccagtgagtgctgataaaattaaagaccgtggcactgaaattcaacataaaagttttaaaggccttggggacaactcagagaggcctgagaacacagcagccccagaaatttgtggctgtcagtttaaggaagactaccttccacagtaccagaagcacggatgacacacacggtaccacttgcacaggcataagctttgaaaagcctaaggcatagcataagcttttctttcttcgctggtcttttatccatctctcttttatctgtttttctttctttccttttttttttttttttgtttgtttgtttgtttgagacaggttctcactctgttgcccaggctggaatgcagtagcatgatctcagctcactctaacttccccttcccgggctcaagcaatcctcctgcctcagcttccctagtagctgggaccacaggtgcatgtcaccacacctgactaatttttaaaaatatttttttgtagagatggggttttgctatgttgcccaggctggttttgaactccccagctcaagcaatccacccaccttggcctcccaaagtgctgggattacaggcgtgagccaccatgcccagcctatcttct

SEQ ID NO: 67842 - DNA, 1094 bp, Homo sapiens
tctttcttttcttcttccttccttccttcctttctctctttctttctttcttctttctttctttcctctctctttttttcttttctttctctctccctctccctttccccctctgtctctctctctttttaaaaggcagggtcttgctctgttgcccaggctggagtgcagtggtgcagtcatagttcactgcagttgcaaactcccgggttcaagccatcctcccaccccagcctcctgagtagttaggactacaggtgcatatcacaaagcctggctataatttttaaattttttatagagatggggtctctctgtgttgcccaggttggtctgaaactcctggcctcaagtgatcctcccacctctgcctcccaaagtgctgggattacaggtgtgcgtcactgcacccagcctgactgtcccctttctgtttgaaacagtgttgagaaccacccttgctttaggtgcccgactcttttcagccccatggcgtggttggaggcctgccctaggcgggtgtggggagagggctgctcggtggagaatcccactaaaagcgcagacccaggcctggggtggggttttctgtcttgcagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcat

SEQ ID NO: 67843 - DNA, 1052 bp, Homo sapiens
tccctgaggtagtcaggggaaagagtgctatttccagtttagagatgagaaaatgagctcggggaagggaaaggacttgctagagaacccttgttttctgatttcagtcttccagtgctccttctagcacctctcatggacacatgtgctactatgcacaatcgccaggagggcacctgtcctcccatttctcttctgagctaccgtcccatctctccccaacaccatcacctgtcctagggcctcactcactagcacctagtaccttctctgcccttcttctccaggcctgcccttctagttgccctgtgtgttttcctctcttcccctggtgatctttcgtgcatcctattcaaggccctaagtgaccagctaaattgacagaacaagtcacgtcagggtgtcagcatctaaaaataacctcatttattacccctttttggaaattgtttatattctaatcaaatttttcattatctcagtgcaaaggaaagcattctagagcaatctcaggaggaaaaattgggcattgtccaaagaagagaaagatttgagggtatcagagaagctggttcataattctttattatctgcctcatgatagatggatgctactactccctagtgaaatatgatcattattaataatcatgtttttccttctcataaatttcttcattattattatgggaattgaagagaagaacaaaggtcaaatgatttggtcaacattattccaagagtttgttacttttagtcagcaatgtagtttgagctcctgccatatttacagccttctttgaatacctagagggtttcatagaaagaagggcagtggtggactgggtgctgtggctcatgtctgtaatcccggcactttgggaggtcaaggtgggtagatcacctgaggtcagaagtttgagactagcctggccaacatagtgaaaccctgtctttactaaaaatacaaaaattagctgggcgtgatggcaggtgcctgtaatcccagctactcagggggctgaggcaggagaatcgcttgaacccaggag

SEQ ID NO: 67844 - DNA, 1031 bp, Homo sapiens
taaaagctggatgcatgaattttgagagtgaaaatactttagttgctcatcatcttcttaattttaacaaggaatgggaagaaaacagccttcagccatttactgctatatattaaataaataggcaactgtgaaatgcatctttctttttcttcttcttcttttttttttggtttgtttgtttgttgcatgaacctgtggaactaagatgctttggtgttaggggaggagagctgggtttttgccttcaaaggtgaatagattcttgcttgtcagctgtgagaaactgaggtgaccttccccctccaaataagggaatcttacacttggaacagtaaaggctgaagagagtgtcagagacggtcttggagtgcctgaatgtgtgtaaaggggattgatctatgtgataatgtctgattgtgtgattgagacaatgttttactgtatgtaaatatatttcagtgtctggatgtgtgcactagcatgtgtgtgagcatgttggcatagacatctgaatgcatgggtgagtgtagtagtatgtgtatggcaggggtgggggtggtagttctgggcatgtctgccttggtgtctatgattagatcctcagataaaatataggttctcttcagcagacagattgctttacatgatcttagctacctttctccgtgcaaaaatcaatacacagggtaattggacacaattgtacccacctgcctccctgaaacgaggcatgtgagcttatgttcccatggttggcatgaaactcatcctgcctatacggtggcagacatgctgatgggagctgcctctttgctttagtattactttttcaagcctccaggactaactctagctgccagcattatctggattttgcatgtgaccagaggcagagccaagcttcctgtcaaaatgcctgatgagacggactaggaaggttgaggagggaggtaatgtcagccccaaaggcggactcatcaccagccatccccagtagagtagaccagacctggagatggagcagctat

SEQ ID NO: 67845 - DNA, 1476 bp, Homo sapiens
agttctcccttttcctttaattactcctttttaataaagcagatagattgtgtttggcgtcttccaactattagccactccctagtcctagcagctgtttgagtgcccccgccccatctctggaagggaaacctgaaactttacattcaactataaactcaaattgacataacagattaggaacgcctggaactgaagtaaaagagtaatccaagagcccttcttcagcttcctttttctcctcttctgctctttccaaaaggggaagcttaacgctgatattccaaaatggaataacagagcaacagctgacggtgagtggaccagaagcaggaaatgctccctcctgacatctcacagagtaacagaatgtccccagtcggatcttcctgggcagggagccaccaggccataaactctgtgctgtttggaggactaggccttgaagcatgtatactgtgttaaatttggatgggaagttaaagttgacctaattcaaccgcttttccaatttgtgacttcccccaagaacatttcggacgaatggacttgattttatttatttatttatttatttatttatttatttatttattgagacggggttttgctcttcttgcccaggctggagtgcaatggcgcgatcttggctcaccgcaacctccgtcccccgggttcaagtgattctcctgtctcagcctcctgagtagctgggattacaggcatacgctgctacacccggctaattttgtatttttagtagagatggggtttctccatgttggtcaggatggtctcaaactcacaacctcaggagatccacccgcctcggcctcccaaagtgctgggattacaggcatgagccaccgcgcctggccttgatctttttagtgatgagaactttctacatcacaagttcacctcttctgatgcttaaggaagttctttatgttcagttgaattccgtacactcctcctccccctccaaactccattaagtggccctaatgctgttttctctttaaaagagctatgcttcctcacatccgccctaagacatttttgtttgtggctactcttccttagtttcttccaatgtattttctagtagtttccaatcctgtaccaccctggctgctttttcagaaggactttcagtttctcagcatgattctccaagtgacgtccagaacaggaactgatggtccctgtgtggtctgaccagcataaatccagtggaattatggctacatttgctttgaaggatataactagttaaatacatttacagccacatcttagtcataatcagcttatgttcaattaaaatccctgagtattcttcacttgacttgttgcagagtcattgtgtcttgtacaggcaattttggaaattttattatgaaactttgcacttattgctgttaaaatttattagtttcaaccagttatcacactgtgttaatacttttattg

SEQ ID NO: 67846 - DNA, 1784 bp, Homo sapiens
ccactgagaaggggagtcacctgccttctccaactgggagagaacctgagggactaactgcccattatacagactttcaacctaatcctcccttttctgtctacccctcttcccacctttgtatcttggtgcttccagtttctaaggcttttcaagtattcttgaacacagatcagcttgactctcattgacatttccttctgcaaacacttaggctttagctattccaactctctaaagtcagttgtttattcctctacttacattccagttttcaaaaatgtgttgctatctctggtctgttgttttcttctctccgttttatttgtctttatgggcttataacgttcactctcattttagggggaactcagaactcaagagggagtgtagataaacttatgtttaattcaccatatataattcaaaacctgttttccttttctaaagcccagataattatatttataaacttcctagtttgaagatcatacttcgtcaatggaaaattctatctaacttcagtctaacctgttgtaatgcatgacccagtagttctcaactctggctgtatataataatcatttttctagctctgaaaaatgctgatacttggacctaccccagataaaattaatcagactctctgaggtgaacatgtgcagcaaataataagtatatttgatgcgtagccaggaaggagaatcaacagtgtgacggtggtgatgggggtgtcttagtccatttgcattgctagaacagaatactggacactgggtaatttacaaagaacagacattcatttctcacagttctgaaggctgggaagtctggcaagggctgatctctgtttccaagatggcaccttgatgctgcattctttacagaggaagaatgctgtgtcctcatatggtgaaggcagaagagcaaacaagcctaatgctgtgtaaaacctcttttataaggatcttaatccattcatgaggggagggtcatttatgacctaaccacctcttaaaggccccatctcttaatactatcacattggcgacacgtgaattttgaaggggacacattcaaaccataacaggggggtgatggtgaggctggggtggcagtgtctgcactctgactgactccaaagtctgttaactcttgaaaaccaaccccccacacaaacacacacaccacacacacacacacaaactcacaccactttcccattggcttcctatgcaatgttccatgcctagctttggaaaataaagtatttggtgctgtcactacctgccctgatttttacttttttgttacacttgtatcagaaccactagagaactcaaaaacatgagggggaacagatccctagaaccctaatttcagttacttatgggataagaaatctcctttctacctcttctgttctagttatgttagtctgtactgaaaggcaagttgtggagggaaaggaaaaatttaaactggatgatctcccaggctttctagacttcggaactttgatcttcaatctttgcataggtgttttaaattaggtaatgtatataaagattctctgaaaagtgtaatgtgctagaagctgtttttaaaacatctaaagtgtgtaactttatgtggactcacaacaaagtcataaattaacagtcaagttagcaagtcaggtaaagtctttatcaactcagtctaagaaagaaagtaattaaacagtgatttaactctaccctgggacctgataatgggaggcccacaatcttggtaggattaat

SEQ ID NO: 67847 - DNA, 3579 bp, Homo sapiens
tttttaattattgtgaataatgttgctacgaacatgggtgtacaaatatttctttgggatctttctttcaattcctttgaatttatacacaaaagtggaacatatgataggtctatgtttaatttccaaggaactgctatgctgttttccctagtggtgacatcattttacattcccaccagtagggcacaagggttccagtttcttcacatccttgccagcacttgttgttttttgctcttgggtaatagccatcccaatggatgtgaggcatttgaaacctatgtcttttgacagcaaggtcagtgtggatcataccacaacacagaaactacactgcatcgcaccaaccacagatgcctgcagaaaacacaggagaagctctctcagaaatatgcagtcctgaatctaatgggccctgctgccctgatcaggatggcttatacaggaacagagagcacttctagtgcagtgctgtattggatggaattgcgtcccctcaaaattatacgttgaaaccctaacccccaatatgagggtatttggagatggggcatgtgggtgataattaggttatgaggtcatgagggtagagcctcctgggagaattagcgccctcataagaagagacaccagacagtttccaatctgtctccctgcttgcaaggaaagaagaggtcacgttagcacacagcaagaaggtaaccatctgcaacccaaggagaaagccctcaccagaaacccaccatgccacccaccttgatcttggacttctagcctccagaacagtgagaaaataaatttcggttttttaatccactcaaactgatatatgtatgtgtgtgtatatatatatatatatacatatatatacacacacatatatgtatatatatatgtgtatatatatacatatatgtgtgtatatatatatgtatatatatatatattttttttttttgagacagagtctcactctatcgcccaggctggagtgcaatggtgcaatctcggctcactgcaacctccgactcccgagttcaagtgattcttctgcttcagcctcccgagtatctgggactacaggtgcacgccaccacgcccagctaatttttgtatttttagtagagccagggtttcaccatattggcctggctggtctccaactcctgaccttgtgatccgccctccttggcctcccaaagtgctgggattacaggcgtgagccaccgcgcctggccctatgatatttttttttaatggcagagcaagccttgatcattgctttcttcttaaaccttattcagtgtttacttctaccagcgatggtaaatgaagtctgctgtttagtcataaagctgctaaatttcaaagtcttactgaacaacagagtgatcaggatgaaaggctgccatcaataatacgttatcttagatgaaaacacactggactaagcgaagaagtcccaatgtgtacagataagtctgtggaatggggtttggaaataaaggtttttgagactttttagaagtaaatgggaatggttaacatgtagtcctgtccagaaatacaaatcctaatcatttcatacatctctacccaatgaatctctgatctttttttcccatctttttctagaacatattccataattgcttccaagatgtgaagattttcactctggcttcaccgtatttttaaaatctttgaatttagccttggtccatatacttggcaaagaataatttctatatttctcatgcatggagggagaaaagggcatagaggagctggctgcactctgatcttcactggaagctttccctgcttagacaagcaaaggagggagaaaatatcttgtttcactggctcatattgatttcctggtcatgtctgatacctgcctgtggatagacttaatggctgcagataaatgaggctcagctagcagaagggaggctgcaaaaaatcacctgaaaatgctttgcttgtgtgggtctaatacaaaatttaaaaaaatgcagctttttgagttgcaacttaccatgacccagccaggcaaggcactggggagaacttaaattatggtcacaggactcctgatttgtggataaaagactgaggatcacgtgtagtgaggggcagaaacaagattctgcaactgctattacacggagtgaactgcaaattgaggggacactccacagagctgctttgccatttttttggtaagctcaatttgtacccctatggggcaccctttaatactgggatactgggcttggtgcagaagataagcaggaactgtttagattacatcctgatcattattctttattctctccctaatgccaggccttaatgctaggcctttatcacataataaatatttgtgctgctctatcatcgttcagtgtgcactactttgcatttagttttctatagtctgtctgccaatgagattgcaagtcctttgcatgcagggacagggtatcatgctctctgcatccccagggctctccttgtagtgtcacatacatgagcaacactagctacaaactgcttcagacagcaggagaggacagatggggtagacaaggatcctccccggaatggggaagggaaggaggggaaagacttaactgaagttgcagggaggaagtactgcctgatatgcaaaatatggcatatgattaacagacagtacatattatggggagctattcagtaagcacttgtcatcagggagctccaacaagaatgatgggtgggtgttccttagatagagagaatacagtgacagagacactaggagtaagccatatctgagaactcaagaagacaaaaggcagaaccagggcatcttctcattaggcagcagaagccttggctctgctttgctgtcaagaacagagttccagttcttgaagactgaaggacggattgacagtaagaaggcagggtcctcaattcagaaagcctcgcactagagagtagttgttgggtgtgtgtgagctctggtgttaaacccccttggtctgtgtcccattacaagctctgttactgttgaacatttgctaggcttccaggtgtgtggctacatgtattggctgtatgtctttttttgagaagtgtctgttcatattctttgtccactttttaatggggttgcttgttttgtttcttgtaaatgtgcttaagttccttgtagattggtggatattagacctttgtcagatggatagattacaaaatttttctcccattctgtaggttgcctgttcactctgatgatagtttcatttgctgtgcagaagctctttagcttaattagatccatttgtcaattttagcttttgttgcaattgcttttggcaatttcatcatgaagtatttgcccatgcctatgtcctgaatggtattgcctagattttcttctagggtttttatagttttgggttttacatttaagtctttaatccatcttgagttaatttttgtataaggtgtaaggaagggatccagtttcaattttctgcatatggctagccaattctccccgcaccatttattaaatag

SEQ ID NO: 67848 - DNA, 2945 bp, Homo sapiens
tgttgaataagagtgatgagagagggcatccttgtcttgtgccagttttcaaggggaatgagggaggctaattttctaataataataataagataatattgaagatttgcttggttccagatatttccatgaatgctttacatgtatcaagtcacaatctcagaaaaccctatgaaagagttcatattattatccccattttatagatgaagagactgaggcacatgccctacaaagacctaagctgggaaacccactaccttgagtgtttttgttgccacctgagcacagggatctcagattgacattgcagtttctcagcattccacctccaggaaatgttttatttcacaacaggccaatgggccacgtgactgaggtgttctactgagaaggggcggggagcaaggagtctgaggctcacaggctataatggatggaggaagaaaaattagagaactgggtttgggggcagagtccttgccggccttgtgaggctgtggctgggtctgatctcatctgctgtaagagctggtcctgaactgtgtggtttgaggcctgggcagtggtgaaggcaggaggactcacaaatcaaccaggctgttgaaaaccccaaggagcaacagtacgggccaaaggccagaggtctgaggtctgggttctagccctggctttgccattaactagctgtatgattctgggcaaatcggttcatctttctaggcccagttacttttttttttttttttttgagatggagtcttgccttgttgcccagcctagtgtgcaatggcgtgatctgagctcactgcaacctctgcctcccgggttcaaacaattctcctgcctcaggctcccaagtagctaggattacaggtgcctgccaccacacccagccaatttttgtatttttagtaaagatggggtttcaccatgttggccaggctggtctctaactcctgacctcaggtgatctgcctgcctcggcctcccaaagtactgggattataggcactttttttttttttttaataaataaaatgcaagtttttttttgttattgtggtgattgttgtttttaatctcccaagtgtttttgaaccccatcattctgtggttctatggctttactgccatgccaagcaagtctcagaatgttggcacgctgaccattactgcttccctccctgccctccattcttttataaaggccaaccaaagataaccatgctggtcctgtgctgggctagaacattctctcctcataacattcgtaagagatagacattattttgattttatggataaggactcatccaagtacacacaccagcaatccacattgggaattctaattgaggcttgcctctaaaatctaggttgttcatgaatatgtgacatggcttctctattttatgttggtttctattggccactggcaaatactgctctttttaggggctggtggggtggtgggaatggtgtctgaagtggaaagaaggcactaggtttggacccatgcgccacagaggcccttggaaggggtgcaaatggcattggccttgtggctccagtcttttccaactactgctccaagtggggcaacgaatgcagattttcctgctaagaacttgcagagaatcccaataggttgtacttcttttaacgcatagagttttcatgtgccagcagctgccataacacaaacacagtcccttactaactgctctcctaggtcgcttttcctgccacgtggcctccctgcccacgtcccctgggaggtggccggaaagctgagatgggggcggctgcagttgctgcctctggctgacgttcagctgcagcaggcagggttgttcaagcttggaagaatcaccactaaaatgatttgggtttgtggtggggaagcggagggcagtcccttttaagagtttcctttcacattccagccatccaccccctgaaatctttcaatcatccattcatgtattcattcaaaaattatttaacgtgttctttttctgtgtcaggcactgttctaggcactagagatccagtggtgaacaaaagaggcatgttccctgctcccaggaaattaatgttttaattgaagggtcgggggggatttggagataagcaatcagacaaataaatacatgatataatgtgagatagtgctgagtgtctcaaagaaaatgattatatggagccagagagtgacagaaatgctgttttaagctgggtgtcaggagaggtctccctgaggaaatgacagacactgagacgtagtcaaggagcaagctgtggaaatctctgggggagagtggccccaaagagggaggagaaagtgctaggtcctgagataagaaggggcatggcacttctgatgagcagtaggaagccagtgtacctggagtacaaggagcaaagcagacgtaacatggagttgcagaggcaacacagaccatgtaagggcttgggattttcttttatttttgagacaaaatctcactgtcacccaggctgagtgcagtggcatgattatggctcattgaagccttttctcctggactcaagcaaacctcccacctcagtctcccaagtagctgggacaacagctgcataccaccactcctggctaattttgtcctttgtgtagaggcgggatcttgctatgtttcctgggctggtcttgaattcctggattcaggggatcctcctgcctcagcctcctaaagttctgggattacagacatgagccaccgtgcctggctgggattttattttaaatatgatgtgaagctgttggaacattttgaaaagggaaatgacacaatgagatttatgtttaaaattatctccgtggccatggagattgtaaggagctcagggaaggagcagggagatccattaggaggccattgcaaaagtccaggccaaaagtg

SEQ ID NO: 67849 - DNA, 1031 bp, Homo sapiens
aaaatacactaacattaatgatagctgatgtgcttaaaaaaaaatcgcagaaaagtctcgttatgttttaagaaagtttacaaatttgtgttgggccgcattcaaagatgttctgggctgcatttggcccaagggccacagtttggacaagcttgccctagaatgagggcagccgtgccaacacctggattccaacccagtgaaatgggttttggacttctggttcctagaactaagaaataataaatttctgttttaagccaccaaatttgtcatagctgccatagtaaaagaatacaatgcaggaaaagattcagcaaagacacctgtaccaagacaaaggccatcggtatattaggccactcgtaaatgaaatgggacattgagaagtggacaagaatcacaaaaggtgtgggaaaaaccaggaacttctgttggaggagagggaggggctggtagaaagagtggaaagagggggaggagctggcataagctgttgtctctgggctgtggcgccttggccagataagcatcttaccttagtgctgagacaggcctacaattcaatccaagttggattttttatacattaattgagctttgctgaaactgtgcttttcttctttcaagtctaaattcaagtcttgaaatgattccttggctgaaattagatggttttccagtgctggtttctttctactcaaagttgtctttcattggctggcaataaccaattatttgtgtgatttgtttgcatttggatttggcctgattcaacagggcaagcagactagtctccctgtctgaatccccacctgccaacccaccgacaccatcctttcttggagttcctgtagcctggagtttaaggcctttttatgtatttgagggtacaattttcataagaagtaattttttttgcttttttaaaaaaataatttatttatctaaatttatttatttattttgagacaaggtcttgccatgttacccaggctggtctcaaactcctgggctcaagcaatcctcct

SEQ ID NO: 67850 - DNA, 1085 bp, Homo sapiens
taggcctgtgccaccatacccagctcatttttgtatttttagtagacagggttttgccacgttggccaggctggtcttgaactcctgatgttaagtgatccgcccaccttggcctcccaaagtgctggcatttcaggtgtgagccaccacacctggccacttcacatgaatataatcatacattatgtgatctttagagtctggcttctctcaatcaatattatatttttagtgagattcattcatgttgctgcaagtagcaataacattttggtcttcattgctgtataacattccacttattgcataccacaatttatttatatactgtactatttatggacatttgagttgcttcctttttttgctgttaaaaaaataattttctatgagctacttacccatgtctttggtttatgtaagcactcatttccgttgatatacacccagcagtgaaattgctagggcatagagtatttgtaaggttaactttagtagatcctaccaagcagttcttggtagtacaagcagtgcaagtgcttgtaacagtttacattcctcccagcagtgtgaaaggtttccagttgctcagctgcttcaccatcactgggttttctgaattcttttcatttagtcattctagtggcaatagggtagtatctcattgagctttcaatttgcatgttcctgatgactaaaaatgttgattactttttcctgcgctttttgtccatttcgatatcctcacttgtgaagtgcctattcaggtcccttgcacctcaaaaatgttagctattattttgtatcatactaattgtgcttttaagttatccgtatatctatctactctccaaatagatgataagccctttgatatgcaaggtctgtgcgtcactcatttacgaattcttagtgcctaacgtaagactcatgttatacattcgttgaatacattgtcaaacgtctaggactcagcagatcatggcaaaatgtcgccatctggtgtctgcagggaatgagatgtggaggatgcaaagccagctggctggataattcattgttttccatgtgagctttctcttatg

SEQ ID NO: 67851 - DNA, 1064 bp, Homo sapiens
tccataaagtgtactgaggtggggaggaggtggcgaacttcactgctcttctcaactctttcttccctctactcactgctcctcaatccaccaccaagacaaatggtaacaatggattgatcaggtttatttgtttgttttttgagacggggtcttgctctgtcacccaggctggagtgcagtggtgtgatcacaacttactgcagcctcaaccccaggctcaagcaatcctcctacctcagcttcctcagtagctaggactacaggcatgtgccaccatgcccagctaattaaaacaacattattttgtagatatggggtccccaccatgttgcctagactggcctggaactcctgagctcaagcgatcctcccaccgcagcctctcaaagtgcttggattataggtgtgagccaccgtgcctggcttgatcaggtttagaaacattgtagtgcccatgggtaaagtctctgtccaggttacaggctagagctcacatgggcgtgacctcccagtcactgtcacactgttggaggacataggctggggtggcaatacgcttctgataaaggccagtagtaggtgtcttaggctggcaatattttaagcactgggagatatgatactgcacctttcctcttatactttttttttttttttttgagacagggtctctaccacccatgctggggtgcagtgacactatcatagctcgttgcagcctcagcctcccaggttcaggcaatcctcctacctcagcctcccagattcaggcaatcctcctacctcagcctcccaggttcaggcaatcctcctacctcagcctcccaggttcaggcaatcctcctacctcagcctcccaggttcaggcaatcctcctacctcagcctcccaggttcaggcaatcctcctacctcagcctcccaggttcaggcaatcctcctacctcagcctcccaggttcaggcaatcctcctacctcagcctcccaggttcaggcaatcctcctacctcagcctcctcagtagctggagccacagctgtgtgccaccacatccagctaat

SEQ ID NO: 67852 - DNA, 1540 bp, Homo sapiens
ggcctcccaaagtgctgggattacttgggtgagccactgcgcctggcctcctctgatgcttcttgtgagcagatgtattcttgaatttcttcacagcagttcacaaaaagtgtctatgacctcatcacccaagttttttttttttttttttttttgagatggtcttgctctggcaccaggccagagtgcagtggtgccatctgggctcactgcaacctccgcctccctggttcaagtgattttcctgcctcagcctcccaagtagctgggattaacaggcacgtgccaacacgcccaactaatttttgtatttttagtaaagatggggtttcaccatgttggccaggatggtctcgatctcctgaccttgtgatccgccagcctcggcctcccaaagtgctgggattacaggcgtgagccaccgcaccaagccatcacccgacttttacacattctcctagacttcttctgacattacaatgcaacaaacatttatttatttcctaatataaaccaaaaattctgctagatgttggcaaaaaacaatgaaagacagtgtttgccttccaagagaaaaggtaacagatgattaacatatgtaaagggctatgacagaagtatatgaaggaaatatgagagcttgcttcttggatgaagtcttaagaataaaaaggaattatccagcaagagtgggtaagagtgggggatggacaataggagctgcatgagcaaagggcatgcatgcagagctgtttgcattccatcttcaacatgctgggaagcttttaacctgagaagtagcagatacaaataaatattttaaaaatttattggcaaccatatgaaggatgaattatggcatggtaccattggaagcaataattctgttagcatgccatggtaataattcacatggtgtagcctcagtcaatgcactgaaagtgagggaggagagatgagagaggggcacagatgcagttcgttaaggttagtttagaattagtatcactgatagatatgaagagcaagggaaaaagaaaaatctgggacaaatcataggtttctgatttaggtcaatggtggccagtcactttcaggaagaagaacagatgctggggtactggctttagtgagggcactaatcccttccccctgcccattccaacttatattcacttctagaaaggatgaatgggattttggtgtaataagaagacaggttggccaggcgtggtggctcatgcctgtaattccagcactttgggaggccaaggcaggcagatcatttgagcccatgagtttgagaccagcctgggcaacatgatgaaaccctgtctctacaaataatacaaaaaattagctaagtgtggtggcacatgcctgtagtcccagctattcaggaggttaaggtgggaggatggcttgaacccaggacatggaggttgcagtgagccgtgatcataccgctgcactccagcccagatgacggaacgagactccatctcaagtaaaacaacaacaacaaaaggtcaagaaattg

SEQ ID NO: 67853 - DNA, 1069 bp, Homo sapiens
aaaacctcactggttagcagtaaaaagctttcaaaaatttataattccagacatttccctatttccaccgttttgcagagttagagtccctgtggactgagcgagcttccagcactgggagtcgacctctagtggtaattctttaaactgcaagtcctgactttggtgatttggcttattttgccagaaccagggcagctgagttcaggttttggttacaattaataaaaaatgttggcttctaagagatctattaatatctcagttttacttatgagaggccttagagatatgaagtaagatgaactcacatgcccaaggtcatacagctagtaagtgatgaaggtaggattcaaatcctggtccgtaggtttattaatccagagcctgtgctcttaaccactacctgttctgcctctgttgttacttgaatcatctctttaggcaaagttgaccaatctttttctttctttctttctttccttccttctttctttctttctttctttctttctttctttctttctttctttctttccttctttctttctttctttttccttccttccttccttctctttctttctctttctttccttctttctttctttttctttcttctttctctttctttctttcttccttcctttttttgtttcttttttttttttttcaagttctcactctgtcaccgaggctgaagtgccactgtggcctgatcttggctcaccgcaacctcctcccaggttcaagaaatccttgcatctcagcctcatcagtagcttggactacaggcatgtgacaccacacctgtctaatttttgtatttttggtagagacagggttttgccatcttggccaggctggtcttgaactcctgagctcaagcaatccacctgtttcagcctcccaaagtgttgggattacagacatggggcactgtgcctggccttgaccatcccttttatatgctctctaatatatctactgtagcacatctcatacattagagaccagtctttcccaccagttcatgaattccctggaagcagagctcttagtaagtaca

SEQ ID NO: 67854 - DNA, 11041 bp, Homo sapiens
tggctaacatggtgaaaccccgtctctaccaaaattacagaaaatcagccgggcgtggtggtgggtgcctgtagtcccagcttcctggggaggctgaggcaggagaatggcgtgaacccgggaggcggagcttgcagtgagccgagatcacgccactgcactccagcctgggcgacagagcgagactccatctcaaaacaaacaaacaaacaaatactggtgtggaagggtaccaaattattaacctgctcaacatgtcatcagttactatttctcagttcagctttcattctagaaaactactatggagccgttaactctcatttggattactgtcctttcagccagtctggtgaatcaaaattttttatttattaaatatcccatttttcgcctgtggcagggtggtggtccagaggccttgactgaaggggactggaacaacttgtctgtgccatctctgggcttttctcctctactactctactgctcagtgcaaacaatgtatcttctattagatccattacttcagttgtgctttgaagggggcaacaggtttcttagtgggttttgattttagtaccttgatgttaatctgatttatgaaattctccatggagttcatctgagtttaccggattctgctccggaatatgaggcctaagtcccagataataaaaatgtattttggcttgatctcttgggcatttatttctcctcggactttgtggtgaagaggttaaatattccttggttattcctaaattatctggtcaaacatccttatattatcatttttaatgtgtcatacctctttagcacatttccaaccacctgccacttctgttaattaagtagcgtattaacttcctccaaataatatctttaaaatcccaccgttttctccctcagaaacttagtatggtattcaaggatgctagaattctactgctcacaagatactagaggggacccctccgaatacacaccctgtgctccaacctccctgctcacgctcagctgcactacttctttcctgccgctgcacactgtggttgtgtttgttcagatttgggagacaacatgtccctcccagaacctcagaaaattcagtaatttacaaaagggaccagagatttagtgtcagcatatgaaactctgcagggagatcagtaattaaggactatttgatgttccaacaaaccggcccagcctcacaagctttccctcatgtagaactctgacagattttcatttattggaataatgcaaataagaaaattaaaaagtcaatttgttgtcactgccagtattttaccaacctttataaatggttaagtctgagctaggagaaactatcttttgtggcagacatttcacccaggacaagctgtgcttaggcttagatacttggtttagaaatgcctgcttattaggacagtatcttctgcaaactccaggcttggatcttatctcagagtgcatatgtttcaccggactctgctaatcatcccaacccttcctttcctcaaggaaaaatactctgtactcccagatctatttgagtatgaaccaccctcagaagtatcaggacactgaagccctggaaaaggaatgggtaagatgggaagtcccagaaaccagggaacttggctgcaagtgttacctttatttatttcatatatgtatatttccagaaggacaacggttgactggtattaagaccaaaccagtccatcagaatatcatcgaccaaaatgagaatttccctgttgggccattagggttggagtcttattaaccctcccctattcctcgggcccataatgcattatgagatagaggagaagaaaccaggcacagaagactctccctgtcatgctttaaccccataccctgtgctccacttatggaggacgtctccccagttcttgccactcccacaatcagagaaggtgaggttcataattattcagcctcatctccaaggaacctttaactggcaacagagattgttgggccatcatgagatgctactttctagctctatgaacataaaatcacgtaagaaaaagcaaacaacacaaatacatgaaagccatttactcctggtgaattcctcagggtcccaggttcaacactttccgtgatgtcagagtactcagtcagggatgatggggacagggtgtcagaacagtcttgatggtcttgccagcaacagctttttcttattttccataatttggtcttagtcgttctccagttgtcttcatgtaaataaagtggcccatggcaatcatgattctgtaattgttatagtgcctttgtaagttgacagtttccaaatccccttactcatacgacccctgtgaaggggggtgtgaaggggttggtgggcttgtgcatatgagggaatgtgaacgatttcattatgaccgaattatgctttactcaataagcactcaaacactaccatctcacttgtagtagaagtgctagggatgcaaccaagagactggttgaataacgggaaggttaaatgcatgagtattttaatagaaaaaaatattaaaaacaaaaccaaaactcgtatggaaagaggcttctgactaggccctcctttctagcagtgtttggcacctgataacaatttgacgctgggggagggagcagcttgacaaggtccacatgaagcagccttgagatttttcgcccacttccatttctcctcagcatcaaaggaaagtgcatggtaagaagtgaatcagacagcgagggatctatgcagttatcctgtgaatgtgtggcaaagccatcaggacgcaaacctcctgtcttgagtccagagctgtgtgctttaagatttgaccccagtaaagacagaatccttcaggctcgtcccttcccaaacctaaggggctgtccttggccactttcaacttgaagctgttgagcagtctttaggatatgtaacagcctattttttggacgatataggaaccacgacctcttaagtctcttagttctcctactttatacccatgaggtagaggcaggtgcactccagtgaaggagaagcctcaattcaggttgtactttggatgaaacatcccctcaaggcgtagaggaaggctgagaggttctgcccaggctcgtgtttagttgcaggaagaggtaatgtcagatctgagcaggtcagggagactccctcgaaaaggtcttcccaggctgacaagagggcttttcctcttcctcacctcccttaggtgagggctgaaagcagatctcctcacatggggacctagctaggaggtcttttctgagtgggtcctctgatgcctaattaagtgatatcctctgctgaagctttttccacaggtagggcacgtgaatggtttctccccagtgtgtgttctctgatgcctgacgaggtggtccctgcgactgaagctcttcccacattcgttgcatcggcagggcctcactgaggcgtgtcctctcaagtgcttggcgaacgctgcgctgtgggtgaagcagcgcccgcactcgctgcagaggtagagttcctcagcagcgtgcgtcttccggtgcgccaggtaccgcctgtgttcactgaagtcctcaccacactctccacacaagtagggtttgcctcccaggtggattctttggtgtgttgttaacacagatttctggctgaagcttttgccacaaatagtacaaaagaagggtttttctccagtatgtgtcctctgatgtctgacaaggtctgaagtccagcggaagtgctttccgcaatcatcacatctatagggtttctccactgatggagttctctcagcctgtgtcacaggggaggtctcttccaaattcttccggtttaggggatatttgtaaggcgcgttcatcttgtgaaccttttggtgcctggcaagatgtgagcttcgtgtgtaactttttccacattccatacatttatagggtttctctcctgtgtgagtcctcaggtgtctaacaaggtgggagttacaagtgaagctctttccacacacagaacagtcatgatgcctccctaacagggggtggacgggtgtagtttcccgaaggttcacaaaactattcacttgagaaatattagtaccaaatcttctttcattaagtctacctggattgtcctcaaagactatttcccaatctggagtctggtgaatttctggttctcccaaaacaggcctgtgtatatcctccaaactcagatcttcctgctccagacactcttcctcatctttactcctatctcctgtagaaagggtgagaggaaaaagggggtcactgtagcggcaacaatgccttctacacaatggggagatttttacaaagggttttgagatggcaagactaaatagaatgcctgtcctgtgccaagcactttctcatattgttatgctatcaacaaaccttggtatgcacaaatataatcttcattttacaaatgcagagattgagaatcgagggtttaagggaattgtacagtaaatggtatagctgcaattccaaaagttaacatttttctttcacccttttgtattacattgctatcagacaaatgatgggaggagaaaagaggagggcaatgacagaagaaatggctgtcagagggagaaagcagtactggctgacatgttagaagaactgatgagagcggggccctacagagagagagaagcactgcctagaggaactgctggctcagggtgggtaacaccgtttttgtcattcctcacctgtgtaggtaaaactcaggatttctggctcttgagtctcctgaggctcttggatatctgggacccaaggctcttcctctctaacctgggagatctcatcaggtctggggattggaaatgctgctcaagagagggaaaataggatatcacgattggctcaacaattccctgtgttaagagcggtccttttctatttggtaggttgtggggcaaatacatagctagctcaggtgatgaaatctttcatctctttagtttgtgtacttttaaccaaggactgcgtatctcttgcctttcttgtggttttcacctgcaacttaataattataccattgtacaccttatcctcttttcccatattcaagaaagattatctccaactcttactgttttaaaactcatgtgcttacttcaaatatttctgcactaaagctgtcatattacaagtttgttttcctattagaggtttccatttccatccatttatcttttacttgaaaggacaccatatttttcacctaatccctcaattttattggtggggaaggcataagagaagttcactgcatacaatctaaggtctaagatcccccaaaatttccagcaggaaaaagatctctgggcttagaacactctagaatacttgaaattccttacacagagagacaacaattccacagtcttcttccaagacatattctccatagaactctttctgtgttgggtccagatcactccactggtcctgggaaaagcatacggccacatccttgaacgttaccagtccctgaaaccacataaggatttcatcaaaacgtgatgctacgggtagcctcgtattttgtccctgttgaaggtcatacaataggtggactcctctaggagatgaaaggagcttgagtggcgggctgcttaaactcattctcgggggagccatgtgtcccctgtggcactggccctgccccctccaactccaccacttttcctgaggaccagcttatgttcttcttctttaaggtattgtttaaaatttaggaaaggtcttaaaaatcatcattcagctccctacttgacactttaacgctatatacatttctgcaaaattcatcttttctagtacactttccctaaagactctaatcactttcaatagtttctatactctatagccaaaacaagacttttttcctcagttagattacaatctaaaaccatacatgaattctatttctttttctccagccacatggcttagtttcagagctttgatcatggtgaatacttcctaaatgtctcagcagtacagtctgtcatacttacaaatgactatcaaatttattcctttaaaaaaaaaaaaaactaaaaaaccctcatttgacaacttcgcagttgtactggagtgttacaaaataatcccattttgttagttcttctagtcaatggcaaataaactggtgttggtgcctgtggatccaatataaggtatgataatttatctcattatctcctccccttccaggtacctgcagaactgtgagcttaaaactggcaagagtgtaaatgtgcatcctgcttcacctgtttagtatggcttatgcccagtggttcttcaaacaaattctctgtggtacagaggtaactagggcacacctgtgacagagcagtaagaagagcaaccatctctgagtctccagagctcctctctgcaggaaggtctgggtcctcgggcactgggacctctatgaagaaaagaaggcaaagatcagtaatatgcagcatgccccaataatgggcaaaaatctgggcatcccccaccatctttggtaggaaggtggccctatcctttctattatgggaaccaagaaactggcctaagggtagctcccatatcccaatcccatcacctatgagactatcagaatgccaagagaacaagcaacaatctgctgtctaagcttggccctgtttatgggggactctagctggcggtactgtctcctcttgacatcctggattctgtgatgtctttccatacagtctatctacccagcttccttggtataggagaaatgtccgagaaatgtccccctccttgcctgccttctgccacaatcccccctttctgctgatgcttcccaccgctctcctgcagggtctggagctcctcttcctggtgtggacgctgctctgccggtgcccccagatctgggctctgtgtggtttcctcaggagactgctcgggggtcgagctttgcacaggatcctgcagctcattaggtgactcaggctccactcctaaatgcaccgtctcctctgacaggacttcctggccgtgaacatggacagtcacctgggaataattccaacttccagtcaccatggagtcaggaggaagttcttggttgtcacgggagcttattttaggagaagatgcctagagaaaacactcccagagggacccagacaaggaggggaaactccagtttcaatggagcaggcaaggaggagctgaaggttatcctccccaggacaaggcaggggatgcgcaggcctgcactgctctctcaccacccccagcctgggcccctgtcacccaaggttccttcccatctccacctgtcccacctgcagctctccttgctgcctgcttccctagctgaccagccaggaagggggatctgtgactggggatctatgagaaccttcgaggaagtcacaaaattctcctctccaggaacccacggctcaacattcaaagaagggaaaaccaaagccatgaccctttggtggctgagacccctcagatggtccctatacaggtgttccaatatccagaaagtcacattcatacacacacatccccctaatccatggggctcatggtatatgagcaacccaagggcagagcccactaataatttatggggatcctgcaagctctccccgcaaatccagccttccagcaaatagtccccctccacatcacacagatcaggactccccctcctcacccaccgccttggtctcctgggttgtttctgcaaaccctccaccagcgtcactgcctcctcgccactttctggccgttggccccgcacccagctctgtagttctccaggtaggacggtaagaaattgttccagcacaagcagctctaggatctgctcctttgtccgcctctctggtctcagccactggtgacaaagttctcggagtctgatgagagcttctctagggcttgctgcctcctggtagcggaagcgtcggaagttctggtgggaggtttccagcaccgggtcatccctctgtaagacagactctggccgacaggtgaaatcatcttccagtttcaccatcagaattccctcttcttcccaaagatcctggtcctctggttccacggctgtagccatttcttggctttggggtggtctcacaccatctagagctcacactgtcattagccccccgcctcagcctggacacagcgaggattttcttccaagggccctggatagagaagtaaagacaaacaagagtataagcatgaaactatacacaaggacaacagcctgagttcaatcataatcctctacacaaacttcttcaaatggttaaatcctcttttccccaaccaccatagccataaatcaacagatccagttgggagaggataatttacaactaaaggtatggtcctctactccctttcctaggcaaggttcatactctgcaagaaaatactgcatttccacttcacaaatactgccaattcccccgcttaagtctccaaaccggttcccttctcttccttcctacagactgctttagtttgagccttcatcatctcctgcctggactactgctctaacttcctaagatccctgcagtactcaactataagcaaagtacaacagaattacctgtggagattttgcaaaacatagtatcacacatcatttttcagacactctgattcagtcaattcaggtaactgtatgtttagagatgctacttgcagttcgaatgtgtatccatggttgagaaacaccaaccatgagggagatgtgtaaggttatgagcgaaagttctggagtcaagctgcctgggtttgaatcctggctctgtcgcttactaggtatttccagagtgggaccataggcaagttctcattctcctaatgccagtttctctgtctatagaagggagataataatggtttttatctaataggcttactgtaaggattaaatgtattactaaagcctatgagcattaaatgtattactatctttgcttagaagagtgatggcaccagctattatctttctaaattatagttccaactatattactcagtattttaaaacaaaacctttttcatgttagtaaaatcagttccaaaatcctgggaatgacacgaagctctttacaatcagcccccaatctatttttcaagcttcagatcctaccttttccctgtatcacctggttataaaaaatgcattgctgatctccctacaacagggtgtcttttcagtcttccatgtctttttgaaggttgttccttctgcacaggctactctccacccttctcctttccacgctacatggtgtgttctctttctttttaacgggtcttgtctttattcccacaatttacagcttaggtccctctcacttctcatctggatgactgcaactgcctccaaatgtgagctatctgcctccagatttgtcaccttcacgtacccactatgatcagaacgagctctcttggcaaacgtgctcatgtccctttcctatctaagatccttccatcactccccgctgtcttgttaagtgaaatacaaacttcaaacattctacattaggttgacgttcatcttgttattctcttcgccctcctctccaatcctttcagacacacacgcacacacgtgtgtacatgcaaagcacacaagagtcccgtgttctttagcttttgaatatgctgtttcttctgattctttatccttggttaggttaaactttaaatttttcaagacataagctcaagcttcatgtcttctgagatgttttctttgatcccatttcccctactctcagacatagttagaaatcacctaagtcctcccgtagtgacctgggcacctctctatcccagtattggtcatattacatagccatcgctcatctttcctgtgaaactctttgaggtcagagactattttccatcaatctccaatacctataataaagtgcacaataaatgcatttaaaatgaataaaactctactccaaagcttcttcctatggtaacaggaagaaccattgtttcctccattatgcttttactatctcttgattattcaccatatcctgttaattccaacttccaaaaaatgtctttcgaatccatccatctcttcatctctactgccatttcccggttgagccattatgacccactagaaggtattcataggaactttaaaaaaaattacaatatcctctgctcctaaacggcactggcacgtaacaggcacggatacattggagagatgacttagttcaacctccatgactggttttcttggtcctgtccccctccagaccagtgtccacaagcagcttaagggctccatcatttctcaacctttttgtgctatactacagttgcctcacatccacattcaaggttatcgatccactcttaatagctgtgtctcatctattgttgcccatcaaatgagtttacagtcaatgatcacattatcttcattctttctcaaaacgcttctaattcatgctcttatgacatttttttcattaccctcagtcacttgcaacatactttcacagtctatcttggatagctccctaattcctagatcttcatgtgtaatttttcctctgctatctctacctcatggtgatttatttttttctcaagtggcttgtaatttttttattttatgtccatctttttactttgggagtcctgagagccctggatttaaatgtgagccccttgaatgtaatttcatttgtttcttcctaagtgctaatggtttcaatgatcttggacagtttgcttttttaagactctccctctgttgcccaggctggagtgcagtagtacaatcatagctcactacagcctggatctcctggcctcaagtgattttccaaccttggcctcccaaagcactgttaccagaggctgagccaccatgcctggccaaatcagtttt

SEQ ID NO: 67855 - DNA, 1070 bp, Homo sapiens
atctcactgcgccatggtaaagtcagcttatacttatttttctagtggttatttctttttccttctggaacctatgcgctttcctttagcttttgagagagagagacagagagagagagagagacagacacacagggagagacagacacacagggagagacagcatgggctgtcctgttcctgacaggaacaggatttaataatgggcaggaggcccatccacattagctccacctgcaatactccaagtaggtgagtggtgaacttcctaacatacaaaatctgccaatggcttcccagtgaccttaggttaaaatttaaacttcttaaaatgtgatacacaaagaccttcaaaagctggtccctgctacctctccttccttccatgactgccactcccattgaaagccactgcaagaattactgttctttcttttctataccctccctgggctttcctgatgctgttcaccttgtctgaagtacccttctccactcttcatgtggttaactctatccatctttcagagctcagtttttccaagatgccttccctggtcctcccagatgatgcttccacaggaacttgtatctccccctatcacagcatgcacatgtgtctattttttgtgtcatcaaaactgttcatcttctgttgaactcactggactgtaaagctctgagggcagggatatgctgtgcccagctcgatgcctggcacacaccaggcactcacttcacatttgatgaatgcagagaatgcttagtaaggttttaaaagtctgtttccagaaggatagataccatgttatattaacccatattcatccataagtctagcaaactgtgtgctggataaaggcatacatagggaaaaaaacatttattgtttggattgtgagtaaaacagaattctcttagtggttcccaagatgatggaaccacaactcatcacaaggaatcttcaggttgcaccgggaataatccaaatgcaagtcacacaacacttggcatttgaaaaaaaaaaaatcattttccattgaggatttaaatcaattttaataagcgca

SEQ ID NO: 67856 - DNA, 6446 bp, Homo sapiens
aaataaatggaactacaatactaattatttatccagacaaagctttccaaaccccaccccaactcctacccctggaagacagaattaatacatagggtcttttggcttaataaaaggacttctagtatcttaaaagtttgagaaccgacgtccagtgaagtagacttggaatcctcattgttttcacgcagcactaggtacaagagattccacagtatggatcctacaacgtatgcattgacagaagagttcctgctctctcaaagggctttgctctccaaagaaaaaagaacatgtaacagtgccacaccaaacttgccatttaaaaatgcccttcagaaatcacaagctgagatttctggtgcttgttttgcatttactttggcagcctaggaagatgaaggaaaacagatcagcaatagaaggaatgaaggaaggagtctttgtggggtaagagatgggaaatgaataggaggtacagcagtgctgtgcacagcaccaaactgggtatccaaagacatatgccccggccccagatccccaagaaactggagcttccctgagggtttcgtgaagtaacgtacccaagagcccttgtaaaggataaagccctctgcagataaccagtctcctaactcagtgattatctgagatatgagagctttatgaactaaaatgtgttgtgcaaatgtcaagatttaatattagaggcagaaaacagatgttgtgtttttattctataattaatgggatgtgctatgccataagtataccttgcaatttgttgcctttgctattctaatacctttcttcaatgtctgtccttggaagagttccagagtaagacaaaaactatagagagaatacaatagagagaatatgaaaccaggccaggattaagtaagagacttggttccagaagacactaaaacagtatctgcaaagatacaacctagtgtcttgagtgttcctaggatgcataggattggagaggagctatcaaggtaagacctctgtacaatcctcaggccagctgtctctgccccttatctgaaggtgtcacgtggcagtgaagacccaagctcaattctcttacaagaacagaaaaccacaggcaatgaaacaatatctagttctctaccttaaaacgctactagctagggtgatctttctggaccctaaatgacaaagtctgtagtcatataccatcaacctaaaggagagacagtgatctgcctatgtactggcaaataatcttcagaagaaaatagtgattagaactgaaattattatatttagcagatatttatatcccttccagtccccattcttattttataccttaatgcaggcctatagtttggtaattttaatacaactacttgctggggctaaccagggcctgtcaacagctcctctcagtgttctagaatagaaattggctaataaaaactgttaaccgctcttttccaatgctgctgctgttctttaaaacgaaagattagcccagtacaatccttctaatggacatattcttttattcttgattgtcctatatacaagcgcttacctaagctttccacataatggttagtggccttggcacgctgggtttgaatccctgacctcgaatccctgacctcgcttattagccttgtaacacaatttccctaagcctcagtcttatcctcaaaaatgtggctaatactacttatctcatgtggttgttttaaggagtaaatgaaataacctatagaaacccttcagtatagagtctggcatagggtaggtgctcaatatattttattcattttccttcaagctatttgaaatcgttttgggaagaaggcaagatttaaatgataaacaagcaaacagttctctattgcatcataattacaaaaaaacagatggcataaggaaaatcttggtcggtctattgttatatcaaagaaaccatgctaaaccaaaaaaaaaatccttgctttggaggcacttatgaagtaggattaaatgaaagtgttggaatacagatgagaaggaaccttagacacaggttctcccaccgaagaccatatcagcaatgcttctaattaccaatatatcaaagtcctctccactccctgtaactggcaggagacaatctgaggcaaactcagtgtaccaagaagtcctgtgaaaacttaacctagacagcacaatgaatgaaagggaatgaattccctggcttttggccttctaacacgtgaccagtatgcttcaaaacatgtttaaaactgtttctgtaaaatatttttgccacctaagtttcccccccgccccttcataaaagtgatatttgagtagtgaggggagaaatggctcaaaatttgttacaagaggttccaaagaaagacaataaggtatagagaaagggaagacaggaagaaagagaaagaggtcaagtatgtagtggatagtacagggaagtcacaagtatcttctgtctggaaatgctgcagattttgtggttagcctcaagatattaggtgggaataaacatgtcattgagagtaaatgtaaacacaaaaatgaaaaataaaaattgtaacaattcactttattctaaactgtttttgatggttatatatggcaggcctaggaggcaatgttagacagtagatagttgccttcggcggagggtgacctgtgttctgtccactgctctacattgtaaagaggtgtcatcttggacaagtcacggcagctcatgttgagtcttgggatgattctttatctaaaggtagagaactgaaccagctttttgatggtgatgaggaggggttttgagaggaacaaggatatacagcatctctattgaatatttgggccataatgtaacagcctaggatgctgagatttactcaagagctgaggacggctaggggccaaacacagatttttaagttttgagatagggtttactctgttgctaagactggagtgcagtggcaagatcacaactcactgcaatctctgcctcccaggttcaggccatcctcccaccccagcctcctaagtatctgggactacagcacatgccaccatgcccagctaatgtttaaattttttatagagaaggggtcttgccatgttgcccaggctggtctcaaatacctgggctcaagtgatctgccagctttggcctcccaaagtgttaggattacaggtgtgagccactgcacccagcctcaaatacagatttttaagaggccagatttatacacctggccatcatggtcatgttggttaacctccatcatgaagctaggctttttaaccttcaggaaaactaccccagagcagttaatggcctaaataaaggaggtcaagctatatgtctcagtttaaaacagaacatgacaaattaacctgaagcaggaaaaggaggggacatcaaacctgacacccatcctgataagagtaactgctctcatttgacagccagagttaaactagatgtatgcaatctctacaacaaacatagtcaatgccaatcagatagtcagaggaaccatcatttaatgggaaataacgcaataacatatataacagagctgaccggaggtgttgctatagataattcataacagcagtaaattcaaaagtcatttactatgtttttagctttgtcattaacacagcctgtgtggatactccctgtttcacgtctagatgacttcctcctggctttgctcaagggtcctttagcatttgaggagatgataagggatgggatccccgcctgttgaaccagaggaatctgaggagtaccaggtttccactgaagactaaatcatgatccagagaaggaatctcagaagtcattcttgtcgtgggcatggcttaacgtctgtctccccactgtgggccctgccctcgagagcaagggtctccttattcatttttatattcccagtgcctaccactttgtggagcccttagtagaaaaggtattcaataaacgcacattgagtttaagctttctatttctcctcccccaactagtatatattacagaagcactgaaaattcagaaatcagccagtgtcagggctcctgggtaataaaccattcacagggatagctgtaggaatttggcataagcatttattccaatctcttgggggtaatcaagtggcataatcatgccctgctttactgtgtagcataaggccagtagagaaaaacatcaagaggggaggaggacaagggatggagttcaatacacaaatatctactgagcgtcaattacgtgtcccacactattcaaggtgctgggcaaagaaagataaaaaaagcagaagctctgaccttgaggaacttaacaggtagttaagaaattgcagaattttagcaatactaggaattcacagcaaaagcccagaatacaggtgtaatattttgatcaaaacgtgaagcccctatcaagagaattaagaaaatcaaggggaagaacttatcaatatttcacctcaaatttggcatatagcattcagttgttttaagtacgctttcttaattttgcgaacaaaatattcagacctaagtgattatctataaaagatcagattactagtttccaacacagaagtactcaaacaaaggtattctgaacctcaacctactgcaatacatatatcacatttggccaaaaggtagttgttctcaaagtgaagaacccagatctgcagcatcagtacctgagccttgttagaagtacaaattctcaagccccagcacagacctattaccagaaactctaggggtgggccccagcaatatgcgtttaactagcccttcaggtgcttatagtaagtttgagaaccaccacctagcaaatgaagtaaatctgaagttcatgcagaaagccattgctggccaaactaaagggtttgctggtgagagaacagcaaaaacaaggggtatagaactgtttcacattttaaatctgtgccaaatttactgggaaaaaaaaatgtaaacctgtaacttacctcatctgtacaatttgcaatggctgagtccctcacattgtggtaaaccttgttgtacccttggaatgattgtctactgcaatatagtatatacacagagtacaaaaagggtatagctggaggagaaagggtgaaagattatgaatcccaggcgtttggtcctaggaggaaaaattcctgtcctctctccaaccctgcccaccctcttatgctagatagtaacagcagaaagttatcccagactgctccgcgttcacacgcttcccaccaacaaacctcctcccaaggctatcccacaacctttctgaagtagcttcctggatcaagccccacggggcagcttggaagagaagctgggagggatgaggggctccactagcattccttgtggcttctgagtgtagctgccctgggtgtcacctgcagagcgtggatagagaaaaagcaacagttctaagcccagcctctaattgagagcctgggatctagcgctgctccccaggaccaaggttgttcaagaaaggctgggtctaagagtctccctctggggaggtcagtacagattccaaggcagacagggttatcaaagcgcctagaagatgagaacattcattgttcagaaaaacaaaaattagactgacacctttctgaaggaacacagcctatccatggcacaaaaacaaatttttaatcaagacactcaagaagtaggtatactcctgctaaaagtaacgcaggtgctgagaagaggtgccaaaactggctgttaggagtgggaggagaggaaagttgcaagtggagacagcagctactggcttgaggggacctcagggtctgtcacagtggcagctgaaaagcctctggccaaatggacgccaaggactactatcatcacaggtgacaagatcacgggtgagtgtatctgggtgtgtgctggggggctgaggggggcttggtggtgtaaggagatggggctagccggggcaaggagcccgcggagatgatcttaagcaatctgagaggaggggtaagaaaaagctgcggaaaataaaggggcctagaccactcctccctcggttccggggggacagttggcgcggaagcgttaggaggtacgaggtacggactaactacatttctgcaggccccaggagggggcggagggcggtggctggaaaggaaaggaagccgggagcgccatccgtgtccccggagatactggctccggccaccaggaaacacagagaccacaacgtctcggcaccctcagtacaccgccgccaccccttccccaggacacggcgatttccccagactctggggggcggggtctccggtccctccccctcctccccgccctgcccggctctgcccgatctggtccggcccggtccagcccggcccggccca

SEQ ID NO: 67857 - DNA, 1046 bp, Homo sapiens
cgggcagagccgggcagggcggggaggagggggagggaccggagaccccgccccccagagtctggggaaatcgccgtgtcctggggaaggggtggcggcggtgtactgagggtgccgagacgttgtggtctctgtgtttcctggtggccggagccagtatctccggggacacggatggcgctcccggcttcctttcctttccagccaccgccctccgccccctcctggggcctgcagaaatgtagttagtccgtacctcgtacctcctaacgcttccgcgccaactgtccccccggaaccgagggaggagtggtctaggcccctttattttccgcagctttttcttacccctcctctcagattgcttaagatcatctccgcgggctccttgccccggctagccccatctccttacaccaccaagcccccctcagccccccagcacacacccagatacactcacccgtgatcttgtcacctgtgatgatagtagtccttggcgtccatttggccagaggcttttcagctgccactgtgacagaccctgaggtcccctcaagccagtagctgctgtctccacttgcaactttcctctcctcccactcctaacagccagttttggcacctcttctcagcacctgcgttacttttagcaggagtatacctacttcttgagtgtcttgattaaaaatttgtttttgtgccatggataggctgtgttccttcagaaaggtgtcagtctaatttttgtttttctgaacaatgaatgttctcatcttctaggcgctttgataaccctgtctgccttggaatctgtactgacctccccagagggagactcttagacccagcctttcttgaacaaccttggtcctggggagcagcgctagatcccaggctctcaattagaggctgggcttagaactgttgctttttctctatccacgctctgcaggtgacacccagggcagctacactcagaagccacaaggaatgctagtggagcccctcatccctcccagcttctcttccaagctgccccgtgg

SEQ ID NO: 67858 - DNA, 1423 bp, Homo sapiens
tcacggctccgacagctccggcggctcctcccctgccccggcttctctcccacccactcccgaccgaaacagcgccgccggatccgagccgcgcggggcctagcgggtcggaacacgtggggcctttgcgcccggaaccggaagcgatcgctcgccccgccttctcgccgagtaggagcctttctaggctgtgggaggtttgatcctctctatgcgccctccgcgggttgcggctcagtgctccccaaggacccagtgcgaagaagcctcggaccccacagctgccgtccgcgacccctaactccactctgcagcgaataaattaacatcttgggcctttcatttacaggcataccttctgcaagggttttctttttcttttcttttttcttttctgtttttgatcttttgtgtgtttgttttcatttggatacctctacgtgtttttcttgatttttttttctttgcattgtccgctgcaacatggtagaaaagggcagcgttaggtttgaatactggctcttgcagtcaccatcagcagcagggcctcggccgaatctctccatctttgaaccctattgtgcatcatataaaacgggcataataataccgttactctgaggactaaatgatacattgcacatgaactgaatggaacatcagaagctcagaaagaaaatagttatggtatcactgttctttcttttcctttgagtgttgcttcgtatttctttactttcaggctgtcttccctgatctcatttgttcatttttgtccgttcggtgacctttctgcccatacttgacattttcctttgctctctgtcccttttaccctgtaagtcaccactctccacgtgccatgtgccacttccttttcatgggacacattgctgggatctgtttactgggtttgaaccaaaggattagttacttttggtggagtggcagtgtattagcgaaacagaactaataggtgtgaacccagaaggcaggacaactcaaagcggggagggggcttccaggtcataggtagataagacacaaatggttgcattgagttgctgattagcctctccggaaggaggcaatcagatatgcatttatctcagtgagcagagaggtgactttgaatagaaggggaggcaggtttgccctaagcagttcccagcatgaattttccctttagtgattttgggggccccaaatcactttcctttcacacggggtatgtataaacatataaaaggagatttattataaggagttggcttacataattatggacgttgagaagtcccaccatctgcttactgcaagctggagaaataaggaggttggtggtataattcagtctaaagctgaaggcctgagaactggaaagggattgaggtgctggtgtctgaaggccagagagcaggag

SEQ ID NO: 67859 - DNA, 1876 bp, Homo sapiens
cttgcccaagcccctgcaaatgtgaagtgcttcctaaaatttctgcgtattctgtggccatctctgtgagattctctatgggctgtttctaatccaaattatgtcattccagacatgaaacgttattcctccttgactcacacacaacgcacacatatatgaatgcatgtgacatgcatgttctgttcatacatgcatttggtaatatagaagactttactgaaggtttgagggggagacagattaacattgtagaaatgtgacttcaaactgagcattaggcatccccattcttaaactgctttctaggtgccctgacgctggggaatttccactgacttcttcccacagactcctctgctttgctccattttggggttccttttttcttcctttctctgtcattttcttttttgagaaatattaactattacctttttttcctcattcagggcactctaaaccattctttgatgacagagctcatgataatattgatgtccttaggttctctctcttcctttatctccaaatgatctatttctcctgcacagctccaagacagttccctctctaagagaaaatcaggtacagcagttgagataataatatttttgcctcattacattttgttttgaattttcaattcaatattaaaaggaatgtgtgcagtgttgatgaaaggagtcaaactctgcaaaatattggaagagatttattctgagcccaatatgagtgaccatggcctgtggcacagccctcaggagatcctgagaacatgtgcctaaggtggttggggcacagcttggatttatacactttagagagacatgagacatcagtcagatacatttaaggtatacattggttctgtccagaaaggcaggacaacttgaagtggggagtggggggcttccaggttataggtagatttaaaaatgttctgattggcaattggttgaaagagttactatcaatagaaaggaatgtctgggttatgataaggggttgtggagaccaaagttttatcatgcaaatgaagcttccaggtagtaagcttcagagagaatagattgtacatttgtaaatgtttcttatcacacttcaggtctgtgttgatgttaaatgctggttggcttttcctgaattccaaaagggaggagggcataatgaggtgtgtctgaccccttcttcccgtcatgacccaaaccagtctttcaggttaactttggagtgccctggccaagaggaggagtccattcagatggttgagaggcccttagaatttggtttacagcagtaatttttttttttagtcatagttttaatggtcttttaatgctagtttttctttactgttgggaagagacatatctaatactcattatcacaaactgaatcacctgcatcatcattccctaaaaagatatcttgcctgaagacaagggtcagatcagtaggtttgtagcctactttgagggactttgcacactaaccctgaaaccagcccaattgttccacacaaaagatatttatggatttttaaatgaacacagaaattgacactctgtcttaaaacctgaaacttacatttgtcttaactgagttccttcctcaggaaactgaccctcaggcaagagactgaaacccactagatcaccaatccggacaacaagatgccaggcccctcattcatcatgatggcttccttacccctccctaattcctattttctcaccttaccagctcttcttccttacccctctctaactcctattctccctcccttccactatatataaacctcccaaatttagttggttggggagatggatttgagactctacctcccatttttcttggctgcagcattcag

SEQ ID NO: 67860 - DNA, 4411 bp, Homo sapiens
aatcctacatgtgagccctgaacttcatgtaaccttggggctgcattttccagtaggaaagtgtttctagatatattggctctgagacttttcctagcttcctaggtacatggtctacttatattggagcccagaaactgctgtaatccatgaactgcaaatggaaattttttacaagatgttctcaagttttggtattatctgaggatgaacacctctaagtttatctaaaaatttgtattatttcaagatggaagtccccttattgagatattatcaaacaaaaagctgattcatttcaaatattttggaaggaccattagaattattagaagtctgtagcgtgcttctctcatgataaagatgataggaactaagaaaatgagatgtggaatgttttatgtttttgacaagaagatgaggcaaagagggtggtcataaaaaaaaagatggtggtcataaataaagagggagacaggattccttatacatttttaaagttgttgacatttgtctctgaccttagtggtttctactttcagtttgcagttgacaagtccagagttctacttcatgcatctgaggatatactgggacttccttgttgaagaattacattgtttcttctcaagaaaaactcctagttcatttacatgtaacaagttctcatgggagaccttaaccatcatggtttgcttttgcatctttatcttactatagcattgaatcagaacttctgggatttggggggagcctgttttaccaaacttctccaaaatcctctctcaactttcattgtttttatctgcattaagctcactttgatgtgttgcatgttttactttgcatgaccagtctttgggcaagtcattgcctttcttaaggctcccttcacctccttgtttctaatagtataaataaagggattcagaaggggggtgaggatagtatttagcacagacaccaccttattaatcttaaaggaggagtgtgctgtgggtcttaggtacatgaacagaacagccccgtagagcagggagacaactgtcaggtgcgaggcacaggtagagaaagtcttttggtggccagtggctgaaggaattcgtaggattgcggacagaatgtagatataagaaatcatattaaagagaagtgaccctgggatcacaaggatggttgctatgacgcccaggagttccaaaatgctggtgtctatgcaggcggctttcaaactgggcccaacatcacagtagaaatgactgataacattattgccacagaatggcaactggatgagcagcatcgtctgacaaaagacaatggtgaagcccaccacccaggagctcagggccagctgcaggcagagtttgctggtcatgatggtggggtggtgaaggggattgcagatggtgaggtagcggtcaaaagacatgatagtgaggatcaagaactcggtggtgcccacgaagaagtggaagaaggcctgcagcaggcagcaggacatgcagattactgttcttgccactacaaaggttcctagcagtttggggatgactgtggtggtgtaccagatttctaagaaagacaagttacaaaggaagaagtacattggaatttgtagcctgggctcagcccacacagtggcaataataagcccattgcctgcaagggttaatatgtaggtgagaaagattgcaataaagagaggtgtttgtaggccttggataacaggaaagcctagcaggatgaattctgtgattactgtgccatttctcatgtcccttgataccctagaaagacaagcaagaaagctccttagaatcttagagcacagttgattatagttgggacaaaaaataaggaggattctgactatgtaaggtccttcgggacctgactctatttcaggtcctccctcacccacatacaaatacgcactggccaccccttctttactgatgatttggctggttcttttgtcagcaaaaccagcttctaatggactttgaatgtattaaaaacacttgatgaatgcaaagtgttttttcacccttatacaactatgagaataatcatgtgaaatgtggttgcttcttgtcaattattcatataactattttcaatgcatagtgtgtataccaacttatgtacgtaaacgtggctgtgagttcataagaaattaatccctattctcagagtctgaaaaagaagttactgattacattacagatacgtttaaggaagccattattgtgtgtgggtgtgagtgtgtgtcttaaaataaccccaaatcattgctattatattagtggtgagataaagttagataacagaagaggtgtttttctgaagaatccacttccacattctagttcagactcctttgctaaaggtatcaaaaataacatttaaaactaaatgaataaaactgtttaggaagtagagaaatattcaactcaaattcaaaatttcagaacaagctgagtcaaagcctgttatatggaagcacctaataaatgtacatgggataaagatctgcagacactaatctacaaaagtgaaaggttagcaaatgctaaggataacaaaatgggaactctgaaaagtacatttttgtcaaaattttttttgtgactaaatgtctttttataccaagtaaagtatttctatttgtatatgcaaattcatgggctgagaacatcctttctgttctaccaaaattcagtagaaaatagtaaaactacttcctttcttattgaggctattcttccatgtgggtttcctttgaaatgggtgagacaaattactgtgaaatgaatttcacatttttcaaagtacataagaagcttagcatgaaagaggcaacttacaggtcattgataggttgtttcattcttccctcatgtgagataactgtaattctctgagggcttgcttagggaagaaaaacacttccattttctcccacctcttttctagaccaggaaaagattctttgtctacaatgtcacaagctctagtgcctttccacaaaacgatgagagacagagaagtatttgaatttgcactaatggccaatataactggccacgaacgtgatctctttatataggatagatatggaattatcttcattccccatgcagagaagagtggcaatctctatagctcaatataacatttccaagggctacacattctaccatttggagaattagacctatgaattccacaagcatttgttgagagcttactatgcttcaagtactgccaggcaattaaagagcttatcagatagatagatagataggtggatagatagatagatagatagatagatagatagatagatagatagatagatagataggtggatactatatatagtataataattgcaacatgactcagtgagggaaagtgtagagctgtgcacagattgttttagaaacacttagaaggggctcttcgcccatctttagcaggggttaaggaagtttttctaaagaaggagaggcctaagctgagtcctagagttcaaaaggaaatgaaagtgaagtaaggagagagggggaatgcattccagacaaggattcagtttttgtgaaatagaaccagagcagagaatttcacttgagctggagctgggagtcaggcttgtcctggcacttatggtaaattaacagttagaacagtttacacgagagattcatgaagcttttggaggacagaatcttgagtcacggagtttgcaagtgtgtgtgtgtgtgtgtgtgtgtgtgtgtgtgtgtgaagtatggtgtcagccattctctgtaacacatgtacatgtggatctaagcttcatggaggaaggggctgcaggtggtatgtgaatgacctcttttgagattctggtcacagacagtactgccgtggtatccaggtgaccatgtgggacacatacaggggacagacatactctctctgcttttgtcaggaacatggcttggtttggtagcatgagggcccaggagtagcagcagcagtggcagcagaaatgataccagcagaagtggcagtgcctgctgagggggctggtccacagcagaaggaatgctgagcaagtagaagtggcagaaatgaggaatcaggcagtagctgtcctgacagctgcacggactgggttttgagcacatgagaagttttgtgagatgcagagggaggtggggatgtctcaagttagcaggtaaaagcaatgttcagagaaacacaggaaagcaacccaaggaacctaaagttatagagctaagatgctggattaaacactgcagtctatatgcctattacaattcaatcctacactctagacttcttcttccttttaaaaagtcacaatgtatagggtcaaatggattcctccatatccacc

SEQ ID NO: 67861 - DNA, 3019 bp, Homo sapiens
gtgtcctttccgtctctccctggctccggtaaatcatgctgtcatctcccatcaggattcgaacacagcctcctaacaggactccctgtctcctgacttgctgtgctctttcctaccgatggttcaaactgtagcaagggggaccattcgaattctgactacgccactcctcagaatcttgaagttaacatcccagactcctcagcatgacatttaagaccaccgatgatctggtcttacctacctttccagcatgattttctgccatttgccatttttccttctgccttcttctatgctccacacttactgaattactcaggtttagaggttagcaaactatggccctgtttttgtaaagtttcactaaaacatagccacactcatctgtttacctattgcctgtggctgcttttgtgctatcatggtgaagtttggtaattgtgacagagaccatatgacccccaaagtctaaaaggtttgctatctggccctttacagaaacagctggctgactcctgctctagttccccaattatgccatcttctttcttgcctcccagtcattgcacctgctgttctcttcaccagaaatacccttcccgactttctccattatttggctaagtcttgtctgaattctagatttaagtttaggagccacctccatgggaagccttccttaacttgccacctctagtccagttaaggtgctgctcctacacacttttctaatgccctgtgcatatctatacctgaacactttgcagaattgtgtttattgtttgcttggtgtctgctatagactctaagccccttgcaggcagcaacagtgtctgcagggccgaagcatagagcttgacacaaaataagctctcaaaacatagtttctaaatgattatataaatggatagcttgttgacactctgtccccagttacctagaagtttatggaaactgacacatgcacatgtttatacatgtcaccgtttcctgtatttcaagtgctcaagtcatatcataacagggactctttgctaaataatttgtctccaagttttcttctgcttccaactttttctgatgtgagttttgccgcatgaaaacctttctgctccatctttccctaatcagggatatgctggtgttttgttttgtttttactgtgttctggttcttttcccagcttcttcaggctgcctgagtacagataattttcttaactcatttaatgctcaattgcttgaaattgtattgagtcatttttttctgagttttgttgtgcgataaagaatcccacattttctaaaactttttatagttttagaagaagacaaaaagaagaaaagtattaacatattttcttctctggataacagcaaaatgttccaagtcttgtttgtttatttatttgtttgtttttaaattgctgatgaagaccaatttcaattttcaagactttgattatggaataaatttgaatatgcccagtggtgtagaactctaaaacagaaacattaagtacatatagaataagcttcacaaagagaaataaaccaagattcatcactcaggggacttgtgctaagctgaaacttgaatgaagaaccaatttgaaattcctttcaaggactgatggttctaggtaagatgtggtgaataaagactgcttttctgaggaagatccaagtccaggtcattgtgatgacttttctacatgataccaaaattgatttattaggatttactttaagacttcaaggggtcaagtctagctgtatcaattcattctagagaaaagcaaaggtttttccaaaatagtactctttcttggtgacaaagcaatacttacagcactactgatttccaggaaaacacttccagccgcaaggtgtgtccttgcccacagtagactgacagaaaaggagagctgggttataaaggcagtataattggaacagaaaatttttcttttttttctgcacagaaaatgaatctctttttctatactttaatgcaagtgtccttatgcattactgaattgtattcataaagctttcatgacatggcaaggtttcttcagcatttaggagaattgtattgagagtaattaattcatctgttcctgctaggtcaggataccttctctgaaaataacaatttgttagtgggacattttcacaggttcctatgagacatcagtctgcatggatttgctccagagagtcccaggagatagggaagttctcactaaaagtttattcacaagtcaagctgaggaatttgtagttttctaaattctaattggtatcaatcattcctgcactcctgaggtaattaaccaaagtctgagaatcttttaattttgtaagtttttagatcttggatttctcagttctccaagaaggaaaattattgacatcttaataaataaatggggtcctttaatgaactgaattgaatcaaaggtagtcaatttggtcaataatataaaaatggccatgtattcagaaatgtgagattgaacagaataaaaattgcattcactcacgcctgtaatcccagcactttgggaggccgaggtgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattccgccactgcagtccgcagtccagcctgggcgacagagcgagactccgtctcaaaaaaaaaaaaaaaaaaaaagaaattgcattcagttttcttgtgaactatcttatggggataaatgaaaagacaggggcctaaagtattgagggtcatgtagagagttcatggatattgcatgtgtaactaattattggagaaggctctctgcaaaacaggaacataagagttggaattgtaacttgaaaatcaacgct

SEQ ID NO: 67862 - DNA, 2530 bp, Homo sapiens
aaagaggtttaactgaacttacagttccacatggctggggaagtctcacaatcatggtagaaggcaaggaggagcatgtcacgtcttacatgaatggcagcaggcaaagaaagcttgtgcaggaaaaatctcctttataataaccatcagatctcatgagacttattcactatcacgagagcagcacaggaaagacctgctcccatgcttcagttaattcccactgggtccaacccacaacacatgcgaattcaagatgagatttgggtgggttcacagccaaaccatatcatctcttgtccaaaattatcccacttccacctgtgttatgtacttgaaaatgcaccattcttaagtgattatgtttggccttggattattctgagtcttctgtagttcacttttgaaatgcaaacatccaagtaggtagggaaacacttaaagttgttctgatcaaacatattaatgaggatattatctgtttgctaagaaaaataggcaagtggaattgatgacagtggagagaaaaccaggaacataaaatggacccaaaagtgatagaaacataaacttcaaatcgttttaaaaatggggggaaatttttgaggaactactcccagatacactatttttgatgcaatattttattagatatgtaagtaaactgggatttggctcttgcttgctagagaatcaagatgtaagcaggtgtagggaagttcaaacttttcctctgaagttttgataatttgagtatgtaaaacaaataggcagatcaacaagagaaaaagcaggtatgcattggagccacacgaaacatgagactcaaaaaagggccagatgtcagaagtttttataccatacagaaaggaataaaggtttgaagctcctggtgggaggttgtgacagactatatgagggcctggggaggaaatgcatggtgagcaaaggctatcttgttatgcagatgaatcctcacaggtaactgctctcagaaagattagctggtagcctgtggtgaaagtttctctgtcagacttttgaaagtatcagatctcagtctccttttcctatgagctaatcttttctagatcaggataaggcagataatggagtctcagagaaagctcatttgcatctgttgttttcgtcactaatgtagcttttctctacagatgcaaatcttccccaggaaagcacagctgtttggagctatttgtatgtctgcagcttctctgaataggccaaagaagcatattttgggtggcatattttggttttccatacagataaacttctttcgtttttcttagcctcaggggcaatgtttaaacattattaatataaaatttcctacacataaaaaatttatttttacttcattgtttagctacggtacatcatatacaccctgcttgaaatgttcttcctctttatcaagccatgcttcactcctccctgcagagtctactcaatattcattttcttcacaaacattttccagctaagctatttgcacattagtcttcatgactgaagacatagatacacagatcttttaacccaagtatcccacgtggttgcagccctggaccaacagagggctatggtaatgggctctaaaagcaatcattctttggttcagtaaaaatctgctgcacaggaacttaagccccttttataatcctaccagagagctttcaggaaaataaacatctgaatctaccatccttcccaggcctcaaggtatttccaaagagcctaatttccacaggacacacaaagttagttcaggttaagcattcggagttgtctttaaaaataataaaataaagtcaataaaataagaaaaaaataaactaggcaagaccatctggggatgtgaaggggtggaaatgtgcatgagtaaggaaaaatcttactgtagcaatgactaacttctctgttcctccctcacacccagtttttcttatgcccttcccagtggggcaaacttttacattattccacagaatacttaatattattatcctaacatttaatttctagtttttttcttttttttgagagggagccttgctctgtcacccaggctggagggcagtggtgcagtctcagctcactgcaacctctgcctcccgagttcaagtgattctcctgcctcagcttcccaagtagctgggattgcaggcatatgccacaatgccaggttaatttttgtatttttaggagagacaggtttcaccatgttggcctggctggtcttgaactcctgacctcaggtgatcctcccgcctcggcatcccaaagtgctggaattataggcgttagccaccgcacacaaccaaaatttctaattttcaaacaaacaaattagagagtaaaatgattgatatggcagaagggttttctttctgcctcatattttcaaccattttttacatagaaaatgaaattagaatgatctgggaaatctatctttactaaaagttggtcctgttataactttatggggaaaacctgacttcta

SEQ ID NO: 67863 - DNA, 1036 bp, Homo sapiens
ggaatgacactgccaccttctcttgttaaattatgggtgaatgtgcacattgcctttcatggtcaaaatcaaaggcaaaacaacagtagcagcagcaaaaacaaggacaacaccaccatctccttgtaccctgagataaataaacacttccccactcaaacaaacaaggttgttccatctagttctagtctctaaaataaatggaacctcagcgattcctataaattactgactccctaataaaaacaattttgtttctgacctttgtaatgcttatgtgtaaaggtatgtgatgacttctgtgtgtataacaattccttgagaaaactgcgcatttttcactataaacatattaactgtaaactgcacaactacagtcaattctttttctttaaatgcctgtttgtttttattaagttttatctggtgagccaattattcaaaggtctagactctagtaaaatttgctagaaaacattttattttctaaaagctcttgcctgtaagaatttttgttttaaataaaaaacaaaaacagggtaaaaactgttttcagtaatcacaaaagtcaccctttgcttcatcccttctccctttattgtgcacctattatatgttatacaatgtgtttgagcagatgcaaaaaataagactaatttactaacttaatctaataaaggggcacagatacaaataatcacaacaaaacacaaatgtagggtatatgcaaatgcaaattgggatgtggcaacaaaaaataaataacaatgcgaggtagaaataaatctaaagttattcaagcctaacctcctcattatacagatgagactactgggagtattttagtcaatgttgtacagtgatttaggggcttagcctggataaaatccagtttcctggagccttccagagctctctctaaaatatgtctgtcatacctgttgttgcagtgcctccctatagggctatactcataggatacaaagtcattattggccatccaattcagtcacatacttattggtattgacttccc

SEQ ID NO: 67864 - DNA, 1132 bp, Homo sapiens
gtgagagggcttttatataccttttcaattttgcaattatttctattacaatcttgcattatttttatttttattttttatttttttgagacagaattttgctcttgtcactcaggctggagtgcaatggcaggatctcggcttactgcaacatccacctcccgggttcaagcaattctcctgcctcagcctcccgaatagctggtgcccaccatcatgcccagctaatttttgtatttctagtagagacggggtttcaccacgttggccaggctggtctggaactcgtgacctcaggtgatccaactgccttggcctcccaaagtgctggtgttacagatgtgagccaccgtgcctggcccctagcattaatgttatacttagaaaaaaagttgaaagaaggaaaaaagtaagccttaccttgaaaactggagaaaccattaagaaagaatatagaaattacaagaaggaaagtgtgtctggtttgggggaagtggataggagtgaaaattggtgggagaggatgttctgggttgatctgtgttctggcagtagagtagtcacatcctgagaacttggcagcaagaaacttcaaccctagaaactcttgggaatagccctctaacagctgcgggtagctctgccttagcctagctggtcccagcttctcctgcagctgcagactctgtgggtaatgaggttcctggggctcatttttgttttttcaaatctagatcttaaagcagcttcaggtcttaccttgagagactatacaagacctgattggatagaattccccaggaaaagaggttgaataagcaaatagctttgggagagcattttttatttagaacttaaatattttctctaaagtacatgatagacaactgattaggagtgaagagtgcactagggctcttgtgatggtctaagaaggtcgtagaaggtagaatataagattgtgtgtggaataaatatgttaataaccacattgtcttaccaagggtttcttacatttaccttcaactgtgtatgtgtgcacagaaatattttaagttgcagtaaagttcagaggaaatataatggaggagaaaaagaaaccaagggaattggaatgaagagaagaacctca

SEQ ID NO: 67865 - DNA, 1024 bp, Homo sapiens
tgtgagttattgaattttgcaaatgtcaaccatattacactctatctctaaagtattcaacactaaattcttattatccagggacagtttgtaaataatagaaagtataattgctcaagtttgctgaatacacttctctcaaaagtttaaggtttgtctctaaggtggaaatcaacagaaagacagatggctgagaccagtgatactacattctcaatattgtgaccagctgtctacagcagctgtagccgctcccacaaatcccttgaggataagagcaagaaaaggcgtgctctttgttactggccttggaggacaacctcaatgtgtgcccttgatgggctgagttgaatgatgcgaaacataccaagactttgattgcatgttagagaaggtagatccatgactgaaagtagctcaggttcaccctgtattgacttccccagtggcataaagaagcatggaaggaatccaaggagagcaactcagggacaataggagtatttgttcctaaaacccagagccacaggcctacaaggacttcatgcctctcttggctatatcattaatgtcttaatgtggaaatcgtaacagaggaagggcatctgtctttagtagtaggagagcccagacctgtcttactgcataagccatatatgtgcaaaaaagagaatccaaagattcttaaacggttttaactggttcacttatatccaaagcacctgaaccctaatatattttgatttgaaatgtgtcatagactataatatgagtggtgaccctcaccgcacctttctccatagttgtgcaacacagtgaacttgctaattgcttctcctctgattggaaaaggaggtgagttggatgggtggtgtgggggtgtgtgtgtgtgtgtgtgtgtgtgtgtgtgtgtgttttgcactccctcttggagaatgttataatgaaacttaaatttaaccctgagaggaactagaatttctttatggtatttaactatgaaaacaaacaagtaactagatgt

SEQ ID NO: 67866 - DNA, 1055 bp, Homo sapiens
taaagttgggttgatgtgtacataggtgtttgatcatcattttgtatttcttatgtatgtttgaaatatttcacaatacaactgttatatatcattataagtgtttgtgatgtatagacttaacaatacagaaagtattatttatatgataatatttattatattaacaacaaatgttgcagaagaaactattcgttcagcaggccaggattttttaaaaaaccatcttccagatctttttacaaaccccaaccataattccaaatagagacaacatggttggagacacagcacacacccacaaagctttttccataaagatgagcatatactgcaagaaatagattgccaaatcacagagcccaggttacgtgacgtgtttggacttttttgtttagggaattcacagtgtgtgcacggacaatgctacgaggcattgcagtgcattctggtaatgaaatatcttcgatagaattctcagattccttacattcgttgtcagatttatggatgttcaggcaggtacagctactggtagacaacttgcactctaggagagagaggactcctagggaaaagagattccagggagtgggatgaagggacaatggagagtcagaaacaattctctccaatttggctgaagaccctgacccaaagcccagtggatcccttttaactaccgaaagccatctgggaggtgaatgctttagtggaagaaaccggaagtgtatgtacaatagcttaaattctgctcagcttaagaaaattgaggattctttttgaaagagaacatgcttctttttgggttaggaagtgtaattacaaatgaaattttaaagacttcttaggaaaggggagacttcggtttcggtagatggccatctagcatcagatgttgtttctctctgccctcaaactgccttgacactacactgtactcccaaggtcactgttcctctccacagaggctgagcattctgtctcagacacccaccttggtcatgactttggtggttatctctgccccaaagcggggagggtgtgaaaggcaa

SEQ ID NO: 67867 - DNA, 1005 bp, Homo sapiens
ttaaaatgcaaggtttggcacttttccctctattctcatctttttacccttccctctgtcggggatggattggttcttaacacccttcaggggccctggagacactcaccacagacagacaagaagaaaacatttaagtaagcagtatacatgatccaggtgatcctataattagagaagtgcatggattgaccttgcttcagcttattgtgatatagtatgagtgcccagagcagagagatacctgatgtccagacaaaaaaaaaaaaaaaaaaagaaaaagaaaaaagtcccttctgaggaactttggctccttgatgcaagtcttcattccatatacacttgacttcccaacccccacccggtccaactacaccttgcccaaagactgatcctgatcctgcttttatggtagatctaactcagaagctacatatatatatatatagttttcagagactgcagcctgaacccacccatcaaagtacacctacaagcttgtgttaggggagccaggaagttacctgagaagaaactgaggatggtagtgaagagttgtatatatttattttgaggaatcagataggtgaatttcatacccaggattaagttaaggaggaaggaaaggccaaggctcgacgtcatcataatcctgaccactttcaggtcatctgttggaaagcaaaagctgttttgagaggacagatatttcttctagactcatttctacctggggtccagaagtctctaggtgaaaattggaatagggtgaaagatttgattaaacaataagaaagaagttggaaaataacaagcaggggaaccttaagctgaataagagaaccaaaaacattttctctatcctgatgtctctctatgtgtctttctcttctattattttcttcaaactctattcttgttaaataccgcaattcactccatcatctagtggcaatacagattacttaatgccagttacgtttctttcttacccacatgtctagt

SEQ ID NO: 67868 - DNA, 1144 bp, Homo sapiens
ataatgacattttggtcaatgatggaatgcatctatgacagtggttccttaagattataatagattataaaggataaattatataatttatcttttctatgttcagatatgtttaggcacataaatacttgccattgtgttataattgcctgaagtattcagtacagtaacatgctgtacaggtttgtagttcaggagcaataggctataccctatagcctgggtgtgtagtaggttataccatctaggtttgcgtaaatacattctatgatgttcacgcagccacagaagtgcctaaatacccatttctcagaatgtatccgcattactaaacaatgcatggctgtattttaaagtgaaagcacatgtctacctgcctgtactccactagaaatattctttggcttggagttgagaggccatatgctggcagtcctcactatatgaggccttggtagtctgattcatggccaagaaacgtgtttccaaggcagtactatctcctgctttgcgtagctgaaacagctgttcctgacatccttctgaagggaaagacacaaaggggacagtgcgaaacctgggggaacatatataagagtgggaagtttctcttccacttgttgggccttagtgaaactaatgcttgtgttaatgagtgaaaaatatctgtgcagcatgtttgtggtatatgtccatcgttccactcagatagtttttcatggcacttggattccctattcttttcttcatcagcataccttcccaaggtgtaggcatgtgtcattaggacaggattccttggtgtgcagaagtggataatggcattttgccacactacagaatttcttgactacgtaaatctctggaatgcttattgaaatggaaggttcctgttcccaaccacagatttgctgaatcagagctttgggggctgggggaggagcccctttttaccagctgctctgggtagttgtttttagcacgctaacatttaaaaatcttttccagcgatagcacagttagcctggcacctaacgatgttgggacatgttgtggtacttcatttttggagatgttccttatctttttagaccctttgtacagtggtcaggttctttgaggaaataatccacaagctcaggaa

SEQ ID NO: 67869 - DNA, 1040 bp, Homo sapiens
gtcttcaaagatgggctttacataatcaggtaatgctttctggcacaaaatgaatcagaaaagtttagagaaggaaacaagaaagaagatcgatgacttcagctctaggagaaaataactgaaaatagcgcctctcaaatgttaatgcactcacaaatcatgtgagaatcccactaaaatgtagatcctcactcagcaggtgtgaggtagggcctgagactgtgcattgctaaaaaaatctctgagtgatactgctactactggttcatagaccacactgtgtagtacaaacctaaaccacagaaatgttttagaaagtgagaacacaggaaaaagaaacctcacaggcttgagaagagggaagaacagtgcaggacactagaataaaacaaggaacatgagcagaataagacattttacttggagagggagcccagtaggaattagggggcatgcaggagaattaaatataagagtggtcagtgtgtttgtaacactcaggacagattttaaaacatgctttaaaaaacccatgatattaaagacaaaaaactgagcatataggttttttgaacattacttcgataagcctctgtgactagactacacacatgaatgctaactggtaaggagtaatgggaaaggaagactccgggtatttctgtaacaggcaaagagcaattggacactcacttttgcacgtgatcttccatctccatcatttaggatgagagaggagcagatacaaaagacacaggttctgaagaatggggaagcctgctcagagaatagctgttcagtgctcatgcagcttatttgttttaaactgtgagaaggatttgggaaataaggagtcacctgcatcctgggaactcaagctgcctacggaagtttggcttgtcctattacagcagtaatatattggaaacaagaagacatgaacagcttattaaatagccaggtagctgggcagaatgagaaaatgcaaccctagacaattgagccatttgggcaaatatgagagtctggagtgagctctg

SEQ ID NO: 67870 - DNA, 1058 bp, Homo sapiens
tgtcgtttgctaagagaatttgttccactggagggtatggaaaagtgtgtttctggttcctaaaatctataggtaggtagatgcttaccgactccatttcatctgagtgttcactttttggttttcgtaacacaaagtcagtgttttcatagagagaaaacactgatatttgttttctatagaaacaaacactgatagaatttgactttttctctctcatctccacagatttctcagagaagaatgggtgtaaaaaaccattccacagtgactgagtttcttctttcaggattaactgaacaagcagagcttcagctgcccctcttctgcctcttcttaggaatttacacagttactgtggtgggaaacctcagcatgatctcaattattaggctgaatcgtcaacttcatacccccatgtactatttcctgagtagtttgtcttttttagatttctgctattcttctgtcattacccctaaaatgctatcagggtttttatgcagagatagatccatctcctattctggatgcatgattcagctgttttttttctgtgtttgtgttatttctgaatgctacatgctggcagccatggcctgcgatcgctacgtggccatctgcagcccactgctctacagggtcatcatgtcccctagggtctgttctctgctggtggctgctgtcttctcagtaggtttcactgatgctgtgatccatggaggttgtatactcaggttgtctttctgtggatcaaacatcattaaacattatttctgtgacattgtccctcttattaaactctcctgctccagcacttatattgatgagcttttgatttttgtcattggtggatttaacatggtggccacaagcctaacaatcattatttcatatgcttttatcctcaccagcatcctgcgcatccactctaaaaagggcaggtgcaaagcgtttagcacctgtagctcccacctgacagctgttcttatgttttatgggtctctgatgtccatgtatctcaaacctgcttctagcagttcactcacccaggagaa

SEQ ID NO: 67871 - DNA, 1128 bp, Homo sapiens
tagagcttttaatggtgtctaacaatggcctggtgaccctgatgtgttttctggtgcttctgggatcgtacacagcactgctagtcatgctccgaagccactcacgggagggccgcagcaaggccctgtctacctgtgcctctcacattgctgtggtgaccttaatctttgtgccttgcatctacgtctatacaaggccttttcggacattccccatggacaaggccgtctctgtgctatacacaattgtcacccccatgctgaatcctgccatctataccctgagaaacaaggaagtgatcatggccatgaagaagctgtggaggaggaaaaaggaccctattggtcccctggagcacagacccttacattagcagaggcagtgacctgagaatctgaaagatgctacagggtattagcctgctggataggaccctcgaggtagataaaatctatgcctacttcttctccattgttcttaacctcaatcaggttctggtgacctgaactattagccacaatagaagatgggatgagtgtcttagaactgcttctaaatgcctcccagataaaaagtatcaagttctatgtagaagtactgtttggctcaggggccactttcccacgtaagaatgatgttggccttgctgagaaagtttcaactagtaaatctggtgtctctttcctgatatcactttttggacacaaagtacattggaagagcttaaaatatttttaaatttctttgagacaagggttctcttgaaatattggaccctgagtcccagtggagactgattgattgattgactgttcgtcaatgaggaaaaaggaaattaccttgggcaaatcactttcttcctcatagtttcctagggtcactgttgttgccatcagtgtcatcatcatcatcatattaataacatttagttagaacttactatgttccagacactgtaccaggtgatttacatttattattttaattttctcaaaattcttaggaggtaggtatcatctttactttaaacatgagtccattacaaattagagacattaaataacttacttaaggctacagagcttgttttctggaattcaacccaagtctatacaacatcagagccc

SEQ ID NO: 67872 - DNA, 1324 bp, Homo sapiens
aaaatgaggtgcatatacaacgtatacaacatggaataccatgaggccaccaaaaggaatgagatcatatccttcgcaggaacatggaggaagctggaaaccattatcctcagaaaacgaatgcaggaacagtaaaccaaaacccgcatgttcttacttgtaagtgggagctgatcaatgagattacatggacacaggggaggaacaacacacactggggcctgtcagggggttgggtgggaggaaggggagcattaggaaaaatagctaatgcatgcagggcttaatacctaggtgatgggttgataggtgcagcaagccatatggcacacgtttacctatgtaacaaacctgcacatcccacacatgtaccccagaactaaaaataaaaattaaaattacaaaaaagaaaaaaaaatgttagtagttagcctcagtgaataccagattgttataaaatttcaagcatctttaaaaatgagcaacagaggtgagtgatgtcagcgagatgacagaatagagattccagccctcatcctcctatggaaacactgattttggcagcattcatggatgagaatatctttgtgggagttccaaaagctagctgagaagttccagcaccccagtaaagtaaaaaatccaagagtggacacattaaagagagaaagaagggaagttaaattttatccatattttccctcctcaatactctctctgctgagtcctctcagttgtgattttttttcccatgaaacaaggtataagtgaagtgagctcctggcttccccagtcttccaggagccccttgtaggtcttttcttacccagaacactgagaagttcaacataactgaatgctgtgagagcagctaggcacagggagaagaggcagggagtaacagaaaccagggtgtggaattcaacagcctgccacagatcctgctgactaacttgcagactccaccaaaaggcccacctacaaaccttgcctgtggactccccaaaccagtcaatgtaaaccctcagtgcctcatgcaccaccccccaggtggacagtgcactgtgtacacctgtgatggcctgcacaagctcctacagtcagcacacagatcttaacagcaggagtgaatcttggcagttgtctcaactctgctggtttgggagaaggtgcacatcttgtatacttcagggcacttccctagggaaaataaacaggcagctgtttgcaacagcccgagctttgtaggatcaggggaaggcacacaatcctaagactttctccttaagaggaaacaagaggatcagaggaggcacatctatac

SEQ ID NO: 67873 - DNA, 1244 bp, Homo sapiens
actgcaattatgacatctgtacaaaattctacaactagacctggttggatcagtattagaatactggtaggttcaattgacaccaaaacccatgttatttctatctctcaatgtggcctaaagtatatactaccatgagtgggagaataaagaaaatgtgactttctaagtcaccttggacaatcacttttctccttgtattttatcattttaaaaaatgtggtttctaagctgggaaatatgtatacaaaggttttttcattgccttttatatttttgtttacagtattctgtatgtatttaataaagttatttcataaaaagtaaaacaatcatttactaatacaaatgaggatacgaatagcatttcacatacctctgaaccatagaacatagattttggagagactctagacatcatctaatccagcctcctcattttctagatgaagtgtttgcaagggagagagtgaggtagaccatttggccaaagctgggggaaagtgtgtgactgagttgcaactcagttattctgatttccacctgaatgatttgagatgtgaatagttgctttcctggcaggcaaattgtgagttttgatagcacagactatgggggtgggctgcctgctgtagactctcggaagctgctgcacaaaagcctttgcagagcatgcttcacctccttgttccgcaaagtgtaaatgaatgggttgagcattggagttacgattgtgtagaagacagcaggggccccagctcctgcctcactggagcgaggctgcaggtagatacagacaggtggcacgtagtacaggagcaccccagtgagctgggcagtgcagggggagaaggcccgctgccggccctgggctgtgcggatgcgcaacacagctgccacgatgaagatgtaggaaataacgatgaggatgaggcagcctgcagccacgatgccaatgctggcaagcatgactagctcattaatggtggtgtctgtacaggcgagctttaggacagggggtatgtcgcagaagaagtaggcaatgtggcaaggcccacagtagagcaggcggaaggtgagggaggtgtggattgcagcgtgcgtggcacctatggcccaggtgattccagccatttctgcacacatccttctgttcatggccactgggtagtgcaggggttgacagatagccagatagcggtcataggccatgactgtgtacaggaagcactcagtgctggcca

SEQ ID NO: 67874 - DNA, 1052 bp, Homo sapiens
tcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagtaaatgcagtggttcttaaagtggtctcgtctccctaccccacaatattttggtac

SEQ ID NO: 67875 - DNA, 1040 bp, Homo sapiens
gaattgtaattttccatggacttaattaatcatgtagctatgtcatattttatttcagctttttcctgttgctaaacattaacactgtgtcagtctccccaacatttaattgatataaataataccataactatgagttttgtgttaaaattttttaaaaaattaagcaatctcctactgaaagaatgtgttaaaatttttatctagatttctgattattttctcaggagagattcctgttgtgtctttcttatttttctattcaaaatatttttcgattttccctgtgatttcttcttccttgacctatgtgttgtttagtcattcttttctcagatatattttcgctaagttgacaggtgagccagagcttcaaccctctctctactctgtgttttggtcaccctaactgggatgaccacaccacacctccatgtacccactgccacacctccatgtacctttatatctttagcttttccttcataggtttcttctattcctctgtcatttctccccaaatgacaataagctttgtgacagaaaagaacatcatcacctatgtgacatcaaacactcagccttttcctctggcttctttgtcattagtgattactccatatttatcccactggccttggatcactatgaggccatgaccctgccggtctctttcataagtttcatttctgtagatggttcataagttatagaatttgctgatgctgtggtccatcaagggacatggaccaattcctgttttgtgatcacagttgcatgagccttaacttgtgtaacataggcccgcttcaggctgcctgaatcagtacctatgtcagaagcaggtggatttgtattcatgagaaccagcagtgtaccatgctgtgttatcattttcatattttgttttcattcttttcaacatttttcattaacccagtggtccaaatcttcagccagattccataaatctgtttatttctttttttggattagggacattcatgtacctcagatctccagaagctatgggttagtgt

SEQ ID NO: 67876 - DNA, 1091 bp, Homo sapiens
tgctctggagactttttttcccagtgggattgatgcgtatcgcacagccccttggccacttgatcaagcacagagaaacttacagcctgaggcattggtgcctgcacacccaagttatgttgggccatggcgatgagacagctcctctactcatctttctgaaaaagccatcttgccacatctaataaataatcttactaagattatttaatcttatggcccaattataaaagccaagtgataaaagcaactgcctctcgttctacaaatatttattctgtacgtactattctgtgcaaagcacaatgggtatatatacatgtgtaaataatgtgcctttcagaagcctaacaccgtccaacatcaaggtagaggaaccgtccagatgcaagagataagctacagttcttatccttggcctcttgaagtattgattatcctccagggctttatgattcatagggcctaataagaacctttcttttatgagtatagtaatctttgtatataattctggcttttcccagtacttgagtaaaatactgaattgagacaatacggaagttcatttctctgctcctttccttcctgatctcaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaaggtactttggggagatgatatcagttgccccagtgactcacctactaatgacagttagacctggtactaactgacagacacacacagctgcagatgtacttagagtctcatctggttcttaaggagccctaggagcccttgagaaaacaaatgtcaaatgtattagagccactttgggtggagaaattcgagctagacttcgttaaatgcaaggggagcagactgagacttcccccttcccccaactctctgggttgcatt

SEQ ID NO: 67877 - DNA, 2031 bp, Homo sapiens
gaattagtgtaatttcgatgcaacagtttctttttattaacataaccaagatattttaacgttcaaaatgaaagtaaatacaatgaaatggcagtttgcagtcagcctgtttctcctagatcttgtaaaattgacttaaaagattacatggagagtgatctcatttgtttttaaaataccatttgtatttgtacttaaggatataaataagtggattggaaaggtacacaacaaattaaacgctcacttttggaaagctgtcaaccaagaagggtagaactgaaacagtcaaaggactttctctaggtacttggatttgtttcaatttttagcagccctataggaaagtatgtgtgtcccttctgaagatggtatacgtcagcttcacgttccagagtaaagaaatatttacagagtagtatgcccctctctccttccttcttgaggattgatctcattgctcgtttgtctttctcagtttgaaattgttcctgaagatgacccccagaatgccattgtcagctcttctgcagatgcttgtcatgcagaactgctcaggactataagcactactatgtaagttgaccaaaagcttgaaaacaggctaaaagatcactgttggtacagtgaaaccttttctcttgcttttaatgggtggagatactttattttatagaaacctatcctggatcctcctgacattgtgccaactagagcctccacattatcaaagtcaagaaagcttatcctgtttgttcataccactattctgttcttaaatccatcttcatctcccgctaagctctcaaactaaaattatccctctcctgtttagggggaaactaatgcctaacctgcttccagctggagctgacttttttggattttctcatccagccatccacaacctgatccagagctgtccaggagctcgaaaatgcatcaagtaagtgtgatcaaattcattcccttgagaaaagctcagtgatcatccggccagggactggcagttcctactttgttcactgaccttctgtgtccaaagcctgcctgcttctcgaccagtagggctcagtattggcccccttagccctctggacaggtaagcaagagccaggactccactgttcgctgattattactattttctgtatgtaccatgacagcaaaaggggtgggaaatctagcagactaatttgtcactaaagaggcctgcttatttcttttaggtttttgttagcaaatatgtgttttagatatatatgggcggaatataaagaaaaattacctgatccctttagtgataggaatgggtatttatgtctagcagataactctcaagggtgatttcccttgattctgcagttaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggtatctttaactttacctttctggtttgaaaattgactgtgtttaggctaccttcccatcttcacacatagccgagtaccctaaatatctatgcattgagtgataaaagctttcattgaatcagccttgcggagtgctgagttagagggggacctgcggcctgcatagcttcctagattactcacagatgtcatggggagcacctgcgatcatagtaaggcagggtaccccagaaactaaggtatctcattctgtaacctaagcaagactggagcagaacaccaggggaaagtttactgtgcagggaataacatttcaagtgaagtcagtggggtcaagtcaaggccttggccctgcctgtgttccatgagttcctcccacaaatgagtgatcaagggttcaggctttggggtcatatagggaaaactctgggttaaaaaatggaattgaaattctcactctttgcctaatatactatataaccctaggcaagtcacttaatgtttcaaccagttttcattgt

SEQ ID NO: 67878 - DNA, 1030 bp, Homo sapiens
tactatctatgggtagctttcctccccttaatgtgaaaaatgagaactaaagcaaaaagcatcactcactgtacatatacaatgtattttacgtagtgtaaaaaatatggtttagatagtgaatatattaatgaaatcatatgtaaatttatttttagtggctgaataatttaaaacattatgtggaattcactatgtttcccccaatttaggaactttttactgtgtgaaaatgaaatttataatactctgtagggtgaatgatggtttttgctttagttctacccctctgtagagttccaaggggttctggtgtagctccaaacagcaggaataactttgtcagtgccaagattttatttagttaaaaaacaaaaaatctacacactttacaaggaacgttggctcccctgaggacttcctagcattcaactcgttcagttaacccctattgcccatgctttgacctctcatgcatctggccccatagaaaccatgaaccttgtaacagattgatgcctgagaaaaagtcaatctacccgtccactcctccactcccaatacacatacccccatgggctgttctaattcgggggcagccagaggtagccaagaactctaagtccagattcctttcacctccaggaacctagagtacatagtgtgaaaaatacggttcaggcaatgattatgttaatgacgccatgcacattcatttttagtggctgagtaatttaaaacatgatgtgggaattcactgcatttccccaaatgtaagaactttttagttttaaaatgaaatttatagtcactgtagaaaatttggacactaaagtataagcaagtaaaaatcacccccaaattcatcattcagagaaacactattttgctgaaccattcacttgacttgagttatataattttatacagtacatattattttgtaatctgtgtttttgacttacttactttaccaaaataattttcttatgtaaataatagaatatagatttagagtgtttcagtttgt

SEQ ID NO: 67879 - DNA, 1037 bp, Homo sapiens
acacagtgtctggattataggaggaacttgattgatttattgaataaatgaataaaagctctaggggaccaaataatgaatcagctgattccaaagaaacctgacttttagtggttaggaacaatcttatgagttagctctcttaggttagttctggtatctttccttcttccatgtctccctccctcctcccaacctgccctttattccttccttccaagtcatctattatttcaaggtttccaacccatagaaggcccagagccccatctatggttaccattcaccatttcccttgagctgactagccactgatcacagagttcagtcaactttattcttactttcataaagggtgctttgtataatcccccttttaaaaaaatgtggtgattgttgagcttaaacccaaagttctctacttgttccttatcctgtagcatccaccctcgagataaacagactgtggcttatcggctgcatttgggggcccgtgctctggcttatggtgagaagaatttgacctttgaaggaccactgcctgagaagatagaactcttggctcacaaggggctgctcaatctcacatattaccagcaaatccaggtgcagaaaaaggacaacaagatatttgaggtgagaagaacagcagaataaacaggggttcattttgtggtggagtcaagatttcctccgcacttgaggccatctcttttgttattacgatgtggcgggtcttggttggttgggggctgagcttatttcagagctgcaaataaacagctgttaattcagtagcttggaggcacttttgacagacagcacaatcgagaaagggaaaacaagtccatattaaaatggactttaaaaaatttttaatttccttttacattttctctgccgaagcaaccatctttgctagggcagggcctgcagctttatttgtaggttacctattgaaggatccttgctccagaatatttaccccatccttgggtgtattttttgttacactctcctaaatcctgacattttct

SEQ ID NO: 67880 - DNA, 1104 bp, Homo sapiens
ccgagagtctgcagatcctgtaagtgatgggaagcatggggaagcctattgcctagccagagttttaacttccatgttatgtaagtgaattatttataatcagactgagagcaaaatcgctatcatatctgcctctctcccaggcagagagagctatttccttgttatgagaacaagcattttgagtaactgaaaaaacatgaagacagataaaaggaaactatcactaaggttacagttttctcccttggaaaagattctccttagggaaggtttggaagagataatagtgttcagaccagcatattggtcttgatgctgtatcttctctgtgcctctcaatcttatcctacttttgaaagtcttagaaaacaacagaagaatgacctctgcccacccttctcacctcgacccacctagcagctgcagtttgtatccatcaacctttctctggctctttttctttaaccatttctctgaacagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtaagacagcattctccagtctgagaaagagcctaccagggaattatgcaagagagagggtcatcgtcctctgtggggagttaagtatatggtgaatgtcccaatatgtgttgaatgtatgtaatttattcatgtagagggaaagcattattttcactgtcactgccaccacaatcgtttgagaacatgtaaaaaaaaagtatcttttcccccagtaatagtaatagctagtggttactgaaagctttttatatgccagacactgtgctaagcactttatatatataaattatgaatatattgaatatatattattatatattaatatattgaagtgtagatattaaagaccatgggtgaagacactacatttcagagagacttagtaacttgctcatgagcatgactagtaagtggcaagtctggcttcagtgtctgtgca

SEQ ID NO: 67881 - DNA, 1035 bp, Homo sapiens
agtaaggagggattggtacagattaaggataaaaatgctgctgctcgtgttagttctatcctcttatctgaaatttggccaatcttcatagctttgaattcggtttattacagaggctgggaatagccacaaatgagtataattgggctttgatttcactttaattgattgattaattccttggagtcctgttactatttcagctcactctgatacgtggatggtggtactggatcctatgaagcctggaggacctttcgaagtgatggcacaacagactttggagaaaataaacttcaccctgagagttcatgacgtcctgtttggagatgtctggctctgtagtgggcagagtaacatgcagatgactgtgttacaggtaatttgcagagtctcagcaataatacacagtgttggtgatgaagaaggaaaagaaggaggaataagggggcaacaaggagaagcagggctgtttctatttagtgagtaccatgagccaagatatgttctaaatgctttgaatgaattcattaatttgacttaacaatcttaagagataagctattgattaaattggtagttattgattggtgctaatgtattctatataggttaagaacttagaaggagtattgttttctctagcactttctccaaaactgagtttcttctcaagttgatttttattttcttgcttttttttttttttcttttttgagacggagtttctctcttgttgcccaggctggggtgcaatggtgcaatctcagctcactgcaacctccacctcccgggttcaagcgattctcctgcctcagcctcccaagtagctgggattacaggcatctgccactatgcctggctaatttttgtatttttagtacagacggggtttcgccatgttggccaggtttgtctcgaactcctgacctcagatgatgcacccgccttggcctcccaaagtgctgggattacaggcctgagctactgagcccggcctgttttcttgccttttaatcattcctttgagaaata

SEQ ID NO: 67882 - DNA, 2823 bp, Homo sapiens
cttgaaatctaagcctaatgtgagccttttccatctgaattcccagatcttaattctgtgctaacctgacttctattaattttgggattagtaatgaatttcagacaaatagaaaatgtcattttaaaaaggtcattagccataatcagttgtatattttcccacagcacacacaaagcccattattggactttctgaatttccaggttagaaattaagctgttaattattttaagtgacgccagatacttttctaaatacagcatttttcaccttattttggtaggtaggtaggtctgaaggccatcatagacataatagccactttaaaatattatgatccatagatttctgaaatcctagagtctaaggtattgattctgattatacagtgaggctgtagaagtcatggaaagcagtttatcattaattcttagaaacttgctaggggtgtgtttcttttcattttaataggttgattgtctagacttacactgcccagtacagtagctgctagtcacatgtggctatttaaatgtaattttaaactaaatataattaaaaatgtaatacctcagccacatttcatgttctagtggccaccatattgggcagcagatacagaacatttccatcatcacagaaagttctatctgacaccgctgttctagatacttagggaatttgacttttatttgtctttccaggaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaattaaagtaattcctggccccttggcgtactagttgagctttttgtagcagagtgtggctgcactggcagtgggggctgcgctctgacttgactgctaagaatgaagagaacaaacagagcagggtatcttcacatcctttcattctctatacctcactgaccaatgtcattatttactgtcagagtaccaaaggtcactgaacatctcattttgtaattctttgaaaaatgactaaaaatgactaggataatccttttgaccctaagtacatcaatttgtaagagactcattcctcatcttttacactcagtactcaggggcagctctcaaggagtacaactggaaaactgatgtaatcttgctatctctcaaaaggaaggaagatccagtagaaattttttttttttttttttttttaagacagggtcttgctctgtcacccaggctggagtgcagtagtacaatcatagctcactgcagtctcgaactcctgggctcaagtaatcctcctgcctcaaagcttcctgagcagctgaaactacaggctcaagtgccaccacgccagcaatgtttttcacttttttttttctttttttggtaga

SEQ ID NO: 67883 - DNA, 1030 bp, Homo sapiens
acaagatctgggtaggccatttattttccagtgcaagagtttatttaaaatggttctttgcagggtctgactatagcattagtgccatgacaatgctgaaaaaaataacgtgatttgggcatgggatttctttttctctgtaggtataggtgggattagctgaacctggctaatcccctagtctgctcatttattcaacacacgtttctcaagtgcctactatatgtcaggcattgggatacttcattgagcataatagacaaaaatctctgctctccatcccaactccttagcatagtcctctgtaagatcaataaaacatttcaaaggagggcagggaaagatggtagctatgaaagataattttcctttaaagcatcgacctatgcagaaatatggtctatgtcttagcctcataagcaccacaatcagacatcataaaattgaccaagtgcttttgtctcctctgagaagaggaataattccctgagaaggtagtgatttcatctagatagccactctcatacttgaaagctttcaagacaaactaaaggatagagggtaaattcagggcagtcttagctccaagaagcagctgataacaaaatattaattctctgccatcttgcaaagaaagtcaaggagagcgagaggacagactgagaatggccacgtgaagcctcgccagaatgttcccaaagctcctcccctagaaggtatgagaacgtagcaggaaaagtctcaaggatcaagctccttccagagcccgttttcaagaagctgttagcacgcacaccccctttcttgcctgtgtatgattgtatgtaagtgtggtagttgagtgtttttataggttaaacccgtaattgatgtggagggtagtagtttgttgccaagttaatatttaacgaaccaatcttccagtatcaaagttttgctgtacttgagaagcaaactttatatagcttcatatatatacaaattacatgatttaagcagcccgtgaaataaaaattccagcattttctgt

SEQ ID NO: 67884 - DNA, 1032 bp, Homo sapiens
gggaaagtaaggaacgccattcattttttttacctgttaaccttggagcattgatagcacccacttattcttgagtgcttcatcccacacatgtgatcttgatgtctgagagatggtagagaagaggcaaaaagggctgtgataggtaacaggcagcacaacaagaaaacattagttgttttttgttttgtttgtttgtttgagacagagtcttactccatcacccaggctggagcgcagtggtgcaatcttggctcactgtgagcacctgtaattccagcccgagtaggtgggactacaggcgcgtcaccatgcctggctaattttcgtatttttagtagagatggggttttgccgtgttggccaggttgatctcgaactcctgacctcaagtaatccacctgtctaggcctcccaaagtgttgggattacaggcgtgagccacagtgtccggccacattagttgtttttattcagcaagacaccactaccacctcccctttgtaaatgctcatttctttttcagagtctctctttggaatcaaagaattcccattgtcatctgattccatgtctggaaagagggtgagagttcagggatgaggagtttttcccccaaattgtagccattatttcattcctcaaaaaagaagctaatcgcccacatcagtaagtttaaggccatttcttattgggaagtagttgtcttttaggagtgtgacatcaaagtgtaccaaaggaagggaaactgattaatgttgtaaaaagtaagttgggcgtggtgactcatgctcacgcctttaatcccagcactttgggaggccaaggtgggtggatcgcttgaggtcaggagtttgagagcagcctgtccaacatggtgaaaccctgtctctactaaaaatacaaaaattaggctgggtgcagtggctcatgccggtaattgcagcactttgggatgccagtgcaggcagatcacgaggtcaggagttcaagcccagcctggccaacatagtgaaaccctgtctctactaa

SEQ ID NO: 67885 - DNA, 7030 bp, Homo sapiens
gattacaggcatgagccaccgcacccggcccttgtatgcttttactgatagaaattatttccttcaagaaacgggaatttggctaatttacctcttaaaggaaattaatgctgctttatctaaatgaacagaatagtgagtgaactgataattgtacttaaagtaattgttccaatctttagaatctcctataaaatctaagatacaagtttaccttattttagggtttcaaactaatgtatgttatattttatggaggaaagaactacataatgcagagcagaattttttaacgacgttcttgtatgggttctttagtgagtccaggtacccccttgaaatcgtatgggacaggttgtgtatgtgtgcatttttctgaggagtggatccatgactcaaaaaggttaagaacttctgccctggaaaggaaaagcaaaagattgaagaataaaaacattttgtatttgccaaaacttgttctgtagcagtaagtgtgaaacaagtttgctacatttttctttttggttttacttggttggggcttttttgtttggttggttttaaaggatttaggggattggcaagtcagtttgtcagatgtcaatgaacagaaaacctaagaaaaaaggtagcaaaagttctgctggccccagatggattttgccttaagtaatttcctaatcattagttacagctctgtgtcaaaagatgtacatagaaatttatgctagattcttaacatctttcttactgtgtgcagaaatgtttttttatttatgtatgctacataagatattgtctttcctacttttatgctcacagtaacaaaatatagctcaagaaattaatgtttttcttaaagatattaaatggtgtttcgttgcctcaattaactaagagcaactagttttaacagttacaatagtaactttaaaggtataagaaagatctattttgcaaagatcttgcttcaaaatacaaatctgctttagtctgaggtatcatttttaacaattttataagaaaattagtcactggaaatttactcccaatgtaatttcttcatctctcgtggagcacaatatgtgatttttaaggccttgtttgtgaataagtgtgctctttaatcatttgggtaaaaggaatctcaaatttatcatgtgtacttggcagtggattaagataactatgtaatccatttccagtgtggccagcttgacagctacatttgaaaatctgtttcactgcttgttttttcttgtaacattgtttcctgctattataactaagctgtcctccttgcagattgactttatttttcatctgacatcttagactgatcaagccaatgttttctaaacaatacatttatatagctgttatgccttatttctgttcctccacgttatagtgctccattccatgtatggtcagttagctagaacagtgtttttgtcctggtgaatattttatgattgtatgaaatggggcaaactttgagaaaattattaagccaatactggaattggttggcatatgcctttatgatttatttagtttgttttctactttgccctaccagggaagaatttaattcttcccatttcctgaaagtcaaaggattggaggacactaaagcaaaataaaccttaatttcaccccaaaagtagcttaggtaatgtcaggaagggctttgatgaaaccactgtccctgcttatagatcttattttccaagcctttcaatattttatttgcccttttctgaactctacaatttccctctcttgtagctggttcgatgcccagaactgaatgctgtgctccagctgtggcctcaccggtgctgaatagagaggaagagccaccttcatagcttacatgtgattcctctgcttatacaacccaatactggatttacttactttggcaagatagctgcattgtgcactgtatttaatgttacgtgtactgtaaccctgggtctttctctacattgctgccgttaaacccccaatcctgccaatctaaaactcctgcctttgtttaccttccccctcccccatagactccccatacattcatccacaatgaatgtcatctttttattctctcatttccttttactctaatcttaaactttggcaaaactttcactctgtcctataaattgtcagttgtcagccatcttatttttctccctgctttggtaatgggacatctttgaagtcttttctctggctcttttcccttcatagtcatgaagcacttggcatggtggatttagtaagcattctcttgccattgcttccaaatcaaataccatgaactcctctgggttgaccaccgatcaagttgttacctatgctttagttcttcagtccaggttttcctgactcctcctgacctctatccctacagcttctttcaggatacagtattctctcacaactcttcctccagggggagacaacagcatcatgtcaatttaccggggagatttccaacagtcaggaaaattacaatctctaattgtgaatagaatagtttttaataattttaagcacatttctgcccctgccccagaccttaatttttagaaactattaagcttaagttactacaaatttctaggatgagtaaaataaaggaagaagaaagggaagcaagatttttgtgttgaataggacatggttctccaagaaagccaaattgaggttcttgttgggtttgagagctgtctgaaatgggaattgaggcttcgtttttctgagcattattgtaatctcagctctagagtaggtttttaagtgggtttatttaggactgggacacgcacagtcttaattccatgctttggctaatttagagtgtggaaagtgtaacctcttttgctttattgtgggtgataattggaaggtctccatagttcctttttatccatctctaaactccctcaagtttaactcaatcccagtgcttcttacagtaccagtcaagccgaagtttcagttcttactctttttttttcttagttgatgtgatttaaatagcctctccttggatctgtggtctttactgaacccagaagttacctcttaagtgcatttatatcttgagagagttaaaatcagttgggaaatcttttttaacatgatttcaatacatcaaattcctatcatggatttaaaagttaccaaacatctttccttcaggcccctgatagatattttacatactagcatagtgcagtattcaagtgtattacaaaagtacactacaaagtaagaagtagcaagatctgttagtgtcttttgataaattgtaaaatgtgtcacctgacttttcttccatatctgtaaccattagatactgctagtttccttattcacaattacataagccaagtgaagtattaagctcaatttggtggttccaaagagagtaagagtctttgctgtggtttcctaccatgtctatcgccagagattggtggctttgcttatgcttgtgtcacttcctgatatgtgtggcacctttcttgaaaggaatgttagttttattccctgacttccgaaataaccgtcagcaacagagccaactgggcccttgtgtgtgctgaatgcttttctccagggagtcagtaagtagtgagcagtggcatggtttccttctccatttatggccttggaagggtgaaagggacatggttgggactctccatttacggtccttggaggagttgaaaagagtggttggggtgttcttggaggcagaaactagacattgtgagataaaaataaattggcaagggatgtttggaattcaaattccaatccctgcaaggagggcagagggcgctgggaaagggggagtgtgtagaaagtcaaatgagctctgccgcaggcatttgtctccttccattggaaggtttgcccatgacacacatttgccaagttcatatttctggtttgttctagaaagttttgtcttatgtaattgtgactatcttttacaaagaggaagaagaaacacttttaaaaagagtgtatcgttggaaacctcagttctctaaggcatcatttgaggctccagaagagatctcaagaaagggagaatgaggcagatgcttgtgcagggggtaggccggctggctttagggtgggagactcttaattgttgctctgtttttgtgtgaggaagatcatcacacatgtcgtgcttttattattccttttacccatctagatttctggcttcaagggacaaatttttaaagtatctgatagagtgtcttgtagattgtcaactgtgatttaaagatactgaacttcctggctgggtgtggtggctcacgcctgtaatcccagcactttgggaggccaaggcgggcggatcacctgaggtcgggagttcaagaccagcctgaccaacgtggagaaaccccgtctctactaaaattacaaaattagccgggcagggtggcgcatgcctgtaatcccagctacttgggaggctgaggcaggagaatcacttgaacccagaaggcgaggttgcagtgagccgagatggcgccattgcactccaggctgggcaacaagagcgaagtgctgtctcaaaaaatatataaataaagagactgaacttccttggaggctttgtagatattattaagagttgttttagtttggtgaaaatagttaacatattggcttatggagagcaatctcacgtttaggataaatttagtctggcagtgcctacaaattaagtctgaggtgaactacttttgaacagttgagttagaaagtatttggtagccaccagggaaaagagatcttatttcaagaaaataattagtgaaactcagtaaagtagaagggagattagaaggaacaaagggaggcagagatgggatagagactggttgcaacttaactaaatttggaagctgggattaagcccttgatttatcttttgaaatgccatataagatagcataagatgtaccattaaattcaggaaactgggctaataatcagaaatatgtgttagaaataaagaccatggtaaaaatggaagggttgtacaagagaataaaattattcaggttttgtctgtggatttgcataatgatatttatttgctgtgtgccacatggcagaaaaggaagtgaaataacacccctctgtcccgtccttttccccagaaagaaatcactggcttcatttgttggtttgtttagctggcagcttgagttggtagaacagacgagtagattgtctagctttagacgtaggtattagtgtactgtttcttgatcattgatgtttgagacctggaatttgtagcattattgatttgacctctgttttaaattttagcggcttccacaaagactgagttagtaaggaatacaactatgtaagtaatatgttttactagctaatttgtctaggcaattatttttaccctgtattcattccttcttaatcaagagtaaggcaggtattctttgctttgggaaattcttctttctgtcctcccttccctcactttttccaaattctgggcacaacagcagctctctctcttctgtggcaggtgtgcatcctattggctggctggtatttcttgttttttttcccccttattctttttaaatgggggtgggggtataaaaatatgtgtatggggtacatgcaataatgttgtaatgtttcttgttgtttaatggataattaattgcaaaataattgttttaattataacatgtttgagtaaatgctaaattagtatttttttctaatataataatgaatttgaaatctagcattcctgtaacaatgtgtctatgtttgtctgtctgtgtctgtctaatagtaattaatatctgtggtccgtacctggaagaggaagtacagctttaaaggaataacaaaagactttgtgtcttagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattgggtaagaaagccaacatatatgatacttatgtttgtgtatatttatatacctttatgtatgtgcaccagtacttattacctgtaaatatctttggtactgttccctatagtggtcagcataaggcataaagggcatctctgccttgtatgtctttcatgaatttgcatgtcccagtctatttggggcaatgtgggcatccttggtttagccttaaactgccaactggtgcttggtgttgttcatttggcaagttgtttaccagcaggattcccaaagacacagaagaatttctaattctgagctatacaagtacactcagtgacaggtaacatcctatgcaattctaaatatcctgtaccttctagttctaagatgactgctaagatatcttggcccaactgctgtagatgttgttcttaggaattccttcttttatcccaaatacatttttcttttctgtttatgatttggaaaaggtcttctctcagacttgagcctgaacacaaaatgaggggaagcctccatttatcttgaatagagctgttatttgaactgtgtgatcatgttccttcacacttcttaagggatcgcatcccaacagtagctggaattatttatacagtcataggcattaaaaatggaaaataaaattcctggtcatcaaatctaaacttgtagggcctaactaagagtatatatgtagttgtgggattgttctgtttctttgcgcattacatgctccaatttttattttcataatttgatttcataatttggaggtactgatcaatcagccattgtacattaacaggaggtta

SEQ ID NO: 67886 - DNA, 1043 bp, Homo sapiens
ccaagcagtgtttctctggaacccatgctcttcttaaccacttgcttatatcacctttttctgaatcagcccatctttattaaattttgacaattgaagtcatgtttttggcaacgacgtgattatcaacattcataaatacgataccaaaatcatatagtaacacccagatggacagcattatgctgatatttcttgtcattgaaatgaaaagaattttttaaattcttggagataatttatcgtttcctaagattagaaacacaaggagatttggaagtcctgaggaagaatttaagataagtattgaaacctaataagtaaagacttaattgtattcattcagtcattcattcaagatctcagataaatgatggcatttattggatcaccaactcctccaaaaagaagtaagtttgaattataggagcagaaacacaatgtagaattactttttgacagtaaaagcaggtaaggatgtggcttatcaaaggaggctatggaatgttcactaccttatgcctgccattgtttacctaatgtgtaaatggtttgggtgcttcttagagatagatgatggggatgagatgaactgttttttaatatatgatataccaaacaaaacatatcagcatattgagaaagctaaaagtagaatcaggaaataagaaaacagagaatgccagcttggcgtggtggtgcactcctatagtcccagctactcgggaggctcaggcaggaggatcacttgagcccaggagtttgaggctgttgtgcataatgcttgcccctatgaatagtcactgcactccagcctgggcaacacagaccccatactaaaaaaaaaaaaaaaaaaaaaagaagaaatgatgcagggcaaatagcagtaacctaggtaaatatgtttacttaaactaaatattaaaatgagctatgagcttcctggcaatggtagcaaaaaagtaaatacagtgacttgccataattttcagtgtcttctgaagagaagtataccaggtcttagttttgaaaccaaagatgaa

SEQ ID NO: 67887 - DNA, 7672 bp, Homo sapiens
gaccaccttcctgaatcaccttaaagcatgtcacttaccttctttggactgtgccttggtcctcttatctatacagtaaaaatactaaaattataagtattgaaattgaattaataatttaactcttggattttgagactaacatcctactttttaatactgtctaaatgaacatgtttctaagcacacaagattttaatttacagtcagatatgaaaatttgtttattgctgcaaagtttgattttgatgtctgtcatcttattggtatttgttctgtcgtttgggtaaaacggatgtgtttgacactgccttactacatagattgtttatcttgaagttttgttgcatttttgtttgtttgccagaagaaaatttgtctactaacaattccagcccaattttggagtcagatacacaaatctaggtagttttttatctagtgattgcatgatttttctcttttactgtaggccttttcatatctccagtcaccaaatacttaagtgcttactatgtggagggctgtctgctaggtgttaggatgaataaaagaactgtagttttaaaaataaaaataaaaataaaagtataatatacactcctgtagtccaagagcataaaatccaattgaagcttgtgtacatacatcaatgagttaaaaagctggtcaagacaacacaagggatggaatgcaaggcggtacttgatttagtgttatttgcctaaagcagactataagtgtgatgacttcaaaggagtgaccagtctcatcgctggccatactgtagtagttgaaagacctatctagacttggaattcatgaaagcattcactctgagccagatgctgcattcacacttcagtcagttaatctgatgcactgcaaaactcattctcaagtcccatatttttgggtgttctccaaaaatttgcctcttgagagttggctttatgtctttgaaacagatgtgtacttctagctgtgcctcaagatgaaatgcaaggtgattgaatgtgacctaaaagacttgccttttctgaatcagtgctggtcgctcatcagacaaatttaaaaatggtaaaagaggccgggcatggtggttcatgcctgtaatcgcaatactttgggaggctgaggcgggcatatcacgtgagctcaggagttggagaccagcgtggacaacgtggtgacacctgtctctaccaaaaatacaaaaaattagccgggcgtggtggcacacacttgtagttacagctcctcaggaggctgaagcgggaggatcgcttgaggttgggaggtggagtttgcagtgagctgagattgagccactgaacttcagcttgggtgacagagtgagaccctgtctcaaaataaataaataataaataaaagataaaagagtcttctgcccagagaacaaaatgattaattttctggggacattgcttagatttattcatcagtaattgtcatcatctttggaacaaattttgtactctaacaggaaaatcaccatatagtatatttggtctttcattttagctctgaagccttgcaattatttataagaaccaacagggcaaagataactaacttggagcaaaaagctctcattgtccctgataagcattttaatagactctgcccatctctgaggacttctctttggcgtttgcagacaagacatttcttctatcttctcattgaaagatttctaagaaatatgataagctactcaaataggtttagatttatttcctgttattttttatatatttagtctctgttgttaccatcccaatgttacctgaaatcttgtgccttccagtttgcttatctgcttatgaatttgacagatgcttgatgtgtatcctctaagaatagaccatctttgactaccaatcatacacttatatttaagatttcagttttagaaggaaaggagctaagaagcacatgttaaaactgaatgagtagaattctgggtttattttctggcattttggaaatacagtgaagggtggagttaaatattctggttacttcattaagaggacatgttaaaggaaaaaataatttagaaagcatgtagtacaaatagtactgttccataaaattttgtgatgatggaaatattctctatctacctcagttcagtatgatagccactggtcacatgtgtctgttcagcccttaaaatgtgtggcattgtgcctgagaaacagaaattttaaattatatttaattaattcagttttaagttataaataggcatatgtgagtagtggctaccatattgaacagtttcaggtaaaaagttgttattcacagtattaaattcatctttgtaaaaggattctcctggccacacactcaaacctctagggggagctcaaagttccttcttgacctttctgtcactttacccctgtgtaggaggaatcttgataaaagtaaaaaaaaaaaatggcctgccattccaggaggtggtgccaggaataaaagtcttataacttcaactcactggggcaaacagtgcatattctaggttccctaggacagccctgtccaatagaatttattgtgatgatggaagtgttctgaatttgcactgtccagtacggcattactagccacaggtggctcttgaggacctgaaatgtggctagcgtgactgcaaaattgaatttttaattttatctaatttacatttaaatagtcacctgtggctagtgactgttttgttggccagaacagcttttgaataatgggtgttcagactttttgcttgtgtactcccaaaaggctttgaaacccatgtatcctctggaagatttttaagctgacattaaaatttttcatgatgtgtttggaaatttatacgaggttagcaggacatagaaaatgttaagtctggtatgagatgaatatgatgagagttggcgataaaatgtactgaataacaaactgaatctgaaaaatacacattaaatcattatttgtgagttttatcaactgtctcttgaaatttttgctgtttaggaaatattcaagttacatttaaaagaaacagtatcactggcctatattgtttttgttattctaaattcaggggccaggattgataacttaaacaatataaataagagggggaatgacaggaatccctaaggtttcaagttgcctccatcaattattaaaggagactaccccagttaaagactgctgctttagaactcagtatctttttgatatctttcttggctgatgtagtggtgctgggctcctgaattcccttgccattagaaagccagagggaaacagggaaaggttacaggggaaaagtgtggagcttaacttttggctaaagttcaggtatctggagggggggaggggatttagatattttgctcattccctgtcatcagattcaactgacagattcatcacaagatttctttaaatgctaaggtctgaaataaggtctttatttttttcattattcatcaacagatagtgcctactgcagtaggtctgagagttacggtagtataccatcaccttcaagatgtccatcttgtaataaaggagtcagattactaaggaaccaattacaatattgtgaacaaggtcttgtgtgtcatgttaatgttatgcttatggtgctacaggagcacacacatcctaggctttcaaaaggtggatcctgaagggtgaaggtggactcaaaggtagatgaatagttagtgtaaaagctcagaggcagcataacctagaatagtgccaactgcaaatataatgagatatacttaccaaagaatgcaaaactggaagcatccaaacagtgttcagctgtttaaaaagtcatgctttttaattgaagaataatttgccagtagtgcatggcatgtggtgaaagagtgatgtgggagccgtaaatgatgccttagtggtgtcataatcacgtagaatggtggagccagtagttttgggatgacattatagtgaacataccaattccaggtcatttatatgttgtgatgagtaacaacttttttatggtgttgaattgcagttgcgcaaatatccattacatatctcatttcttaatttgtatactggaaagtaaaaccaaaacagtgcatctttttttgaccacaactcacaggaagaagaaatatattttaccctgggacctagtagtttcatgacatatatgtataactgaaacagatttcacaaaacagtgattatagccaacacatagtattttctatgtgccatgcactattctaagtgctttgtaaatattaacttaatccacataatgacactatactgaactacatgtaatatactctgatatgttctgttctaattgaaggcagacactccagctgtagagcctctttcataacagtatacacagtgaatgcacctaacacaatacctgcccctggcgggggatctttctctgccccacatcctcctcctccccagtgcttgtcagcattggctccccttttcaccccagtctctgtggtacctctcatctttccccttccccagccacagccttgcctgtctccagaaatgccctcaccaaatgctggtgcaaagaaagtctggaaggatggaagctgccgatcccactgatattgggcagcgggcttactcctcggagactggcagctcagggtcacattggtgacccttctgtctgcacccttctgtcgtttcatttatcccttctccaactcttgccctcagccatttaggagagtgactcgcctgacctcccagtgcaggtggggaggggtccggaagtctgtgcttctcactcaccctgtacactgagttctaaggttttgatgatgtagcccgtaatgatgccttgtttgtcttgcacattcacggagcagctgtaggggccagagtctctctcctggagaccctccagccacagggacagttctaggagggcatggagtagaccaaggatactccaggtttgcttgttgtgaccccattgatggtcaatgatggcattctccaaatgtccctcacatgcacccattcttccaacctgaaaccagctcccattcaccttttgtccctagccccctttcactgtccctgggtcctcttcaccagaatagttcacttcttggtcccttacacgttatctcttcatctcctacttgtgtttagaaaggtggtcacaacttgctaaaattaattgtacaacccactaatgggccataacctacagttaaataaaagaggactagaagataatacagtgagatcaagattttttcattcattgtgttcttttagactgaacctattgaaactccagaaacattaatttgcaacatctgtcccagatattctggtgaaattatattacatagttttagatagcttgagcctaagctttgagataaagggtgaagcaggggagtgggaagtagtaagaaatgagactggagacttaaacaagaggtcaggtgatacgctaaggcgtttggactttattctaatcatcaaaggattttaagccaggcaatgacatggttagtcttaaattttaaaacagtccctggctgtaatatggagaatcaaaagagtaagactggaagcacaaagattatttagaggcttcttgcagtaagctagatggaaagtgaaataaagcagtggtaacgaagatggagacacaagaataaatttcatatacatcaaaaccgaggacctgtttcgaagaatctgggaattttaatttccagaatttgttagatcctaacctgtgagacaactcactatctacttctctaccagcttacacagagggttcttgactgcagtcaaagaccataacagtatttcatagctgaagttttcaggcttgatttctaagaacccaaggaaaaccaactgaaataccaaatgaagacagtcctgtctgtatttcctctaccatatactctctgcagactcttcagttctgcttcccagtcttcagaagtgattatcctgctttcccccccgactttttcacaatattaccagagagtaagaactaaaattcagatccagtatttcaaatgttaagtgtcatgtagctagatacctagatttgtgctcctagtgttacgttaacgtagaaccagcagttgttttctatggaaaattgtatctgtgtaatgttaaaacaaacgaaataaaatagaaggaaaaactttctgagtttcaaaaacaacagactagtactctaaagaactctttaaaacaattaactgttaggattgcagttatgattggatattatttaattctgtttctgatgtggggttcctccactgtgttctgtgtgctattaatatttaccattgcagaagcttcattcagtgttgaaaatgaatgcttagtggatctgtgcctcttatgcatatgttacaaattatctggagttcctaatcaatgcagagttcccctcccctccgattgttctaaataattgaaagatgtctgctgtggaaaaaggcatgtatttaaatctgtatgattctcaaccatctttagttgggaaaggtccttgaaagccaatggaaatactttttttttttcttggcactaatcaagtgagtgttaccttttcacttagtaggatgtgttgttacgctagtaaaatagaaacctgtgtttattctcaggtattttagaaacaacagccatcattttattttatgtgtgtgttcttggctgtattcataaattatatattttgggctatcaaatattacttcattcaatataaataacaatagtagaagttgtttacttagatatgctttctagttgcattttctcagcctatgtaagactactttgttgtaatagcctttgaaatttacagtactgtctctctactatcttcagattacttgattcaaataaaccaattatgtttgtaattgatattaataaaaccagaataaaagttcatatctacccaaaactgcttttattatttttttaagttgcaaatacttttctctaaagggaaatagctggtttataatttagaaagaataggataggtcaaaaagcacttcaacctaatatttggtatctccactacctatacaccatcttaaggaattttccattcattcattcatcaaagatgtattgcaccccattaacatgttaggcattgatttgggctctgggaatacctcagtgaacaaaactgacaaaaccctgccttcaaagagcttacattttggtagaaaataatgtgatatttaaaatatataattaagcaattaacacaattagggaaaaagaccctcaaatatgatattcattgataaatccttgaagttgagctctttcattatgcttatgaaagaaattcatttgctattgttatattaagaatgatttacatgattttatatcattcctttgtcttgtgtatatccagttgtcattgaggtttgtactaccaagcagcaaagtgctacattcttactcatcaaccatcagttcatgagcatctgctgttgtgccaggcattatgtggagccctaaagagtcagttttaaggaaaaccaggagagatcccttctctgttatacagtttaggaaacatggttaa

SEQ ID NO: 67888 - DNA, 1073 bp, Homo sapiens
tttaaaacctactattgttcaaggaatttgccacccattaattactccattacaaatttaaattagtgtatttgataacatttatctttgggacttcttaagctttctctttttttaacaaagacattaaagtagtagctaataggacaaagctactcttctctgaatctcatttgttctattcaacgtcattaaggttaaattttaatttttatttatttatatttagagagaggatctccctctcttgcccaacctgaagaactcctgggctcaaacaatcctccccagtagctaggactgcaggcatgccccaccacacctggctcattaaattttttttttttttttttttttttttaagagacagggtcttctacgttgctcaggctggttttagctccctggtctcaagctgtcctgcctcagtctcccaaagcactaggattacaggcgtgagccaccgtgcccagccaaggttaaatttttgggagactttttgtactgtcttggctagcgtctatccatgacctcttcttgagtttagaagtgcattttaggcattttaaactgtttcagcttgattgatttctgtctgtagaaacttcccaatcacgcagaaaaagtgtgttgtcaaaacctcactgaatataaatctctccataaaattgtttctcaaccagggagtatctaattgggttgtttcattgtccagttatgagaaggataacttaaagcaagaaaaggagatttatttgaataatttttagaagaggattggtttacctgtgtccagacaggtaaaaccaagttgacctcaagctcttagggtattttgggaatgtgctgatgagtatgggttctctgatccatagtagctgttaacaaggagggcagataactgttttgtgttttaaagtgctctactctttatgtgatttcaatcaaagaacccagactttttcattagtaatgttgagtgttcctgccagaatgataagctctctaaggacaggttctggtctctcttactcactgctgtactagcatatagtagacactacatttttttt

SEQ ID NO: 67889 - DNA, 1167 bp, Homo sapiens
tctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaaggtaaccggccgcccggcctggggcagcgaaccagaggcagagagaaggcggggaagcgggcctcgggggcgggggccggtctgagggcagggctctcctccggggcccggtgggcgattcgcatctcctccgcctttttcttctctccctgggaagggggctttttcccagatggccgccagcccgtaggtttcctgagtttgaagttgggcgtgcctgccgccgcccctctttcttgccaattgagatgttcctgcgctctgaagttggtagtttctcattgtgcgccgtgcggcagtccccgtgccgctggcgcctcttgcccccaccgccggggcccctcgctttgttccaggcggaggggctcccaggcagaggcttaccggccggggcaggattgaggaagggcagaaggggggggcattgagcccctagtttaggaatagttaataagtggccgtagcggagccatagaaaaagcgccttgggacgactggcctttgtgtcagtcgctttgcttctatcttgagctacgaaggacgagtaagactagagatgctttggagaattggaaaggcttgattgtagccagattgtgtattgttaccgcggagttagtgtacaccataaaagttagcttggccaagagttggtctggaatttggattgtcgatgcctccagagttagattggcttgaggccctgcggtttcttaggaagctccttcaggaaagccagtttttccctgcttcagtttctgtgccggatgtggtgacaagtagaactctcagtgtgcatctggccgtccttgtgtacctgcatgtttaaatgcagaggcttaatttgggcta

SEQ ID NO: 67890 - DNA, 1057 bp, Homo sapiens
gagacccagtctctttaattttttttttaattagccaggtatggcagcgcatggctatagtcccacttactcaggaggctgaggcaggaggatcacttgagcccagaaattccagtccgcaataagccatgatcgcaccattgcacttcagcctggtgacagagcaagaccccatcaaaagaaagaaagagggtgagaaagagagaagggggagtggagaggaagggatgaaaggaaggaaggaaaggaagaaaggaagggaggcagaaaagaaggaaaggaaaggaaaagaagagagagagaaagaaaaaggaagaaaggaagaaagaaaggaaagaaagagagagagagaaagaaagagagaaagaaagaaagaaagaaaaaggagaaatctcattgaaccaccaaatccaggatattgcagcataggactttcttttctgggaaaaagctgtgttttgagcaggattaaaagatgaccaagatcctttgcctttctctaattgttggtcaattgagttggatccttccagagacggacactgagacaagcttttgagtgcaagaagtttctctggggaagatcaccaataggaaaataaaggtctgagaagggaaagaagccaatacagggtaaattgtggatagctggggcttaattccttcagggaactctgggacagatggcttaggatgcacctcagagttttcctacctgaggggcaaggaagttgggatatgtatctaccaaccctctatccatcgtttgttaagatccacttctgggagcattaactgttgcaggcacggccttgccacagaaccctagaggccaatactgcagctttcctaacagagcttgcaagagactctgtgtggcctacatgcctgcaacaagcatctctagcaccatggaattaccaggcacatggcccaagcagaaaggccgcttaaactgcagctagaacctgctgcgaagtgtagtcttgctctgggcctccctcaaaatccgtagccttctgagtcacccaatacatgcgtgggagcagtattcaaa

SEQ ID NO: 67891 - DNA, 1135 bp, Homo sapiens
tccctctgagctctgcatcccatacagagcaggccatggagcgagccacccaagaacccagtgagcatggtccctggaccctggagcagctgagggctaccttgaagcggcctgaggtcattgccacctgcggtgttgcactctggctgctgcttctgggcaccgccgtgtgtatccaccgccggcgccgagctagggtgcacctgggcccaggtgagagtctgagggggacccacatgtatacaggcctcctcagcatccagccagaatggtgcaggggctttggatctctgaccaggtgatccagcctctggatttagctttcctcctgccttctcccaggtctgtacagatataccagtgaggatgccatcctaaaacacaggtgagaggtgaaaggggaggtctgaagtaagggagggtggcaagggacagtggagctgcaacagagaagaatggagtactagtctacctgccagggagtttgggactgtcgtacatgaatctctcctgtaactccaactgatagttcatttctctgtcattaatattcctatcacaccacttgacagactagtaaactgaaactcataaaaccttctaaacccccaatccaggactcttgtcaccccacctctcctgctgcctcacccgctaggtggagaataatcagcatgagacgaccacctcaaatgtctcatcttatgcgtgcacccatggtctaccaagtagtgcctttgcactcagtaattctctcactgagccattgtgcctacatcatagtccacccgcagctccagcagagggtgttcagtgcctacatcatagattcttcctcactgttctcaaaaacaggatctgcccatgggcccttctgcttccggtatattcggctgccagaacaagtctgcagttctgggacatcatgctgatagagaacacatccttcttgctcccgttgtctgagttttgtactaagtaaccgcctcatctctctgtctgccttcttggctctttatttcgctagatctcctctgggaggcttcccactccaggtctgcatctatccacagaagttactgagcacctactatgtgccagcaaatccaggcctagagctgccatttcactgtca

SEQ ID NO: 67892 - DNA, 1045 bp, Homo sapiens
catataatatatataatatataaatatatagatatataattttgtatttttttccatatcttgacccaaccattaaaaatgtttgtctcatatatgttggcaattggttgaatactaaactgtaatgtttttctctttaattacaactaagaaatttatagttaaatttaaaaaacaagtgggcgtggatatgtgtccatgtatggcaacacatcccacgtgcgtttatatggttgtctttttctagcattgccttgtggctcctcagagtttcttttgtacctaaattattttcagatgttggtttcttgacagttttcatacctatcgtggtttggtagtactatagtttgggccattagactgactccagggtactgttagatgaggtgattagacactttctactaaatcagaaaaaaaaacacagttatcagatcttagagatggatatttatattgcttggaacatgctcagacctttcaactggtgtttttccagaaagtgtactattcacagttctgattgaaataattatccaatagacgggaggattaagtctgagataacatctttgtataaaccagttttttacgtcagaggtgccatttaagtgtaattcattattgttatggtgataatgatgaattcaggctacctacttgcttccaaagaaagcatatatgtttttcaggtaaaaatatgaaaaacaaatctactcaatacaattgggaatgatctaagaaattggtgaaatttttcttattacttgtatcaagctttccctcaaatctcaacaattttctaccttcttagttgtgtgaagtgggaatttgcaaatcagaaagaacaatctatgattgagttgaaccctggttttatttcattattagtctttagtgacattagaatctgtctggttgttattgatccggatttggagatacaagtggaacacatacttgcttgtactctggcaggttgccaagactaaaatcatgagtcttctgaaattgttactggctagaataggtgcaagttgtc

SEQ ID NO: 67893 - DNA, 2146 bp, Homo sapiens
aatgtaactgcttcaggaatttagtgttaaggttagtaataacgggcaaagaatataacgttcttttgttctgtgatgtatcacaccattctgacctattgaaactacctcagtcttcttgactgaagcttttaccattgccacaggaatgatgatcccgcttggataacttatgttcagtgtttatgttgtcttttagcacaggaactatgagtaggcctcacgtgatatgagagatgagagatggaggaaggagttacttccatagcgccatggatatattttacatgaaatccaagatccaggctctgccagagagcaggtagagcagggtgtattaaagagtaagcaacagaaagcaaattagagtttgagctgggcttgtcatagtttcgttaccaaaaaagatcatgatgatcacgttatctgtttttaagattagcaatagtgttattaatattattatgaataacagcttacattcattgaacacttaccacagccaaaatggttttagaattttatatgaagtatcttatttgattttcataataaccatagaagatagatactattattatccttggattatagatgaaattgaagattgcttcgcaggtagagttaagatccagaatggtgacaagaagtataatgtctgcttttatgccataatatatcagactattctgactcatttagattacttcagggctatcactgaagcttacagtattatcactactgtgatacccctgctcacacaatttggtaagtgtttttgtatcttttagaacttatacattaggcagcagctatctgtttggtcagctgaaagacggccacaggatttgcttctgggtggccattagcacctttcacccatgcaccagagagatacttccagcagacgacaggtagagcacatcacagggtatgagcagtggaatttggacaagattataggtacctactaaactgggagtggtcaggctgatcaagaagcacattcctgttttatttcatacagcgcaaaatgtatcctgatattattatcctaatcctaagattattttaggtctcccattgaaacctagggtattttggggagcatttattgtccatttgaaaaactatattttagatgtatttttataaaaggtatatttctgatggccattgtcttttacagtgtgagaggggaagaaatgagcagtttctgagggcaggggttatgaggatcttccaccccatggccagtactagatctccatcagtaagctggtagagcataaggcaggctcaccaagaaataaactaatcaggtttgggctggagcttgttaggtttctgttgcctaaggtttgggggcattgagttaagatctgtagtttttcaagaaaatgttacaacatcctggcctactaagatttttccgtggcttaactgaagtttagtttattatcactggaattttacccctctgtgcataatttttattttctgattttatgtttttaaaaatgaaggcttacggcaaccagcagtgttaggctgtgtgagagactgaagagaaattttctcttggcctctttaagagggcaaaattcaaaggaggcaaagaagcagaaaatagagtttgggctgcggttttcaggactgaactgcaactcttggtgatttttagtttgggtctgtaaggttggcctaagggtatgctgctgtgttttagtctacattgtcatttatacatcctgagccctgccaggctctttcctacctcaggtcttttgcatatgttgtttcctcttgtctgggtagtcttcccttttttcttcataaagtcggtcccttcttatccttcgggtttcagcttaaatgtcacctccttggaaaaggctatccttaccaccttatcaaaaatagatctccttttttctgtttttctctatccttgcattctgtttgttgccttttcagtacaaaacaatttgtagttaattattaatttgcttgttttcttattgtctggagatttcccactagcccataagcttcttgagagaggtaccatacctgttttgtttaccattgtatgaacagcacttggcacagtggctagtacctagtagtcacttggtagata

SEQ ID NO: 67894 - DNA, 1065 bp, Homo sapiens
ttagctgtaattgtgatctgatctgcatgaaaaggtcttttcagttctgtattgctcatatgtaagcattttacaggctagcaggtaaaagtcaaaatgagaatttcattcagttcatttgactgaaggcaacatacccctgctgtgggtgttttatgtctaacctaaatcttctcatgacatgcctaccacatggcatagtcagtgggaaacttctttagcaatactactgaccttctttgaaagcttttctgctaaaggctttttgttttattgccatttcctactggataatcttttccttcttgtgtttatactcttgacctcagaaaaaatatgaaggactgattgctttacagatggtatcagaagacttaatcttgtattgatagttggcaaataattaaaaattaattttgccttttacttactgaagaaactaaatcatttatgccttctttgcatggaagtcacatgatttaacttgaagacaaaaccaccttagcagcattctaaaataatcatacatctgttttataaacagtaattgataactactttacctcactcagttgttataagaataaaatgatatggtttcattcattgatttagcagctatttattgagcatctgttaattggtagagatgatgctagacatagggtatgcaagaaatgaaaaaacatgatccctgtcttcaaggatctagctagataagtttgactaaccagtggggaagcagataaatacggtcatgcaccacataaagatgttttggttagtgatggacagcacatacactgttggtcccataagattatagtggagctgaaaaattcctatcacctagtgatgtagcattgtaatgcattcctcatgtgtttgtggtgatgcttgtgtaaacctactgtgcttccagttgtgtaaaagtatagcacatacagttatgtacaatgcataatggctgatgacgataatgaacacctatgttactggtttatatatttactatactattctaaaagaaaagttaactgtaaaacagcctcagccaggtccttc

SEQ ID NO: 67895 - DNA, 1027 bp, Homo sapiens
tgggtaaagcatgactggaaatagatcattataataccgtatatttagtattacaagataatacagcacgtggttaagaacatggggagatatgtttccaagtcccagctctgctacctaccggctgtgtgactttgagagttacttctgtaatcctcagtttcctctatatacaataaggataataatgatatatacctcataaagttcctgcaaggattaaatgaggtaacgtgtaaatgtgcttagtacagaatcacaaatatagtatgtactcagtaaagattagctgctgcttatcatgagaaggaaaaaagtacaagaatatgtggtagcacagagactgttttaaagccaaagttggggatatggggtggcagaaggaaagggagaacttcctgaactgagttttgaaggatttgtggggatagtataagacaaagtgggaattggagaggggaaaggctggacaggaattccaggcaaaaggaatagcactgcaaaagcagtgcttcatgaaagaatgtgacacctctgaatttgatgtgattggagctaaaggaatagcaataggtgagccttaagaaataaggaaagacatgattgtaaagaccttagtatgtcatgagaaaaaaatttgacttcatgttgaaaacagggagctcagtggcatcatggggataagatgaaatgactgttaggaggttgttgaaataatatatagagagaagagaggtgaaattaattttttaaaagatcgttatatattaagtcctaactgtgtgtcaagcacttcgcatagattatctcctcttaatggataaagtagtcctgcaaggtagcagtagttagcattcactgagtgcttagaatgtgctaggcgtagtgttgagtgctttagagacactaagttatttacttgtttcaataaccttttaaggtagatttgattactcatttcattttacagatgagaaaatgagccctagaaaggttaggtaatttgcctaggattaagggtacattt

SEQ ID NO: 67896 - DNA, 1031 bp, Homo sapiens
ttcccttagcccttagctgactggtctagagaataattcgtatagagaattacaccagtaactaagcttttctgtcatcattgacttcgctctgtttaaattccatcattgaaaacttcaatttgattcattattcacaggaaaatcttttatcatttactttttttacaaggttgggagttaccgaacttaacaaatatgaatgtcttcaagacacttactttactggctctcattggaataagatctcaatatacgcagatccctagccaagagctcctgtgatcttaggctcgtcttttaacttttgtattttaatagttttctttcattctctaacttatttcacacatgatcttttaagagagcaagatgacatatattttaaagtcaagtgtgatgtgtgtatatgcctgttttggcctttttctatattaccttcctcacattcctagtgtactcctttatatgcctttaaatctttatcttcactagtataaaagcatctccctctgcccaagctgcaataatgtttttcacttctcccctattacaactttatgttgttttgagtttgaatcataccataaaaacgatgtttatgtcctgtactcaatttagatttacagttgtagctcaagaaagactggtaaatatgggagaatagttgtaagaaaatctttgtttaaagtggctttgtcactttgctagagatggccagtgagtagctgtcagaatctggacagacttggtttcacaaataccatctcttgtgtgtttttccaatgcctgatctttcagcctttgtaggatgtcttcctgatttttaacttatacctgtgttaatctaacaaaatggaaggctataattcccctggagtcaatagcctgccacaaatggatagaagcccagaattttcaccagcacatgctttattgaagaagtatgagtatgaactggcctcatactactgttcagaaaacaatagctcatttgtttcaaagtaatttttagcaattggcctcatcag

SEQ ID NO: 67897 - DNA, 3067 bp, Homo sapiens
ggttatgtgtttttaccacaattaaaaattttaaaaatagaaaataaaggaatcccccatacccattagtagccactccccattttctctcccaaaatgcacctccaaccataggcaatcactaattactttctgtcctatagattggcctgttgtggacttttcatgtaaatggaatatatcatatgtgattagattttttcatttaacatgttttcaaacatctatcttgtagcatgtatcagtacttcattgctttttattgctgaatagtactttattctatggatataccacattttatttatccatatatcagttgacagacatttgaattgtttctacctcttggctattatgaacactgctatgaccatttatttgcaagtttttctgtagacgtatgttttcatttcttttggatatatacctgggagtggaattactgggtcttctgtcagctctgtttaaccttttgagaaactgcaaactgttttcaaaagtggctgcaccattttacatttccaccaacagtgtataagggttcaaatttcttcacatgttcgccaacacttgtcattatctgtgtctttgcttatagccatcccagtgggtgtgaaatgatatttcatcgtatttttaatttccatttcctcatggctgtaatgttgagcatcttttcatatactttatctctttcggagaactggcttttcagatcctttgtttactttgtagttgggttatttgtctttttattattgagttataagtgttatcattgtattctacgtataggtttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggccaggtttcttaccatatatatgatttgcaaatattttgtgccattctggggattgtctttttactttctctatgattttctttgcagcacaaaagttttaaattttgacaaagtccattttatttactttttcttttgtggtttgtgcttctgttgtcttgtctaagaaaccattacctaattcagggccacaaatatttactcctaagtggtcctctaaaagtcgtatagttttagctcttatatttaggtctgtgatccattttgagtaagtttttcatacggtgttaggtagtgttccaacgtcattcttttgtatatggataacaaggatcccaacactgtttgttgaaaaagactattatttgccccataagattgacaatacacatgaacttctatttctgaactctcaattgtgttccattgatttatatgttttaccttatgccagtgcaatctgtcttgattactgtagctttgtagtaaattttgaagtttggaagtgtgaggcttccaactttgtgctttttcaagattgttttgctcttctgagtcggttgcatttttgtatgaattttaagatcaccttcctgcaaaaagctggctgagattctgataaggattgccttcaatctattgatgaatttggggactattgccatctaacttatgaacataggatgtctgcccattcatttagattttctttcatttccttcaacaatgttttatagttttcgaagcataacatttgcatttattttgttaggtttatttctaagtattttattctttgatgctcttataaattgaattgttttcttgcagattgtttatcacaggtataaagaaatacagttgacttttttgcatttattaatagttttttagagaaaaccttaggattttgtatatataagatcttgtcatctataaatagccttttatttcttttccttgcctaattgccctggctggaatatccagtacaatgtttcatagaaatggcaaagtggacatccttatcctgtttctgattttaagtgggaagcatttagtccttcaccactatataggatgttaactgtgggtgtcctttttcaagttgaggaagtttctctctattactagtttgttgagtgtttttgttatggaaaggtgttggattttgtcaaatgctgtgtctgcatttattattatcatgtattctttgtcctttttttctgttaatatgctgtgttacattgttttcaggtgttaaattactttgcattaccaggataagttgtattggtttttatttgtttctttctttctttggtcttataaaacaattttattttgctcgtttgattctactattttttttttggtttggtaatctgaaacaggtgaattgactgtttgacatcaaattagtagtagaattatgatgggattagatcttgcattggattaggagactttcaagtcttcttttagcctatgaatataaatttcatctgagaatgtgtgtgcttttacattataatttggttatatgtagacaatgtctaatgatttatgtttgtggagttagagaatgctgagtagcagctaccaacgaggaagactgagtctcatgaccctttgtgatagtagtatggtgaatcctgtttggattggatcagtgtactttggaaaagagcctggaatcttaagtgtttttttttgtttgtttgtttggttttttagtttacaagtttgtgaaatcagagttgtatagacatattccactgttgcgggaagtcagggaccccaaacggagggaccggctgaagccatggcagaagaacacggattgtgaagatttcatggacatttattagttccccaaattaatacttttataatttcttatgcctgtctttactgcaatctctaaacataaattgtaaagatttcatggacacttatc

SEQ ID NO: 67898 - DNA, 1774 bp, Homo sapiens
aaacagggtaaatggcaggcatttcaattgaaaaatgattaagtaagaatgaacatttcctcgatgactgtttacatcttactcaaactttcctcaaacttcctataggtttttccttactttcactaccagttggtggcagtacttcctgtgccactgaaaaaataagcaatcaaaaggaaacttcacaagtttccaccatcatacctacccatctacttgcatctgttaattcctgttaatgtggatgaactgtttgttctcctatcttaggcctaccctgacatgtggctagatccaattccttcccacctactcaaggacatttcttcagcatttcttccccttcttttctgcatcatcagtttttctcctgtatacaagagtattgctatcagtttataaacatgttgtaattttgcccatcttaaaaaccaaccaactagaaaaaaaagaagagaggaggaaaaaaacacctctatcccacatcttccttcagctgccactgaacttctctgcttccctttataacaaaaatccttgagttgtacatatttgctgctcctattcctctcctcacattctctcagatgcattttagtgagactgtttgcctttacctctctaataaaagtactcttattaaagtcacccaaaacttccacattgctaaatctaatggtcattctcagactccatcttactgtcttacttacttgcttactgtcttaccgacttatctgtcaacagaattaaacaattgatcaatctttttttttttctgaagtaccttattacctggttcccccaacactagagctttttatttttcttccaactacaactggctattgcttcttaggttttgttattgttgttgttgttgttttttgctgtttctcccccatcttcaatcccttaatattggagtatcctggggctcagtccttggacttcttttctgccttgcttttcgcttgctcttttggtgatctcttcttatctcatggttttaaatatcatctaaatactgatagctctcaaatttatatatctggtccacagctgtctctaaccttcagactcatctaaccctgactgcctacttgacatttagtttttcacagatttgctcctcccacagtcttcctcatatcagttaatagcagttgcatctttctagttattgaggccaaaaatctcatggaaatcattgactcccacctccgctgctcatctttcatcactcactccatcagcaaatcatttcagttctaccttcataatagatctgcagttctcatgactccctttgccatatgcctgacccacccaccgttctctctctcatggattattgtaagagtttcgcaagtaatcttcctgtttgcaccttatgtattttctcagtacagctaccatacttaatattaatgtatcccaaaaccaaccttctgatctctatcattgcacactcaccaataaaactaaccaacacaaaaatgttttccttactatagtcttccccttctcagtaaacaacaactccatccgctgtttcttctgtccaaaaaaaagtgtgaagtcaaccttcattcttttcttaaacaacccatattcaatccttattggatccaccttgaaagtatactcaaaacgcaattatttttcaatgccttccccactacaaccctggtccaagtcatcatatctcatctgagttcttgcaatagctcccaagttggttttcttgcttccatacttcctcctataa

SEQ ID NO: 67899 - DNA, 1089 bp, Homo sapiens
ttatgacagaccttggttgaaatcctttcaccactgtgagccttgactttgctgagccccagtttcctcatcaataaaagtcagatgggttcttgaggataaatgcgataatataaggaaacattcttgacgtcttgtggctgctggagggtactcaacaggtatccttttacttccttccagataagtttagatttggattcctatcaaacactaaatgtcacgtagttcttctgtaagtacattattatgctgagctctgaggcctgcaaagacaatcaagacagggttctaccttcttggaactaagaatcaagctggagaggggctgtgtacacacagtcagcaattttagaaggccctgctctacttattgagtgccaaaggatggcatttcctatgtgccatgtcattcagaggaccagcgaggggaatgcagaagtcggttggggagattttgaagaaaactgacttgctgagcacttaacacataaaaggttagagattatatgtatacattgcctggtatacaggaagcatggaatacatggcggcttttactatcattattaatgatggtgatgttattattacagatacatattaacccaattcacctttcttgtgctaaacaaaatacaggccagggtgcagacaaataaaaataaagacttatagtctgaaaatgagaaatcaaatctctgtcacatttaactgctttcacatgtccccaaggagggcatttaagaagtgaagaagacagaataggaagctgaaagtggactggccctgggccttggactcctcctctgtaaaatgaggataataataatacctgtatcacacgagtgttttgaggtttaaatgaggtactacgtgtaaggtacttaggtcagtgccaggctgatatgaaacactgagtaaacactaatgattgactatattctatttgtttttcctactactttgtgccaggcattgtttatttgtaatttttgtggaactgcaaggtgaatgttagcttccctgtggaacatatgagtgtaatgaggcacagagcagttatgtaagcctgtccagcaccacaca

SEQ ID NO: 67900 - DNA, 1048 bp, Homo sapiens
tctttggcctgggatatttctggaacatccacgagctctggtactttgtggtcatccaggtatgaatcaccgtcttgcacttgggcctgtgttgccgtctcgggaaggacctgggagaccgcagctcacagcgggtgggagcctgtgttcctggctccctgtccagtgctctctattacactgcactgagttctacctcctggccccactgcccccgcatttgttcactcagagagttggccttgagcacaacgctgtggtcacttccaatgcacgagaggcttggtctctgcttgaacaatcttgagcgagagaagccagctcatgccattgaggaggtgtggcatgtgtgtaagggaagggtaaggtttgtagtgtggggtatggagggccccttggccacgaaattgaacctcctcagcccagggtggtcagagcagggagccagtcgcacagcccaggcctgttcccaccctcccttctctctccctgcaggtctgtaatggactcgtccagaccacaggctggccctctgtggtgacctgtgttggcaactggttcgggaaggggaagtgagtgtaacaagggaggaggagtgggaaggattgggagggctgggggtcctgagctggtcaccgtggcctctgatgtaatttcagagggaagggtcagaaagcggcctccacgttgctgttcacgtgcttagaagtggctaaaagcagtgctgattttctcactgatgaggctttaacccatagagcaggcaaccttagttatgtttttttctaataatagattaatttctattttcaacgaagacaaaaagaagcctataaaacttccgccctgccccccaaccccgaccccgaattggcttgtgtgcaaaacaaagttgctttggagaaggagttctcacccttggcactactgactttctgggctattggacccttgtttggggactgtcctaccactgcaggctgtttagtagtagccttcctggcatctgctcactggatgccatagcacaccctgagctgtgaccatg

SEQ ID NO: 67901 - DNA, 1121 bp, Homo sapiens
tcctcatcgaacgtgagtgggcccctcactccccacaagtgagcctagaagttctcggtttctgggagaaggcagctggatctactggaaagattgctggtcacagagtgggaggaccagccgtgtgactttggacaatctttcagagcctttattttctcatttgtaaaataataatagtaataataatgtctatttcgtaggatttctgcaggcttaactgagacaccatagttaaaatgccaggcccacaggaggtgcttggcaagcattggttgaatctgagaggtgtgatcagggagggtggagttgaagggacattgttacagtgaccaggctctccacttgctgcaggtggtcttgtgcactagccaggccaggtatgagagccactctgtagctaagagtactaaagtccaagaggcagtagtgacactgctggttgttaggaaagccaggcctagaaagctgtctcctgagccccaggccccgctccctcctgctgggacacacactggccaccttaggagctggaggcggggctggttcccgggatggcttagatccagtgcaaggtgagggcctggcaatcacctcgggattgggggggcgggggttgggaaacttcttagaaagcgatttttttttctagacccagaagatgtggactgcgcccctcctcagcaccacgtgagtgtgagccctcccagccctatccctgccctccaactccatccagagggctggacccggagaggcctggggagctagagcagggagttctggccctcactgacctcaccgacccagtgctaggcccatgggttggccctacagcctgatgagtctggcaggtcagtccagcccgagacgaacgtgtgcctccccatcctgggagccagtgtctcttgcctgggctgcaccttcagctggtgggaggcagcacatggacgcacccacagcagggctcatctcctctgctcagggtgagccagctgagaaccaggacaaccctgaggaccctgggaacagtccctgctctatcagggagagcggccttgagactgtggccaaatgctccaaggggccatgcgaagagcctgctgccatcagcttctttg

SEQ ID NO: 67902 - DNA, 1028 bp, Homo sapiens
ggcaggggaaaaggaataggatgccctctggggtttcagggcaggagatggttgttgcagacctcagggctccaggccagcaaagggattccgggtgactctgcctctcccctctcctctctcagatgttcctgtacaactacattggccaggacgggattgccagctccataggtgaggaggaggttgcaagtcctgccaggccaggggaaaggcactgccttgggggccccatgaggctggcccacggggggcactgacaggtggaggggctgggagggctgaaggctggagagtgctcctgccttggggttggggctgcgggtggtgctgcttctctgactggctgtctctatgctgtcccagtgatgctgatcatctgtgggggcctggtcaatggcccatacgcgctcatcaccactgctgtctctgctgatctggtgagtggggccacctcccgagggccagggaccgttctgggggcttggtcagggccaccatctccaggtccatttctccctgtctcccatcccgcagaggagaaaccgtcaaagtccttcagaacgcaccatgggcccctctcctctcaagcccaaaccccagttaccaccttccctgagtcagcccctctcctgtcctggttctgctcatgctgctgctcagctgggcttccccactccactgtctctctccaggggactcacaagagcctgaagggcaacgccaaagccctgtccacggtcacggccatcattgacggcaccggctccataggtctgtgactctagctctgttgtgggccggcccctaggcatagtgccctccggtgggcaggggaggtgcaggacccctgctcacgaggctgtgctccattcaggtgcggctctggggcctctgctggctgggctcatctcccccacgggctggaacaatgtcttctacatgctcatctctgccgacgtcctagcctgcttggtaagagtcttggggtacacagataggtattgagggatgctctgtcctgccag

SEQ ID NO: 67903 - DNA, 1137 bp, Homo sapiens
tttattatactattgcatttttatgtatgtttaaaattctccgtaataaaatgtattttagcaacaacaaaaatgagcctttctaggaccatgcaaaagcttctcattaactctttcaggtaacagatttcagaatataaaagaattcatccagggacttcaaagtgtttaccaacatcctaaattgagccatttgttccctgtccctcattaatcccttcttgtgtctcctgctcagggagttgaggaaaagattcttttttctcatgtacagaggagactcagggcaggatgttactggaagttatacacatgaactaactcttggcccactcatcatggagttcaggttaacccagccagggtgtctaactggtagtaatttcattttgatgttttctttctccagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcga

SEQ ID NO: 67904 - DNA, 1044 bp, Homo sapiens
actatatccactctattggcagatatttggattgtttaaggttttagctatttcaggtagggctgcaatgtcttttttttgaatttaggtgtgcgtttctgttgggaatacacctaagaatagaagagctggatgtaggatgcatttatatttagctttattagatactgccaatagtctccaaagcagtggttaacaaattatggcccttgccagccgtatatgagggttccagttactccacatctttgtcaacacttgctgttgtctgttgttttcatgttagccattctggtgggtatatgaaggcactgaatttggttttaatttgcaatttccggatgactaatgaagttgagcacctttttacatatttattctcattcaggtatcctctttctcaagtgtttattctttttttatctgcttgatctatcagtttctgagacatatattaaaatctcctgctaaattagtggttttatacatttattgtagtacttctgtcagttttggctttatatatttggaggttttgttgttaggttcacatttgtttcaggttgtatctttttactgaatggttccttttgtcactgttcttaatatttttcagagctttacatctgttttgcgtggtactaatattgcttcatagcttatattttattttgtttcacttggttttttttcaactgtggcttataaaaaaacaaaaacaaaaacaaaaaaacagaatttcctgtcttaaccatttttaagagtgcagatcagcagtgttaagtatattcacagtgttgtgaaacagagctccaagatgctttcatcttgcaaaactgaaactctatactcattcaccatctccctattccctccttccctggtttttgtcttgttaatatttgctttgcatgtctttctcaatctctttattttcagcctctcattatactttctgtagagcttttgtacacagctatttttaaaaagaaaaatctaagagaatttcttttagtagtcaaatataatgtttccatgtactat

SEQ ID NO: 67905 - DNA, 1096 bp, Homo sapiens
tctctgatgtccatacttgtgccacttacttcctattcgttctgcgatcatggcctgattaattctctcaaaatacggtactccgctgctcaccctcttggttccttatttatgggatacaaatcaaacatcttagtctggcacttaaaaccctttagagcccagcttctgctttggtctccctcttttggtttctcagcatgaagtctcatttccactctaattggttgatactctgtcccccgaccctgccctgtgatggccacctgtgaacatttgctctcgagggtccactttcctgggctctcactctggccgtcaccacagatgcaaatccgtgcctgcatccttcaagcccagcagggattcccatcttttaaatacagcgctctgtgaccagcccacccctcagcactctctcctcctctgaactctttggcctagagcaattattgtctgcacaattcatttggcatctaatcatgtactgcctcatgacttttcatatattgtttcttgaactagggctggaattatttgctgcaatttcactttttgttttcatatgcctgtctccacagtgaaactgcaggttcctgaggacaggagccgcatctttttcatcttttcattccttatggcaccaagtgcctagtaggtataacataaatactttccagaaattcttaagaggtgttcatttaggagtcttgggactggaaagatccttataataacatagcttatactcttattttgtagataaacaacaataaaaaaatgaagagacaagaagtcaagagacttgcccaaagagacccagctaatgcagatggcagaggcaggattcaagaacagatcttttcattctaagtccaggacactctccagtcaccacaggctactgcctgtgtgttgattttattttgtgagtgggttgcattcattttcaagggtgtgtaggaatttagaaagcagaataaaccaaagagagcaagccaggagtggagcacagcctcagcaacgtccaagaggtgcaaacttgtgtggcataactctggtgccacagcaattaggccaccataatttcactcta

SEQ ID NO: 67906 - DNA, 1077 bp, Homo sapiens
taatttatgggccacataaaattctgtgaagttgccctgcatctttctgaggcaaagttgaggttttttactgtttcaagctgctaatttttccatttaaagcgagccttctgtccgtgccagtgtgcatgtgtgcatacaagttggccgctttaatttatgtgcctctttctctctgtgtaaggctataacttacaaatgtctgcatgaaatacagagccactcttcctattacaagaggcatggatgctttgtcccatgcgtgggataacctggaccccaccctgcctcaaacccagggacaaagtaacctcagtgcagagaggggcattgacctaggaacaggagttgatgggactcatcatgtgaaccaagacccagtgtcctcaccagtaagacgtggggctggatgagaggcagcacggttgggggcaggcataggaggttcagagcaggggacaaggatttaaggatggaatggagcacattcaagaactgctgccttgggcaagccatgtaagctttccaagcctcagtttccccattttcaggatgggggtagggttacaaatttctccccacagtgttgtgagtaccaagtgtgctactgactgcaaaggcccttcctcagctaagacaatatcgaagggctggttgggagctattccaagctctgagctgccggcagggccccgtaggaggggtaaagaccaagagcaacgtgatgtctttgggctttccaaagtcaaacctagatgcctttgtgcgagcccttcctccctggtctctgctgagccctgtgtggagagcggttgcgtagcacagggcaggagagctctgcacatgcttctccttttccagtagggccctctgggctggagagagcagtcatcccttgctaagagcagttggcatccccttccccaccccaggccggctcccattgcggcctttcttgagagcaataatcctctcctggtctttgctgatgcttctcatcagaagataacacagcgagtcttttcagggtctcctgagaacctagaagatattgagcaggtgctgggggattcacag

SEQ ID NO: 67907 - DNA, 1040 bp, Homo sapiens
gtgcctggcccaaaagttaaaaaaacacttaaaatgtgaacatttcaaattctacggcaattctggccacatgtgatccgggaggggagtgagatggtgcgcacagaggaaaaaagccccaaaccacgtatgtggaaagtaaagacaaggactgcctgtgccaccccaacctcagtcctcgcagaaggagggccagggaggggtttccagcacctactgcttgccagctgcccggcttggccttttggctcggctatctcacttcctcacaaaaacctggagatgatattatctccatgtgggcaaatgataggaatgagacccaaagaggttatgtcacttgcccaagatcacaaagttagcaaattgtatcatggggaatcaaactcagttctgcctggccctaatgtctacgctgtgccatcccatgtcaggacccacctcttggagggtggcttggaagagagctaggctgtcatctgagtgggctccatgagcggccacctcccagccccacctacccttgaacctgaaattctaccattcccagtttgttcctcagagctggcatttcctcttctgattcgctcttgctctccctcttactccctttctgtccccctcttttgaatgccctactcgggagggggttgctctggagcatggatttgtgttgtcagcctcttttcttctggctaagagtgacagccagagtaagaggtctaaatcatgtacctgggaggatagctgatcctgaaaagggaaaaaaggaaaggctcctccacctaagacaaatcttatacccttctgagttttgcctgggctggccctgcctgggtgcaagttgagccataccctgggccagcctctgaggtctgcgtcctgctgtcagcaccccctagttagcatctgcaccatcaatcaggcaatgcagcccctgcctgaggggtggaggggatggggtgcagcctctccaactccttgccaacccttagacacagagcccttccctctccaccctcctctttttctctctcttc

SEQ ID NO: 67908 - DNA, 1008 bp, Homo sapiens
gcactgcttttcccaagggaggtgagccccgagagaatgacagccacgctaccaatcctggggctgggctggtggatggggtgggaggaatctctccaggtttgaggctagacagataggctgggtcctgtgtgactgtcctctgtagcagccgcctggtcaggaccctgggaactggaacttcctaatgaagtgtctttgagagaactcttccaccctgtgaccaaagagtgttctggctccagtgaagttgaccctggggcttaaccctctgccttccctggcattaggcttggtcattcctggaatgtgctgggtgaggtggcctgagaatggtgtgggagacatgcagccattccaagcagagaagttaggaccggatgcttcgtgccagggcctctggactactaggtgctgtgggcagatgttccaggctgtgtccttggctgggctttgtgggatgggggttcttctggtggatagtccctgctttttgaagcagctgggttcactggcacctgaggtaacatctcagctgctgactatagtcaggggggtgatcctgctggagctataatctgaaaagtgaaaccatgctcagatttcctctgtaccaggcaaagcctattccctgccctttctatggcatcataaggcctcccgcaccaagcccagccttgcaactgatgctgacaggcccagaggctgcagctgtcttgctcagggagcaggtgtgctcaggagtggttggtcgtgctgcttccacggctcacctccctgacctaggtagagctccatcatccagggtccccgccaagaccaaagatccaggagtcctgaaatctgatgacttttatcctcacaaggttatgttaggattcaatgagataaccaatgctaacagctggcagtgcttggcacacagaaggctcttggtgaatggtatctacattcatgaagaaggactgcaccgggtctgtcccccttacaagaaggaagacaaccagc

SEQ ID NO: 67909 - DNA, 1050 bp, Homo sapiens
tcctcactggatcatctttttttttttttttttttagatggagttgcgctctgtcgcccaagctggagtgcagtggctccatctcggctcactgtaacgtccacctcctgggttcaagcgattctcctgcctcagcctcccaagtagctgggacttcaggcatgcacaaccaccactggctaatttttgtaattttagtagatatggggtttcaccatgttggccaggctggtctcaaactcctgacctcaagtgatcctcctgcctcgatgtcccaaagtgctgggattacaggcgtgagccactgtgcccagcctggatcatgcttttggtgtcaactctaagatctctttgcctcaccctagatcctgaagattttttcctgtttttttttaagaggtttatagttttctgtcttacatttatgtctttgatccattttgagttaatctcatctaaggtatgaggtttaaatcaagattcagtttttttgcatgtggatgtctaattattctagcaccatttgaacaaccccctgttgaaaagcaatttggcaatatttatcataatccacaagaacgttcatagctttttttcctgtcacttctgggaattcatcctaaagaataatgcagaaacttttaaaaaaaaaaaaaaaaagctataagcttagaaaatattcactgtaacattttttataaaattgaaaaattggaagtaatctaaatacctaacaataggagactggttaagtatggcacacacatgaaataatatgcaacatttaaaaatatgtttactcaataactttcacccattcagcaaatgtttactccatatccatatgtgttcgtgctgaagataacatggtgagcaaattagacatcatccctgccttctcaaagctcatagtctagaagagaggatagagaaaacaattctggcacttagaaaaatagatttgctaaactagagggaaaaaacagaaaacaaaattgcatgcacaaggttattgaaactatgttaaaatatatgggtgtaggaaaaaat

SEQ ID NO: 67910 - DNA, 1055 bp, Homo sapiens
tatgtctggggcttcttgtcatttctactgttctgcagccctggcagctacaggaaagtattcagatgatagaaggctcctgagatggaggtgaaatcccagagcctttttgctgttaggctgcagtgagattgggatcgtttcatacgttagctgctcgcctctgagtccctgaagaatccagtgacattttcttgctcttgcatttggctgaaagaggccacactcctgctggaagcaatcattccatagcagactcaggtcggccgagagcccatggcagagagtcctcctcttggagggtggagaggtaggcactgttccccatccccagcttctactccaccccttctgctccagatcttggagtcttcctgacctgccacgtgattctgctcctttccatcccaaatatgacatctgtctgtgctgctgccagccaagcacatgagcagcttttcagaatatgctctgtgtgcggggagatcctggagaccaggccccagcaggccctgccatccaccagaggagccgcttctgcattagccactgcagcgtgccgggttctgcactaaacactgtaacgcatcatctcatttaacccacacaaccaccctaggaggaggtaatacaattcgcctcattttaccagtgacaaaactgacactcgaagaaggcaacacatttctcaaggtcacatggatgacaggtggcacaggatttgaacccggacctatgcaacgggaggctctaatctcttacccaccactttgacccaagaaaccacagacatctcttggctcccatgcaaagtctgggtaaagcaaaggggaaccccaacgcccagcagaggcgtggagccccgtcctgggagaggtgtagagattttacatgtccagtcccggtcttcagacctcacagcgatgctgcctttgatgtctcccccaccccactcatcacattcagaagcctggcctggcatccagctgcactctgccatccaccaccccatcttccattcagccacaaggagctgagggctcactccagggccc

SEQ ID NO: 67911 - DNA, 1029 bp, Homo sapiens
tgtcttgcagtatctgaacacagtcattccttacgagaagaaagcctctcctccctcagtggaagacctgcagatgctgacaaacagtgagttcctcttgttctcagccagatcagtggctcctttttctcccttcctgcctgtacgttgtacctccgtgccgcaggcccgagactcctcaaagcaggtttacatgggccaaaataccctccaaattactgcgtcacatcctcccgcacagtgtaaaattaaaatactctgcagtgataaccagagctgttttttctttctcctggttcccataagggaagaggcctgctgggggaaaaaaaaatgagctggtgaaagaggttggggtgctggtgcaggggactttttgttttcccctgcagttcccaaggcttggcatcctctgcctccctgttctctctctccctgcaacttgaggttgcctggtcggcacttgtgccccttgaagcagggcgcctggtctctgggtctggctgtatttttaatgagaagcaaggtttcttgggtggggtaaggctgactggaaaaaatagagtccagctttccttccaggaagtgactgcctcctctcctccactttgctctattgtcaaatattaataaacattctgaactatgagggaaaacagtgtgtaacaaagagccttttgtagacagtaactgtttatatacatcaaacagtacgacccccaaagggctggggggcacatggtgttagccatcagtgtcagcttggccctcttaggacgagaaaaatcctaggctgagatgtggtgacaggcccagaggatcacgagggaaattccatttccttggcaaccgtgccctgcagagagtgacagctaacgaggccccgcccactgcagcctgttctggagggaaggggccagtgcggggctactggatacccaaggagaggggaagttgagcttctgttcagctgaggaggatggatacctgctggggcctggtgctgaaggtgaccaaacgtttcatttt

SEQ ID NO: 67912 - DNA, 1061 bp, Homo sapiens
taacttttctgtgggacttgaatgtaaatgccagactatggcagtttgggatatggtcagttaagccagatatgctttgaatagcttgttagatttaaacatctagaattttgatggctgtgaactttgaggatcttacttgggattatggaattatagagacacagggcaaatgagataaatggggttctcttttgtagttttgttgttgtttagttcatgtggtcaggttattcagtggcatgtcccatgcagatttcttacatctgccatcagctatgacatcatgcctggattccagtaacaggatggcatttcatcaaattctgaaagtcatcattatttggactagaacaacctattccttaaaatgcctagtaagacgaaatctggaaacaaccccccaggttggaactccttaacaaaatcagggcacctttgctgcagttggctgcagtgtcacttacctggagaaggcgccttgttcaccccaggatgacctgtctgtgggttaaaaaacggtgctgtcccctttgagtcagaatggtgctggccattcccctgtcgtcttttcctgccaagttggattcagtgctgcatgctggatttctggcatgctggagttagtgatggggcaaagatatgtttggaattggatgaaactctggacacctcttcagctccactgtttagacagcagctggctggagtggcctcccagtcagtatcatccattctcgagactagaggcaatcccacttctgctgatggtcacccagaattccatctccccacctcctctccagatccatgagaaagaagaggaagagttcaatgagaagagtgaaaatgattccggtatcaacgaggagcctctgctcacagcagatcaggtataagtatctctccaggttatcgggaccttttgttcttttgatggagaaaaagtccaagagaacacacttgccacatccatttaaggcagaagaaagatatgtggtcatgtggtgcctgtgctcatgactcagagtattttttgtttcttttttttctttatatat

SEQ ID NO: 67913 - DNA, 1025 bp, Homo sapiens
cgtcgcgggggttgactttagttaggacccgactcactgctgggggtggggtctggtgggggtggtaaggaggccccgggattctctgacaggacggtctggggtcgccgcagctcccctcacctggtcccattctgggattagaaaggaacaacgggaggccgtcgccttcctgcccagcccttcagggagcgcagctgggacgccgcgccaggccctggagatgtgggatgatgggcacttccagtatcatctcagcatcggccctccagccaggcctggtgtgtgtgtgtgtgtgtgtgtgtgtgtgtgtgtgtccgcgtgtgtgtgcccgcgtgtgtgcgcgcgtgtgaaggcagggcggcgaggtatgggggctgggggaagaagggaacgccgcccgatcgcgctggggcagtgggtcggtacctcgtcccgggaccgttatctggtccagtcaccgtaaacgccccaagatcatctttgtccctaaaaacttacccccgaccccgctcgtgcccctccccagagtgcggagccttccccagaccgcgcattcctgcagtgtcagaaccgctggcagcggccgcagacgccgggagagcgattgttttactacagacgggcgggagaagggaccggggcggctgcgcggtggcggggcgcgctgccgtcgggtgggccccgggctctggaatgcggggagcagtgtttgacggcgtcgaggaggtatcacagcccgctcttcttcccttttgcctatcccttctctcctcgccgctaggcatccccgactctcatccctctcccgtgtccgggcttgtttggccggaagggcagtggagtgtgtatgcggcctgcacgggatgagtccggcttcctcagagtgccagccattgtgctgcctggaggaggctttctttaccccaccggactggggggaggagggggatctgagatggaggtgaatggagcagcgggaggagggggaggggagcaagcagaaccgcgaaggggttgctgat

SEQ ID NO: 67914 - DNA, 1985 bp, Homo sapiens
acttttttaaaaaaaaacctttaatgtaattttttggtttacttgtgtgcttttcctactaagttataagcttcttgagcatttctatatgacaatatatagcttattgaagatactcagtacgtgggtgggagatggatgcatgagtgaattcttagcctttgggaggcttaggcaggaggattgcttgaggacaggagtatgaaaccagcctgatcaacatggtgagatccccatcgctacagaagaaaaatttaaaagccaggtgtggtggtgcacatctgtactcatagctctttgggaggctgaggcaggaggatcatttgaacccaggagttggaggctgcagtgagctatgattgagtcactgcactgtagcttgggtgacaaagcaagaccctgtctcaaataataataataataatgatagccttttctatagggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagaggtaaggagtgcatgcctgatatcaaaatgtccaagggagggaagaccttacatagtgacttgatgtttcagtgccattttatttcttttgtgctttttcccagaaaaatgttgcaagtgatttccccccaacaacattgacttaaactagggtctaacaataatccttgctaaaaatgtcatggtgttaaatcagaaagctgaatagagaatcgcaaaatattatttggtttgatagatacttctagggaagcctgtgtggatttatgtattaatagaagaaccctggccccacactttctcttaatcttttccatcatcagactttagaaaataaattatttttcttttaaaagctggttccatatatatacacatttttttttttttttgagacggattcttgccctgtcaccaagctgtcacctgagattgccgtggtgcaatctcagcttactgcagcctctgcctcccaggtccaagcaattcttctgcctcagcgaaccggctggctggaagtacaggtgcgcaccaccacgcctggctaattttttatattctttagtggagacagggttttgccatgttggccaggctggtctcgaactcctgacctcagttgatcgcctaccacggcctcccaaagtgttaggattacagccgtgagccactgcgcttgaccatttttttagtcttttctcattgactgacattagaacattgggagaacatgaggcactgaaaaataatacagtacccacaaaagataagatataaaatgaactactgaatgacaattaggaaataacttatgctttataaactaaatacatgtgatcttttccagtgagccacgtattgttagtagaattttccagtgttgtgcttggaatggtggagtgttctgggtaagttctttaaattccaggtgccttataagcatcttcagattgttgctgggttgatagctatgaactgttttcttgaaacactgagacaaatagttttcatctgctgatgtacacttagaaatataactcaggagtctgtgcatctgcagagattttattcccactcaggaaagcacacttatatgtaagcaaacgtcacagccctgaatatacacttgaattttgtttctaaaatgactcattcacaagtattagaggtagcagtttctcttgacactgtctagacattttaaaatgctaacagcaactatggggactcgggaagggcagatacggctagacaagaacaaggttctccctgcttctgcttatagtgatcaacaagagttaatttgcattgaaacctatagcagaaaagattgcctaccatttactgagaatcccagtgcaggcttaactgaaatttgggtactttgaagaatggata

SEQ ID NO: 67915 - DNA, 3095 bp, Homo sapiens
gggagatgatgtttcagtctccctcagtttactgaacatttcctgtgtaccaggagctttcactgtttattttcttttttgttgttttattctttttaaaaatttatatttcgttattctcctagaggccctttaagaatgggtactgttgttctatccattttatgaatgaggaaatgcaagttaccaaggttaaaccattagtaagaggcaaagctgagatttaaacccagatggtatcctgcagatagcgtactggtaatcactgtggcatctcgttaccatcatgtaagcaggtttgtgtcaagcagcacatatctatggtttctttgaattggaattgtggccagaatgtggtgcgtctattatgagttagactctttgagataggtatagtgatgtgctggcaagaactagaaagatccaggaggagacagagaatagtcacgagatgggggttccgcatttggtcttctggatttccatttctccatttctagtaactcgtttcctctttcttaggtgacccatcactacatggagatgtttggtcgtggctggaattcttcctcacgtcaattttcagtgctctttgggtgctccccttgtttgtgcttagcaaagtggtgaatgccatttggtttcaggtaggtccagggcagaatggagtctgggtcccgcagcatgattggctgacaggtgacaagtttcagcctgtgaagttagtgggcatgtagggggacctgtttttcagccttaatgtttcttggccaggtagccagtagctgatctttgtgttcttacagaatggaattattgtctcagcatctcattggcaggtgtctggtgccttttctttttcgttttggcttttttttttttttttttttttttgagacagtctcactctgtcgcccaggctggagtgcactgcaacctttgcctcccgggttcaagcaattctcctgcttcagccttccaagtagctgggactacaggcacgtgccaccatgcctggctaattttttttgtatttttattagtgacagggtttcaccatgttggccaggctggtctcaaactcctgacctgctgatctgcctgcctcggcctcccaaagtgctgggattataggcgtgagccacggcataaggcagcaatcctcctaccttagcctcctgagtagctgggactataggcacatgccatcgtgcccagcttatttttaaataagccttttcttaactggcagctctagtggcggactagtggccttagctttggggatgtatatcaaggccatttaattcatgttttggtacactttctctgttacaggatatagctgacctggcatttgaggtatcagggaggaagcctcacccattccctagtgtcagcaaaataattgctgacatgctcttcaaccttttgctgcaggctcttttcctcattcaggtgagactgaccttctgggcatatgggcagctttattaaaaagaaaaactgtttcactagagagaacttcacaaagacagagtattatatttatacagagtattatatatatgctggtgggaggtaatgatttttaaatctttttttccccacggaaatgagaattttaaaattacattataaaattataagaaacatgaatttacctgcttttttctgctactctggttattctccagtcctgccaggtggaaactttttttctttttatagttatgcctaatttttttttttttttaaagagacagacgggtcggctgggcgcagtagttcatgcctgtgatcccagcactttgggaggccgaggtgggcggatcacctaaggtcaggcatttgagaccagcctggccaacatggtgaaaccccatctctactaaaaatacaaaaattagctgcgcgtggtggcaacatgcttgtaatcccagctactcgggaagctgaggcaggagaatcgcttgaacccaggaggcagagattgtagtgagccgagatcgcgccattgcactccagcctgggcgacaagagcaaaactgtctcaaaaataaataaataaataaaagacagggtcttattttgccacctaggctggagtacagtggcacaatcatacctcactgcagcctcaaactctgggctcaagcaatcctcctgccttagcctcctgagtagctgggactacaggcacatgccatcatgctcattttaaaaatcttgttgtagagacagggtctcagtatgttgcccagtctggtctttaactcttggcctcaagagatcctcccgcctcatcctcccaaactgttgggattacaggaatgagtcactgtgcccaccctgcactcggccttttagaaacttgagaagcagctaggaagctatctcagacagtgattggagagtgacaggtgaatggtgctaggtttccgaggctttgggattaagattttccatatttgttcttcagggaatgtttgtgagtctctttcccatccatcttgtcggtcagctggttagtctcctgcatatgtcccttctctactcactgtactgctttgaatatcgttggttcaataaaggtaagtccatctaaagaaatccagaaaatggaggcccagtttggaaatgctactgctaagcagacttcttaaactactcatagtcaggcttttggcaaacaatcctttgagggaagcagcctcattggcaagagggagcttaccttcggcttagtgggtttaactctcaactttgaggctgggggatgtggtagtatggcattatctttttggtgcttaacatggtatatctctgactgggttgtaagatggcataaatgagcatgagttgctctaaattagagaagtcaaattgatgtcagcatctggatccttttgggggtgttttagaaagaccttcagatatttaccagggtgtgcgtggttgaaagaggttaactgatacttacaggatggcatccttttgatttgctatcttgcttagttccagactaatcctgacaaaggatgctggtgctgaaattcttaattcacttagcctgtcagctttgaaattacgat

SEQ ID NO: 67916 - DNA, 1088 bp, Homo sapiens
aattctaagaaactttgcatgctttatatcagatttgtacacttctaatttatatgctgtagctctgttctaaatctgtacctaggctgggtgtggtggctcacacctgtaatcccaacactttgggaggccaaggtgggtggatcgcctgaggtcaggagttcaagaccagcttggccaatatggtgaaaccctgtctctactaaaaatacaaaaattagctgggcgaggtggcaggcgcctgtaatcccagctacttgggaggctgaggtgggagaatcgcttgaaaccaggaggtggaggttgcagtgagctgagattgcaccaccgcactcccgcctgggcatcaaagcaagactccatctcaaataataataataataataataataataataataaaatctgtacctaaaactcatggtttgtctaccatagttacttagtcacttgactaaaaggaaatataatatctaattgtattggctttcttgttttaggaattgaaatgcaccagcggttgtctaacatagaaaggaattggccttactactttgggtttggtttgcccttggcttttctcacagcaatgcagtcctcatatattatcaggtaatttggctacagggatttgaaggagactagtaaaaataaaaattcatgaagtcagtgccttttgtttgcttcgttctgtttcgcattctacatcatcatttgtccatcaggagacctgcagggtatttctacatttgttagcatgaagatctagtctgaatgtccctatatcccatattctttttctatgttgcctcctgaagcaattattctttttttttttttttttttttttttttgagacagagtctcactctgtcgcccaggctagagtgcagtggtgtaatctcagctcactgcaacctccgcctcctgggtttaactgattctcctgcctcagcctcccaagtagctgggattacaggcgcccaccatcacgcctagctaatttttgtgtttttagtagagatggggtttcactatgttggccaggctggtcttgaactcctgacatcgagtgatccacccacctt

SEQ ID NO: 67917 - DNA, 1515 bp, Homo sapiens
ctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtgtctaatggttgaatttgcaaatcttgatttcgagaaatgtattcatggaatataagactttgtcttggataatttagttacagttttgagaaattagccctgaaaaatgttccctgagaaagcctggattatatgattataatcacatttatatttggtagaagagtcagattattactttttctaaagtctatatgtatatcgctactgtatattcatgaagggagaaagaccctcctagatattggtgtattgagtattaatcgagggaagccgttaaacatctggttaacagagacctttactatgtgcaagataaaatatggaattaaaaattgttgctggggccaggcatggtaactga

SEQ ID NO: 67918 - DNA, 1031 bp, Homo sapiens
ggcgtggtggcgcacacctgtagtcccagcttctcatgaggctgaggcagaagaatcgcttgaacccaggaggtggatggaggttgcagtgagccgagatggcaccactgcactctagcctggcgacagagcaagactccgtctcaaaaaaaaaaaaaaaaaaaagatagtagtactgtcttatacaagaataactaacctatggtagattagtgctatattgctatataaataattcatatctgtcatgtgatttccattttgaactgcctacagatagtgtccctcaacattttaatctactttttttaatcccccgactcttctgcttcagtaggaaaaattcgttttctttccctctagattatcatctgatgccatcaaactgtctgtgtaatttaatcagtctcttaaatcagcattgtcagttacagagaagccttgagacagatgattggaagcgggtatagatctgagcagtcgttacagtctgatatatgggatgagaacacagtggatctgtgtttgggtacctccacctctttttgagtgcatgattgtacctgcattagttatcaggtatgctgttagttgacccgacagccccattgggatttggaaaagaaaaaagtttatagccattcagttgaagtttaaatttagggctcgaaattgtgttgattcagtcgtgacttctatttttcctcttaatgcctttcacttcttctttttttttttttttcctttttaaagagaggaggtctggctctattgtccaggctggagtgcagtggtgtgatcctagctcactgcagcctccaactcctgcctcagcctcctgagtagctgggactgcaggtgcagaccaccaagcctgcataattttaaacagttttttgtggagatggggttttgctgtattgctcagattggtcttgaactcctggcttcaagcgatcctccctccttagcctctgaaattgctggggcttgcacttctggtctcaatgtttatttcctgcttccccccc

SEQ ID NO: 67919 - DNA, 1045 bp, Homo sapiens
atttttgtaaaagacaattatcttcaatttagatgtctcctatagtatttttgaaagtctcttgagagtttactctgtattttagattttctggctcttcatgagtcctaggtgtaattttgcttgccatacctattactttgctccaaggttaaggttagttatgtgtgtatggtgggggagtcagcgtatataaaagatgaccatgtaagttgagtttggtattagtaggtgaatgtaatgttataggcttttataattagttaactgtgacctatgaaagtggaaaatgtagatgccattgtcaggggaaagtaaacttctcttgtttcctttatgtggggaaagatggataaagactttattcagggattattttatattttctgtgacctctctactggataatactgtcttcattataatactatatctgctgttctttcatggcacattaccaataaaatattaactctctggtttttgcagccttctccactcgtctgtttgctgtcctgagatttgaaagtgttatccatgagtttgatccgtgagtacctttgcttgatctggtattatttcctttgggaggcattcaggttcatgggtttcagattcaaatttcagtcagctctcagtgatagagatgtgctttcagtacatttaagggaaaaaaaaacccttaaattcttccaaaggagataattatctccttttaagacgtatgtgttggagtccagcacagtggctcacacctgtaatcccagcactttgggaggctgaggtggagggatcacttgagctcaggagttcaagaccagcctgggcaacatggtgaaaccccatctctacaaaaaaaaaaaaaaaagtatgtgttggaattgaccaagtaagtctctgaaactcaaaaaatgtgagaggcattgctagtatgtctgcctatcacttaagatctggctaggctaagagaattctggctgcccagtttggtaaaagtttgtgatgcagattgaaggaaagggtcctggtgtgtattccaggctca

SEQ ID NO: 67920 - DNA, 1023 bp, Homo sapiens
gaccagcctggccaacatagtaaaaccccatctctactaaaaatacaaaaattagctgggcatggtggcatgtgcccgtaatcccagctactctagagactgaggcaggagaatcgcttgaacgcaggaggtggaggttgcagtgagccaagatcatgccactgcactcctgcctgggctacagagcaaggctccatctcaaaaaaaaaagaaaaagaaaaaagaaatgaggagactcaggctgggagtggttatctaaggttgattattcagtacgtggaggaaccgtgatttgaatgttggtttgtctgactccagagactgtagtcactgtgttatattgcctaaagttaaggcttataacaaatttggagggccaaaatcataggttcttgaaatattattggtatcttaaaaatagtatattcaatcttgtggagtattgattgaaaatgcctgcatctatttgcaaatttataattttgttttgtgtagatatttgaaagcattttggaggcattacaaataattctgtttggggcctcccaaattcagtttatattttttctcatgaatgaggagacatgtccttttgttttttctttttttgtttgagattgggtctgactgtcacccaagctgaagtgcagtggagtgatcacggcttactgcagccttgacttgtggggcctaagtgatccccccacctcagtttcccaagtagctgggaccacaggcatgtgccaccatacctagctaattttttaaaaattttttgtagagatggagtctcactatgttgcccaggctggtctcaaactcctgggctcaagcaatcctccctcctcagcctcccaaagtactggcattacaggtatgggcttccatgcccagcctacttttgtttcttgatcccaatctgttaggcttctttctcagaccctctgaatgagcaaatattgatgttagataatcaaggaatgcaagagcatctgctttgtcgtcaagagctgttagggacca

SEQ ID NO: 67921 - DNA, 1591 bp, Homo sapiens
ttttctgagatggagtcttgctctgttgcccaggctggagtgcagtggcaatctcggctcactgtaacctctgcctccaaggttctagcgattctcctgcctcagcctcctgagtagctgggattacaggcacatgccaccgtgcccagctaatttttgtatttttagtagagatggggtttcaacatgttcgtcaggccagtctcgaactcctgaccttgtgatccacctgcctcggactcctaaagtgctgagattataggcatgagccactgcacccggctcatttccttatgagaaaagcagtgctttagttgagacaagcatggagatagaagtaaacagacttatggtagtgtaaaatgattttcatggcataatatctgatgttaaactgatttttcattgagtaatgctgaatttctcaatggtgtatcctgaggagcaaaattcaccacaaatttacaacaaagtttatttcttgctataggtactttaattatcggactaccaggttcctggctgaggaggggttttataaattccataactggtttgatgaccgagcctggtaccctttgggacgaatcattggaggaacaatttacccaggtgaggagaccagatgtgtttttttttttaaaaaaaaaacagaaatatttgtatgctagagaaccagtttcttttatttctaatagctttgtcttgtgacacttgtaatttcatcctgattacaggttcctaaaagtgcatcttacataaacaggagtacatttgtagtagagtggagatgggtggtttttatacattctagacttctgattgaatccttaggggagaaatttataggcttactgcagttgctatgttagtatttctggtgatttgtcaagacttacatagtcactttattgtatctgggattttccctttctttttcccttaagttctggtaagacaacctaatggagtttcttcttcctgttacaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggtgaaggatttggggtgacaggaggcttgggaatgaatgttattgagcctctctaatcgatgctggagggtgggggacagagccttagaaaggcagggagccagaaggtgaagacagcttttactgggccaaattaattggcttcactccaacccctttctgcaatatgtgttttttatcattagcaactgtttgtccttatgagagtacagttgaaagtgaaatgtaaattgcaacataaagaaaaaaacatttaaaatgcaaaatgtgaggtttggattttgaagtcctcacaatgtaagggagaggaaaaaaaaactacatgaaacattccaaaacggttagtttttcctaccaggaatgtactcagcaattatttgttgatttaaaaaaaatttttttttattttaaaattcttaagccatttggcttccgtagtagactccataatgctg

SEQ ID NO: 67922 - DNA, 1061 bp, Homo sapiens
gtagattatcacttagctttcttggctttttaactgaaataataattttcttcctttgattgtccttgcatggcttttagaggtgtgactggtgttccaatgatgtacagatattgttaggggtagagacttacgagcttggggagattggtagccaaacagcccattctgggacagtattgatgtttgacatctcacttgatttgtctgtcctcagcatatgtgttctcagtgtcaggtttggtgtcatcatggggaattggtcatgaagtttttagcttgcttgtgctgtgagcatttctagcatttctaacatctcacatctaccttcgaaattgttggactgttttctgggctcattataaacagaatggactagtggatcctctgttctttctcagcattgtattggtgttaatgtcttattaccctttttttcttacaggatgcaggggctgggcttcttgctgctgccatgattgctgtagttcctggatatatctcccgatctgtggctggctcctatgataatgaaggtaagacttttaaaatgctgaagaagatcatctcacctcattatccaacagagcttcacaaagtgcagtctatggtttagcaataataaaaatggtaactgggtgagaatattagaaatgggcaggaacggatcttggacaagctcatgttctcttcccatcatcctttccagaaaggtagttggtaacttttcttacaagtctttggttcatctctgcactcataaaatagttaactattgttttaacattataatcatttgctttattttcctacataaagggagtggatgtccttaaaattttaatgactgattgacttattctcaattcaacatacatttgttgaatgttattgggaaaacatagtattaagtgttaggtaatgactaagattactttgtgcataattataagaaattaaagagataggtaatgaataaggttatattggcccatcatctattaaggaagattaaaatggacatgtaaatataactccagtgacaggagatagtactatgt

SEQ ID NO: 67923 - DNA, 2004 bp, Homo sapiens
ttttttaagaaaaaaaaaaagcagactggagaatcaaggaaggctttttagaagtggttgagggtcaactgggtcctgaagttgggacttcattaggcagatatcaaggaaaggggcaattggggcatgagtattatatgttaagacatagaggcaggatgatgaatgatagtataagatgtctttagaactatactagcaggatgtttagtgcttggaaagaatgataataatggccaatatttacttaatgtttattatatgctaggtactcttctaagtgctttacaggcattaattatatttgttttcagaacacttttatgaagtagatactattacttcttcttacatgaaactgaaacaaaaggaagtaaataatttgcctaaaattacactattacttggtagtagatccaggcagtctgttccagaacagtattcttaatgactatactagcctggcctcttgttgaatttttggtgtgtcctttctgcagggattgccatcttttgcatgctactcacctactacatgtggatcaaggcagtaaagactggttccatctgttgggcagctaagtgtgcccttgcttatttctacatggtaactttttctacatgttttcaatttttaaagttctctaaatactgtatttcctatgggtacttattgtttgaccaactttcttttctggtaggttcccctaaatttttttcttttccagtatattttttctgttcatacttacgtatacatgtagacttccttaattgcttccacttgctcacatatccctaaatcctctgtgtgaccttacagtagattgcatttagattaattctgaggcttgagtccctctcgttatgtgatcatgacatcagcaaccacaagggagcaggggattgagttacagtgatgggtttgaacttgattttatattttcttttttaaaatttattttattttgtgtgacctgtacatgtaaggacttgattttcctgtttaaaaaaaaaaatcagttatttgaactctttaagccatttggcataaataaagttatagttactataagtgttctttaaagagtcacaggtgatatcctacaatatagtggtggtggtctgaggaggcatactcagaggaactgtttttttctattccatcataggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccaggtgagcccttgactgagtagggttttcagcttctactttttctatgcagccccaactagactgatttatcttagattctgttaagaagagtacgacttattcacagcctttatattgaactacttgtgttagttgaagcaacagaattactggtcattaaagtttgcatccaggagtctgctaatatttgctccgtggagtttgaattccatggctcttactttggctttaagtttgtgggaaggggagggatatttagttgagttgagtttagatgagtgatcagagttaaaatttccagtcttcttaatgcagatgaccccatgtagtagcagagattcctgatcttaatggcatctaattgtaagtgcttcaggaagtaaagcacaaacctttaaccacattgctccacagggttaacagacaactgttaaatcaaagaataatgtggtatgtttgatttctcttgtgaaattatcatgaaaatgcaaaccttatctagaggtcaacaagtatttctttactgattacctactgcagattgtccccaacttatgaagcgtgacttaggattttttggctttagaatggtgtgaaagtgatctgcattgagtagaaaccgtacttccagtacccatacaagcattctgtttttcacttacagtac

SEQ ID NO: 67924 - DNA, 1544 bp, Homo sapiens
ttgcccaactgtaggctaatgttaaatgttctgagcatgtttaaggtagtctacgctaagctgtgatgttccataggctaggcgtattaaatgcattttctacttaagatattttcaacttaaaatgggtttatggggatataacccaatcataagttgaaaagcatttgtatatgcagtttgctaatcacttgaaaatgtaaaaagaataaaaatgcggtcatagtccttaaggaagttttggtcttcttacagggaaagaaatacaggcagctgtctatatccgataggctacagttctggaagtgtggttcttgaatcatcatcactagcagcagcagctagaaacttgttagaaataaatgcaaattctagagccccaacacagacctactgaatcagaaactctggaggtggggctcagcgatctgtgcttcgacactcctacctccttggtgactacgatgcccactagcatttgagaaccaccgatctaaggcaaagaatgattaagtgctagaagagaactaatgtgatatggaacatagagaggagtgattgatttcagtttggcagattgggaagagatgatatttgagttggaccttgaatgatgagaattttagtggatgggaatttggggaaaattacagtctaggctaaggaaataacctgagcaaaagccagagatgtgataatgatagtgtatcttatgctttagggggctgcaaatattctgtagaaaatatggctggtgaattaaacccttccctagattggccctgattccttcggggcctcagaactcatttgaccatttggtttgaactagataagaataatgcaggcctgcactggacttactcattttttttccttagtattaacatacatatccttttacctacagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggtagggaaggctcacagcttttttccttttttctttttttttaagatggagtttcgctcttgttgcccaggccggagtgcagtggtgcgatctcggctcactgcaacctccacctcccaggttcaagcgattctcctgcctcagcctcctgagtagctgggattacaggcgcctgccaccgcgcccgccaccacgcccagccaattttgtatttttagtagagacggggtttctccatgtttgtcaggctggtctcaaactcccgacctcaggtgatccgcccgcctcggcctcccaaattgctgggattacaggcgtgagccactgcacccggtcaggcttagagcttttactattaaatgcagatgggtacagacatagaataaactccaaaagacagggtattttctgaacacaaaagattatttttttcttatttcttttttcatcgga

SEQ ID NO: 67925 - DNA, 1100 bp, Homo sapiens
atcatagctgtttagttggttggaaagccaaattttccttctttttctctactttgctttctcagagatgaatttgattttgctcaagtctatctattgactaattcagagcaggacttgaggatatagttgatttaatctctacagttggccttggtttgaccaaatttggcctaaaaccctttcaggtagcatttctgcctctgttcttctctccaagtttatatacagcctggctttattctgctggcagtgctgacaaaagtactctcaggtttgaaagaaaggaaggagtgaaactctctaagtattggtggcaattaagcaaaaacctaatccttctctgtcactgagaatcttattaaaatgggaagttgtgattcatttggatcagatgtttgtttgaagagtgtgtgtggaatatttattgcctctttgctgctaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccaggtatgtggcctcgtgttctgaaatggccttgttcataagaatcacaatttgattccaaatttgcaagctaccctcattcgtgttttgtttttctttgcctgtttatgttgtgtaatacagaggacggctaagcaaattttctcatgtatgaagctgagcagaagtcagaagttcaacagttgtagatattggcaagttcagcctcacagttttctgttcatttgtcatttgtgttataagttaaaatttaacggtaatttttactccggttttgttttgttttgtttgagtacttctgtcgtactccttcccctttacccttgtttttcctcttggaagtattgaagtcccataatgagtactgctgattgtaaagcctcatcaatctcttatcttctggccaatccagatgtgttttagaatttaccggtgttagtggtctttttctcttaaaaaataacttttacctttttttttttttttttttttttgagataga

SEQ ID NO: 67926 - DNA, 1078 bp, Homo sapiens
aggagttctcactacccatctctagccactgttaacattttgatgtatatttatcaaataagaatgagatcatagttttttccctgatttttttcacttcataaagaatcaaatttctctgttacttagtattattttatagaaatacttaaaatgtatcatttattagttttttaaagtacagagatgtgtcaagatgtgtaagaaggcaagtagtacataatctcatgcagcaatattttaatatattccattttataaatatagtataattagctccttgtttttggacatttgggttgtttctgatttttttgctactttaaagtgtgctgtagtaaacatctttgcatgtttctatgattgtttttttaggataaattcctggaagtggaattgctgggttaaatgtgtggaatcatccagtcatataatgaagatactttaccttgtaggtttcaacctacaggactcagctgcttatttctccttccctcttttgtagttggcctctattactgctttagcaacctgtctgatgcccggatttttatcatcatgtatggtgtgaccagcatgtacttttcagctgtaatggtgaggatgccctcagtctggtagactttttcactctaactctgaggtgcttttttatctgtctggcagaattcagaaagtactgatgattgtgcacatgcttccctctgagcatttgagggaatgagttgtaagttgttgatcctttccaggaacgtatgggacactcatacattctggttgtggggtccaactttcttggattcgtaactttgtattatagaagcatttttgcactttgttggataatatgaccctgggtgtcttaaaacgggagatgatatttttttcttgaaggcttgggagtattacccagtgctagattgttagaggagggatttgaatttttttttttttttttttttttttttttttgagacagagtttcactcttgttgcccaggctggagagcagtggcgtggtcccggctcaccacaactgccgcctgctgggttcaagcgattctcctgcctcagcctc

SEQ ID NO: 67927 - DNA, 1050 bp, Homo sapiens
acactgattagactgatcatgcttcctgtctctgttaggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtgagaagcaatgttaagagtagacttgggaaactctgtgtgtgtgtgtgtatgtgtgtatgtgggcagcggggggtgggaggagtaaagtagagcactgtcctaggtggtcagaattaactcatatagcctctgacttattttgatcaatctcatctatatgaatgtgtctaagaagttgtcctgtgttgtgtgaatttagtttggttaactacacaattaattctttttccttgtttaggtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggtgaagatttgggaggggtgggaattgtgggttaggggcaaaggggaagacatttgatgttacagtgaatcatacagcttttagatgggtggaaagctgggtgaaactggaactttgcaactctagtcttgaatgagccttaaaggtgaacctccattcaattctgggatcttttgtagttactcttactagtaattatctagactttgcatgcacacttttattgatatgatgattttaacatgaggtagaacatcccagttataaaagaagaaaaaagttatagataaataatacatgttcactttagaaaaatcagaaaattgaatcaagaagaaagatataaatcttgtgtaaagtgatcaccttatgataactgcttttaacattttaatttatatcttttgagaatctgaagtgatttcc

SEQ ID NO: 67928 - DNA, 1289 bp, Homo sapiens
ggaatatcatttctgagacaatttgttaggaataaaaacttttaagagtctcttaattcttgtccatcgtatcatgtgatttgagtttccaccccatctttatagtaagtgatttttgcaattctgttaaaaggttatttaagaaaattgtctaatgacactaggctattgatgtggctacattgcacagtctcccacacctcccaccccattatgttagtataaagtgacctgggatgaagtgttgggaatgttggtttgttatttgtgctgagattttataattgtatataaatggaagaccaggtgccaggatttattttctggtttgacatgcattactttgtgaagaaattgattagttagccaggtgtcacttctgtcagaccaaagatgccttctctgttgcatttgatttttagagacagtgagaagcttgttatttccatttcccattctactttcaggatgcgaaggtcatgtcctggtgggattatggctatcagattacagctatggcaaaccgaacaattttagtggacaataacacatggaataatacccatatttctcgagtagggcaggtaagataaagggatgatctttgagtgtttggtgtacaaggtctaatgggaaatgtgtctgcatgaggggatcatatgacttgggattttgctctgagaattgtacatttgtttttccaggcaatggcgtccacagaggaaaaagcctatgagatcatgagggagctcgatgtcagctatgtgctggtcatttttggaggcctcactgggtattcctctgatggtaatatacttgattctgtttctagctgcaggacatagattctaagaaaactagatgaatatcctagttttctgtacttttactaatattttactaagatatttttctttcatgggaagttcctaagtatttgcaacttgaggtttgggtattttgatttttttctttttgtaacaagaggacataaatgtaaacaattcttgtgtaggtacagcatgctatatgattgtctaaggcatagaagtagttccacaaccagtaataaaaccaagctgaatataaggctcatgacaatgaacttaagaattagcatttttttagtggttttaagccatataatcattgaccagcttagaaatgttttatatggcctgacagcgtgtaaaaaaagagaacattttatatatatataaaatatatataaataaaagtgtgtgtaaaatggaggttaccatgtgccctatgattattggcacaaagat

SEQ ID NO: 67929 - DNA, 1132 bp, Homo sapiens
aaagtaattttaataattttaactgaatagtcatatcaaaacattattatttaatttaacatgtaaccagtatacccccttttggggtttgttttttttactaacttttcaaaatctaatgtgtatttcatacttacctagtgtgtattttatacttacagtacatcttaatttggactagccacatttcagctgctcagcagctatatgtagctaattgctgctatatttgatagcctagccctagctaatctataggaccaatctcagttgtggcttaagtctggactagtagcgtaggatttcaggagtataataatttctcagaaaagttgtatattttgacgaaaaatgctttgcccgtatgttgtcctcactatttttacaaattagagttaaatgataccaatccccattaaaaaaatgttgaggaattttcttagaaatactaacctgctttaactccagcaacttttgtgatgcagcagttctttttttttttttctcctagatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccagtgagtgactcataataatattaataacagtagtaataatagtgattactaatacacagtattttccatatgccaagcactagtaagtgctttgtgtctgttaactcatttaatcctcacagcaaccccaaaggcatatactgatattattgtcatattacctttatttttgttgtttgcatatttttttgagacagggtttttgctctgacacccaggctggagtgcagtggtacaatcatggctcactgcagccttgatttcctgggctgaaggagtcctcctgcttcagcctcttgagtagctgggactaaggtgcacaccacaatgcctggctgtttttaaaactttttgtagagatgaggtctcactatgttgtctgggctggtctggaactcctgagctcaagcaatcttcttgtcatggcctcct

SEQ ID NO: 67930 - DNA, 2748 bp, Homo sapiens
ttaggttaagtctctccttctgacttcaatttcttgattctgtactagggagaatttctgacatgaatgcaggtctttgacttctggtaggcttttttctctgatccatgcaagggttgctagtgtattagaggctctaaatgacaatcctcaggaatagagggccttggaagtcggctccctatgtctgtcttatcagagataagacattgactggcaagcatcatcttgcatagaacttaagctagggtaacacttgatttgcccttactacctcatgcccttttttgcaggctctactctcaacaaattgcaggctgaggaataatcatcaattagtagatggtttcctgaatccatatactgtctctctaggaaattagcactgtagaaagaagtgtgttctttttcatccctctctagagcgtcctccaggctttgaccgtgtccgaaatgctgagattgggaataaagactttgagcttgatgtcctggaggaagcatataccacagaacattggctggtcaggatatacaaggtaagcagatgctatacgtctcagaaagcaacttttatttttggagattggtttcaatgcttataaaatgggacatatatttctcaaatagggaaatttctcatgacacctgtgcttgaaaagtagcttgcaaactcactgaaaattttacttattttagattgttcttagagagtagatgatcccagtctgccatcattttggcggttgttgcagtgatacttttccagctggggcttgactaaaccagtttctgtgattatcaggctcacgggtggggagagtgcaggaaatagagaaaaagttcacatgtttatatttagctacattttcttctctctctgaagaacttaaggtatatagagtcatatagaaccacataggagtatatctctcatataagaaaagattgagaacccttgatctatgtggagggtagatcagtaatattggtcctcacagaggtattccaaaaggctaagcagagagaatctagtctctagtcagtgcttgtgtattcacagccctaaaccaggctgcagaacccaacataatcctgcccactctgggtgaatccattttagtagaaaatttctccaaagttgatctgattgtaaatattaaactgacatctttatgttgcaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaaacagtgaaattattggtttatcaatggagaggaagaaactcttccagcattacatatagagcttgatggtcagtaggtgtttttgaatcagcttaaatataatcatacatatcaatttgaaatggagcttttcagtactctcacttattcatgacacaggaatgaccctttactcaaaactcttgtggttgttcaaaggtgagcttctttttcccttagtcttagcctatgtgttgctgttgtatattgttaccaagttcaactacctaattttgaagctctttccaaataagatacaaattaaaaggggaagcattgccagtaacaggtccctagagagcagtgccagcctgcctgcaagaaaagaggagaaacttcttaaaaagttttaagcctgggcaacataaggagattgtttctatgaaaaataaaaattagccaggtatggtggtgtacacctgtagtcccagctactcgggaagatgagattggaggatcacttgggcctgggaggttgaggctacagtgaactgtgattgtgccactgtactccagtctgggcgacagtgaaatcttgtctaaacaaaaacaatttaactgggaagcacagtggtccttgaggacatttaatatcaggacaaagagcctatgaatatatcactgatgtatataaaccctaaggcgttaataaaagctaactgtttagtgttatccatttaagggaacaggaggaattgcataacttttagattagtcatagtggtgctcctaagggatatgctgttgtatatttgtatagccagggcacttagccttccaaaccaatttatataccatgttcttcaactgtgggtgagatttagcctcaagatttgatttactat

SEQ ID NO: 67931 - DNA, 2896 bp, Homo sapiens
tggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaac

SEQ ID NO: 67932 - DNA, 1544 bp, Homo sapiens
cctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtct

SEQ ID NO: 67933 - DNA, 1095 bp, Homo sapiens
tttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccact

SEQ ID NO: 67934 - DNA, 1019 bp, Homo sapiens
tgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtc

SEQ ID NO: 67935 - DNA, 1032 bp, Homo sapiens
accatttcagggctgtaccctccggctccctcgcacctttgggttcctcaagctcactgtgccttccaaacaccagaggacactatcaatttctccctgaagcaactttcatgaggcttctctctttcagaggagttgggagcaggctgcgcagtacactgataatgctcttcgaataattgtctctttgatctttaacctgagtatttccaatttcaacattctaaaaatgcattatttaaaaataggtaatacattgatgtgactaaatagtaagtaatagaaaaagaatgttgtgtaaagttgatctcccactcttgccagctagttatccagttttcatctgccaaataaaggaaaccagttttattcatttcttttatatcttttagattgattttcagtatattcaagcaaatataaatatgcacatgtatctttttacccccttttcataattggtagtatactatgcatactctgcactttgattttttgaataatgtatactaagtgtatagtattccactgtagtgctgtaccatgctttaattaaccagtctcttatgagaatttaagttatttgcactttttgatattatctgctgcaataaataatgctgaacatatttcatttgtgtgggagtatatctataagataatttcatgcaagcagaattgctggataaaaagtaaacacttttgtaattttgataggtattgctgaattgcccaccagaggagatgtaactattctgttgctatcaatgcttggaaaattcttgtctcaccacaactttaatactcaaatattttatcaaactcctggatgttgacaatctgataggtcaaaaatggtgtatcagtgttcttttaatttgcatttttcttagtatgagtgagattgagcactttttatatgtttaatagccattttcattttcttttgtgtgaactatctacatactttgcccatttttctattaggttgttggccttttcctttttgatttttttaaaggaggcattaca

SEQ ID NO: 67936 - DNA, 2084 bp, Homo sapiens
aactatgttcttgtcactctcaagccgtattaaagaattgagctgcctgaatgcatatgttgtcatctctaaccctttatacaaactggatcttctgacttagacacatttaaagtggttctttatcctcattttaactggctcccacttgttctgcaagatctagcttcaatatctcctctataagaacttgcctatagtcactagcccaaggcttggcaaacaccatggcccatgaactaagagtgctttttagatttgtaaaggattgtaaaaacatgtatgcaatagaggccatttgttgttgacacagcctaaaacatttactcattaatccttcacagaaaacatttaccaacctctgcactagatttatatgctttgtaagataaggtactgtgctttattccaggtaggtaactttgtgcctggcattaaaccaatttatccaatctttaattaaatgaatttaatattcttaaattctgtcttagaaaataagacactcagatgcagcactttatgaaaattcagatgagtagtgaatatcttatctgctttggagagaaaaacacaacaaatcagatacttgcaggattaggctttaatgaatttgaatacaaggcacaggtttccaggtgtatgtaaatacatctccattttacgttctttaatcgcttaatccttttggaccgggataagagaatatttgaaatttcttattaaagcaataacttccttaatagggctttagtctttttgcttttttttttcttttaagagctgatcatctgaattcctagtacttgcaagtaaatttttttttttttccttttctgtccacctaccattaggtggttcctagatcctggcaaattgtctatggttaaatgatgcttttaatttctgtgtcaacacagaccctcttcgttggtgtctccaaattagtattctcttcctctagtgtgtcattacagtcccttttggcttttgtttcttcctcatggaataaatgtgggtgctcaattcgtcccctacgtacaaaatgctggatccgggattccagtccttggcatttaggacggtccatgaggggcttatatgtgcgcatcttcactccttctacaaaggcactggtctgctttatgacagagggcttaacatttccccattctgtcattccatccatctttggtcctattccacagggtactggaacagtgtccagtccttgtagcatactatacaacatgtgagttttgacagcatgattagcccacagttgttgtaggtgggtaatattgaactcctgagcctcctggtcatagatccacttgacattttcaaacttacagtcatataagactagaggaaattctacagccatactagagaaaaagagaaaagaaagtttgagaatacataacatccatctaacagttctttaaaaactaagggttagttgcgttaagggagccgggtagggcgccaccattgatgttaatattgcctaatagctgagaaaatatctcaccatccctaaccttgaacacctttattacaataatgaaaaatgcaacaaatcatagatcaacctgatctatgtaaggtaaatgtcagtgctaacaagacatggctccatcatactgctataaaattaaaaacagctggtattttttccaaatttgttaatggcattgcaattttgtatagtatgagtaaaattattggtatctatctcagcctgttctcaaatgaaaaatcttgactattctttctttcctaccattttggaaataggaaattaggaaaaattcagaagtacagtaggatgactactcagtgatataaaacaagcaagatttaatatgaatagtttgttcattttaattttaccacatcctaacagtaatacctcttaacataaattcagaaacaccaatgatgtagaaattaatgtctttttacttaaggagcctggtcaaaacacctgcctctttactcatgggatagaacaatgagaggaaattaaaatacactgctccctcttacatgttcataacattctacaattcagagtaaag

SEQ ID NO: 67937 - DNA, 1078 bp, Homo sapiens
ggaggcggaggttgcactgagctgagattggaccactgcattccagcatgggtgacagagggagactgtcttaaaaaaaaaaaaaaagaaatagcatatcctcctctccaccgtaactgtctaaataacgaagtcactgattctgccttcatgaagctttactctgaattgtagaatgttatgaacatgtaagagggagcagtgtattttaatttcctctcattgttctatcccatgagtaaagaggcaggtgttttgaccaggctccttaagtaaaaagacattaatttctacatcattggtgtttctgaatttatgttaagaggtattactgttaggatgtggtaaaattaaaatgaacaaactattcatattaaatcttgcttgttttatatcactgagtagtcatcctactgtacttctgaatttttcctaatttcctatttccaaaatggtaggaaagaaagaatagtcaagatttttcatttgagaacaggctgagatagataccaataattttactcatactatacaaaattgcaatgccattaacaaatttggaaaaaataccagctgtttttaattttatagcagtatgatggagccatgtcttgttagcactgacatttaccttacatagatcaggttgatctatgatttgttgcatttttcattattgtaataaaggtgttcaaggttagggatggtgagatattttctcagctattaggcaatattaacatcaatggtggcgccctacccggctcccttaacgcaactaacccttagtttttaaagaactgttagatggatgttatgtattctcaaactttcttttctctttttctctagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaat

SEQ ID NO: 67938 - DNA, 1240 bp, Homo sapiens
tagacagttacggtggagaggaggatatgctatttctttttttttttttttaagacagtctccctctgtcacccatgctggaatgcagtggtccaatctcagctcagtgcaacctccgcctcctggcttcaagcaattcttgtgcctcaagcgtcccgagtagctgggactacaggcatgtgccatttattttttatttttaactcacctatattgaggcttttggggatttttctctatattcagcagctcatcaataatctctggcttctccattccttggccaatcagaaagaggatagccatcatacatcggacttgatgataaaggaatgcctggccagtcacttcaaactgacataactggaaaggttcttgccatctcccctcacctgggctctggcccactagctgtacttgagcagatagaatagtcctctgaaaattaatcacaccgttggctacatccattttacacaagttcctgaaatcatgggtgccaacatacttctgagctgcataatccatggttacaatatctaaatcagcacgagggaaaaaatagcggtaagtccgctcaaggcagctgaacctagcactgaagcttggttctacaggggcccaggccaatatacggatgtctggagggagtacccgattgagaatgtgggtataacggatctcttcagcagcagcattagcctcctcttttacattaaagtcctcggaatccctgccccttggaaactgagagcgaaggtcaagtgagatcacctgtggagttagacaaagatactgggttttagagacacaaataatctcagtactcagtgtgtatacctagaatatcctagtattgcttgctttgagaaacagtgtattggcccttacctgtccaaaggcactaactcctttatctgttctcccacatcggtgatagttggatgtctgtctgctttctactagtcgagtcttggttagagcttcaaacagtttctcttcaatggtattatttgtgttttcctgactagcaaagccctggtatccccagcccatataggctattcttagggctacgtgtcttcggccatgagcactgaaatcaaatgcacgcttagtttttccagctcctgctgaattttctctaatgtttgagtcctccttatttttggcctgttcctttttaagtctttgcacctcttgctccagttctcgtactctttttaggagcttctcagtc

SEQ ID NO: 67939 - DNA, 1091 bp, Homo sapiens
caacactgcttttgtgattttttttttttagatcaaatcactcttttatggttaaaagcagggactcagtctgaagccaaactgcttgagttagaatttcagctccactacttactagctgagtaaccttgggcaagttatttaacttccctgtgcctcatgttattcatctgtgaaaagcagataatcccacagctgaaaattacatgaattaataaatgtaaagcacatagaacaatggcaggcacataaagtactccctaagtacctgttacataatgtgcattaagcagtatgccccatatcatgtagtttcaagcttttcttatgccagaactatactgtcctgttttaggacctgaaggtggcaagacagtagaaagcaggagtaagagtggaaatgaaagcaggtaatagattccctagaactgagttaatgcccctctaaactgttctgatactaccctgtattgaatttatgatggccttagccattctttctccatttgactgctataaaacggagataagggaatgagcaatttatgagctgggaatttattatcagaaaactgaccaatgttatctcttgcagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctacca

SEQ ID NO: 67940 - DNA, 1082 bp, Homo sapiens
ttctaatagtaaatgtttttgtctctcaatggtaactttcttctcatttaactaggtataaaatcgagccaagatcttcaatcttttagttttcgtataaggatagcagaatttgaaaaattaccttttttctattattttagcgtagcactacaattcctccttttattgctgtcccgccacaggcccagattctgccctgtgggcggagaaacggtagctggactagaaaacctcaggtagattctagcaccaagctcggttctcagaactacatttcccacaaacttggactacacctcccatgagggctcgggcgcctgcgcagaagacgcacagtgacagcttcctttctcggaaacgcggcgcggccggctgccggaaagtaagtgtgggatttttggagtgggttactttctgggttccacaggggaagggacaaatggacacactgctgaacggttgtctgttgtcttctttttgccctctttcacatactttggtcttttcaggaaagcattgccgtatggaaatgagacctcgcttaagaccatgtatttttcttttgtgcctggtactttctggagctctcggtggaaactcgccgcagtagggtcgtctttaattccgttgtgacgggagcttcagtggtacttgtactgtggagtacaaaagtgctctgctgccccacttagaattgggtgctcataaaacagtagaagttgagaacccaggagtatgtgggaggctgtggcagcaattttcaaattattttggggattgccttacatacagaccacgattgctttctagtgatcatagtgcgtgtctgctaatcctttggacagtactccctcttcttccctttggattaatataaagtttatcaagaggaatgctatttatgtgttaacccactggttcctgagattaggacttttttttttttttttttaagactgtcgcccaggctgagtgaagtggcgtgatcactgctcactgcagcctctacctcctgggctcaagcgatccttccacctcagcctccaactagctgggactgcaggcgtgcgccatcttgg

SEQ ID NO: 67941 - DNA, 1028 bp, Homo sapiens
tcctgatacctttttcagaatgtcacccttgtaaataggcacctaaagccaagttggtcagcagagctcctgaccacggctgcctctgcgtgacaaggacatttgcagctgcctttggaaggctcttcacattaaaaaacaataattatgtaagtgtgtttcatagcttgagtcaagctttcaaggatcactgctcctttgtgcattgtgcatccctttggggaaagaaacagaaaattattctctttctatagagtcaagcaattccagcagaagtgaagaaatgttagtttcccagaaatcgcagtggaatagaatacaatactgtgttaaccaactttctgtataaatgcatcagtattcccttacatatgtctatatattttataatagaactgttagtgaaaatgtgcttgtttaagctgggtcactatgcaagagttacttccagtagaatgtagtgaatgtaattccctagtcggatattagggatgctgtagacccaagttctacattccagatgtccgtgcctatagtatactggatttattcttcatgttgcttaaatgcagttagctctggagggggatagctgcatcccttacttctgtgactagcaaaggacaaagtcccagcgcacagaatatgaaaacataccctgtgttagccaatcaagttacagcaatgctgtcacaaagggagttttagaaaactggggagtcattgtccgtagacagccattttgatttaggaaacaggtgtattagcatgagccttaggtcatgaactgcttttaaagattgagtttgaatatgggatctgtccacgaggaagagaaaatggctttacctttaggacaatctcattgtggactgctttatttatattattagtaacgctgttttaagtgttattctttttattgtattttatttataaaaaatgcctttatatattgaaatatataaatatatatatataaacacacacacacacacacacacacacatatatatatatatatataa

SEQ ID NO: 67942 - DNA, 1033 bp, Homo sapiens
caggttcatgtctgtcttcatgcttaagatttggtatttccagtaacttgaacgagtgtaactgctagcaacagttgattagacttttactgatttttctttgccccagaaacatatcagcccatgtttaaaggatgcaaatccaaataattcttatcttcattgcctaacgttatctagctccaggatactactggtcagtcctatgtgtttcctacctaacatgtccaaatcaaagcccagtgcaatgtcatctccagacttttcttactcccaattataggggggaaaaaaagtgtcactaaggctccaacttccagtaatggtagaatagcttgatcatcaacagataataatgataaaatctggataatttgaaagtattggagaataagcagaagcaggcagaaactgaataagagtctacccttgaaataaaatgtgtgagatttatgagtttatgggtttctgtctgaaagcattctccaatcttggggcaaggatacaagcagaagctatcagagaactgagtgtgatgctaacagagcagccagaaaattaaaaggaaaatctagtttaaaaaaaattattatatatgtgaagaaacaggaaaatgtgataattacttaagggaaaaaaagtcaatagaaacagactctgagatggacccagatgtcacaattagcagataatgactttaagcagccattataaatatgttcaaggatttaaaggaaggtatacacataataaatgaacatatagggaatttcagccgataaacagagccggtacaaaagaccaaatggaaattccagagctaaagagctcagtaactaaaatggaaaatttactagatgagcttaacagctgttggagaccacaagttaatggacaagaagatagatcagtagaaattgtccagtctgaagaacagaaagaaaaaaattaaagaaaacacacattgtacgtaaaggcaggaagtaaaagtagaacagaattgacgtgaaatactcagtggtaataaattcca

SEQ ID NO: 67943 - DNA, 1046 bp, Homo sapiens
acccagctaattttttatgtttttagtagagatggggtttcactgtgttagccaggatggtcttggtctcctgacctcgtgatccgcccgccttggccccccaaagtactgggattacaggcgtgagccaccggagaacgttaattatcatagcagttctttcaggcctaaggtttgatctacccagttggtttgctaagtattaaaacaacaagttgtccagttcacctgagctttttcttccagcagaaaacaggcattcagcttctcttccatctatggtaatctccctatttccctaagaaattcagagtgctgtgttgaattttaaaaattgatcagtgctttccttttggggaagttatatatctccccaagtctgtctcgtacttctaagatggagacctagcgcctgttgtcagggagtccagctttttgtctttctttataagctcgtgtgtgtctgtcaacttgccatgttcaggaatacactcagtcatttgttgtcactcaacatttactgtcatgttttatgtgacagctgctgatagattaattcccaaaaggaaactcccactctaatgctgcggtcatcgcagcatccaacagagcagatatcgagaagggaagacggccatggccctggagcggtgccatcagggttctttaggtagtaactgataagctcccgaaaataagagctgggtcagcaaaatgacacagtgactagtggaaacagcagaggtgagtggaattttaacataaactactggccgggtgcggtggctcacgtctgtaatcccagcactttgggagactgaagcaggcagatcacgaggtcagaagttcgagaccagcctgaccaacatggtgaaaccccatctctactaaaaaaacaaaaatcagccaggcgtggtggcgcgcgcctgtaatctcagctactctggagcctgaggcaggagaattgcttgaatccgggaggcagaggttgcggtgagtcgagatcgcgccactgcactccagcctggcgacagagcaagactctg

SEQ ID NO: 67944 - DNA, 1038 bp, Homo sapiens
atggcagtgaagtttttggaatacagttaaatctaatgcagaactctcattcactcctttgtgaatatgggtcagtgatattcacaatgacgttgctctgggagttggttagaatatactgtgtgcccatttatggttgacatggctcatgtgtatttgtgattatttggctactggtctgtgagtaccttcagcattccttcttcttttctttttctctgacactccttcctgtccagggtggtggaatgtacacggccgtgcctcagattgaccctctggagtgtgttaactgccgaaattgtcgaaacaacaataggtatgttaataatgtgtctgcacaagctgttgtgaataaggcatatgcatccttttatttttcccttcagcaaagaaagttcttggaattttacctaggatataaagttcaggatttgcaatcttaaatttaaagctgttactaattttttgcctctgctttccaatttttgtctttttgtgcctcggtttcttcagctatatagaaaccatcttaaaggctctatttgtcactgaaatattattataaggcttaatgtttttgaaaattttaaattagagtcattctctgttataaagactttatcttttctcaccttttattttctactctatgttatgggatgttatgaggatgaatgacagtgtttctgagtgttggggggaggggggaaccctctgtatatagtaatttttttcacagtaatgttactgaaattttcctaccagattatccagtgtttttttttaattcttaaaatcttaagaaaattaagcagcaaacccttgctttgaattttgtgttttaattttaaaagtggtatgtactcacaatatttcaaacaagatagaaatatggagagcaatgtgcatttaacacataggatactcggcacactttcctacgacctctctctatggtaatcccaaggattaccaagctttttgttgtattaaagttgtttcagaaatcttagttctttcttttacataatgatg

SEQ ID NO: 67945 - DNA, 1127 bp, Homo sapiens
ccatgatggaaagcaggtagtgaaaacttgtctaagtcactgtcactgaatgacacttcaccgatgaggataacgcagccctgtttctgtacctgatggactcaagactgctccagcatggcgtcctctccctggagtgtgtctaggaatacgtgtgcttgaacatcgatgatggccctgctttgaaataacagtgaagtaacctagaaccccctttctcttttctcttccttcagttctcttcacctcactgtcctacttttcctgttatctcagctattataaaatagggtaatcaaatcaagcagagagtttagtctttggtgggaggaagttttttggtttcccctttggctccagaataaggaaatgaaagaaaagtgagggaggaccccagcaggcacttccagtggctgttagccagttctcacgcatgctccccttttagttaccagttctgggggaagaaagtactctgtttgtattgaatgatgccttccaagagatagggggagagatggtggctgcatcaggctgaaatggatggtgatcatttgattttctaagtggttttaatgccatcgcctttaattgtgtgagtgcgtgttgaatcatgaaaagagaagtattaatctgaaagggatggtgatcatttgattttctaaatggttttaatgccattgcctttaattgtgtgagtgcgtgttgaatcattaaaagagaacattaatctggtcgtcccagccatattaatcagattaaagtcatcctactttgtgacctgataatgtttaaaaatggaaaattctcatggtggtgttcattcagtcatttattcaaaagataatcatcgtcttctgtataccaggcactgttctggacagtggagatgtaatggtaaataaaataaacaccacctctgccctctcaaagtgtgtagcttagtgagaccacaagcaggtgtactgagactacacacctgggcgagagcacacagtaatgtgggcagctaaggaaaggagggacacctaatccagccttggcaagctctcctaccttcgaagaatttatccagactccaacaacaaatcctgtacagtttggacactctagtttctaagagatac

SEQ ID NO: 67946 - DNA, 1228 bp, Homo sapiens
aaggagtttttgttccatccataagtagaaatacttttttttttttttttttgagacagaatctcactctgtcttccaggttgaagtgcagtggcgtgatctgggctcactgcaacctccttctcccggcttcaagcaattctcctgcctcagcctccccagtagctgggattacaggcacccaccgccacgcccagctaatttttgtatttttagtagacacggggtttccctgtgttgctcaggccgttcgcaaactcctgagctcagacagtctgctcacctcggcctcccaaagtgctgggattacaggcgtgagccaccacgcccggcctaagtggaaacacttttatttcaactctgggagttttctccaagtacagttaagcagataatcatatagcagtttggattagaccaagtgcatatgttcctttgcctttaggatttctctaaagtttgtggactaaaactttggcacatcaagtttttaaactttggagccctctttgtgactcattggtggtcaggtcatctcagtaacaagagtaaacagactggcttgcattcctaaccagacctccttcagagagtaaaccatttcatggagtctgtattcactctgacatcatgttttcctttatatttcaactagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaagtaagtcactcataaatatctccttctctttttctaaaggtgggtagacaaatattgtcagaataaatattgatttctaacactgttgtatattagtgtcatggtatgaaacacattagatactcttcattcagaggagatgactttaaaactgttctagctgtcagccagagtaagtggagcatcaaattaaattgcccagcagacataaacaccaaagccaaaactaagcaggtctctaagtaaatagctgacttattgctgggaaactccggctttgttggaccaccaaagaggacgcatatttgaagcctgagctctggaattgctgtaggaacacctttacactgg

SEQ ID NO: 67947 - DNA, 1056 bp, Homo sapiens
tgtctttcctgttcgtcatgttcccattgccaccttggctctaagactagcactgctgatagctcgccacagttctgggcatcacctttaaagtgttatcatatctgaccgtgtctattttcaggaacaaggaaaatttcccccaacgtcctctactagatcttcccaccagtctcattagccacaattcagccccacacagcccctaaaccattgaccagatttatcccagagttctgtggggttgaggtagacacccaaacaaaattggagctctcgtaacatgataaagaaggctgttgagtgagctgggcagccatcagggtctctacaggtgatcttattattcctttttaaaaatgaggacatgaaaaagtacgtttttaaaaaatgaggaaatggaggctccaaaagattgaatgataagccaaggcttagttccagcttttaaactctaaaccatgtgtgtttctgctgcaatactcacatcttaagcccatatttaaacatatatccatatacctttagacttaccttgaatttcatttgtttagcatatatttgagtgcctttttggaccagacgctgtgatgtgttcatgggatacttggagtaaagttaaataaaaatgaaatttatcatctctgtccccaggacatttaagaatctagccagacaaaacataaaacattataactgttatttataatagtataatagtatagctgtgattacaatagtatacctcattttctgacatcagtagggaatgaaaaggttctacctacagactttcaggtcagtggaaaacaaaaaacatctttgaaatgttaactattcatattgaatgacttttacgtaattacatattacataattcccagcctgtttacatggaagatctcatgtgtacttcaacctttaaaaaatgactgtaggttcttgtgaacaatgacggttttatcttgagtaattgaggaaggttttcagggatgacagaggcgctgaagcctggccgttttcccttcccaccgaagatcagagactgctgtgatg

SEQ ID NO: 67948 - DNA, 1125 bp, Homo sapiens
agagattaagggaatggagtccacactgaatgagaaggagaaagatgatggattgggtgtgggcaccagaagaccatttaccaagataagtagtaagagtttttaggtgaagattatggattcagttttggaaatgatgagtttggagttgtccaagaagaaataaccacaagaaaagatttatttaatattcaaaacaacctaatgaggaacagatttccacatctgttttacagattaggaaactgacacatgaggaggttaaccatgcacgatgcctcagatcgtccagaaagtggagaaacggcttgctacccaagtccgcttctaactccagtgccgtctttcttttctaccttgttaacagtcacatgctatttcttttagatatggaaggtattattttccgtgcagacattttccccaataactttctttttcctatttgaactgtggtgtttggtgagttttgatttcagacgaatcaacataaggaagttgtttggtttttctagtattaaaaaagattcactaaccatactattcattctgttttcattgctttctaacttgaaaggaatacagtaagtatcactcagcattgcctgctttgaatacattcctcttttatcccttaagcaatttattttttttaaatgctacagttttctccatacaaataccacattcaactttattttcttctttcgtatgtatttgtatggtgggttgaagacatgttgaggtggaagggtgttgctcaattgaggagcatggcatgggctagagatggggctccctagtggctttctcaaagtaactagcgtcaccatggcccagagttggccctccacattccagctctagaaacttgattgtcagcatgccaaaagatcactggtctctcaaaaaccggctcatgtctatccagttcacagatgatcaaggcaaagcagaatggcaattacaaatttgcaatgtcactgtcatacagaccggattatttctgtcagcattctttccttgtaggaaccaagtgggaagccagttacaaccacaagattgcttgttgtgttagcctgtttgtgttgctataaaggaatacgtgaggctgggtaatttata

SEQ ID NO: 67949 - DNA, 1661 bp, Homo sapiens
acaaatgctcattaaataagctacttctaagctctgtgtgctagggacgaactgtggatacaagaaggcatgagtggagaggactaaaacaaatggttacaatatacaaataattacggccccataccctgaggcctcactccctcagttccttcagacccccatcagatttcacttccttggaaaagatagccctcatggtcctatctaaaataatatgcctggtgctctctggcccctttatttcgttttgcttttctttatagaattgatcacacctgatactgtgttattcatatttctgttagtttattattgtttgtcttttcctctgacctccccacatacccctactggaatgccggctgcatgcatgcagggtttttgtctgctcttttccttgccgtagcacttgtgcctggccattgttggcagaaagtagccccttaatatgtatttgtggaaaaaaaatgaatgactagacagtgcaggaacaccatgtgaccagtgctgtagctagaggtttgccaaagtcaaagcatgtttcttgtgctttgagattcactaccgttaacatgcttctgctgggtttggtttgctatgctagttctgtagacttttttttctattctgccttgactttccctttccttcatttaagaaattttccttgattgcttctttaccgctaatctcatgtctaaatgtaacgcaggctggccggtggctcacgcctataatcccagcactttgggaagttgaggcaggaagatcacttgaagccaggagttcaagactagcctgggcaatatagtgagacccccatctctacaaaaaatttaaaaattaactgggtgtggtggcatgcacctgtagtcccagctacttgggaggcttaggtgggaggaccgcttgagtccaggagttccaggctgtagcgagccatgcttatgccactgtactacagcctgggtgacagaatgagacccccatctctaaaataaaataagatggaatagagcataatgatcagcctttgtgagttttagttgtgctgtggtgtccttcataaagggagaggcctaactgcactcccttccttcctcagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtaagtatttgggagaataatggtaactggaagaggaagagtcctcataaaaagttgggcaatgatagttcatttttttttcaaatcctgtttgtttatcataaaaagtcttaccaaaaaagtaaatacaggctaggtgtggtgggtcacccctgtgatctcagcactttgggaggctgaggcaggtggatcacctgaggtcaggagtttgagaccagcctgaccaacagggtgaaaccctgtctctaataaaaatacaaaaattagctgggtgtggcagcacatgcctgtagtcccagctacttgagaggctgaggcagtagaatcgcttgaacgtgggaggcagaggttgcagtgagctgagattgcgccactgcactccagcctgggtgacagaatgtgactctgt

SEQ ID NO: 67950 - DNA, 1038 bp, Homo sapiens
ctcctgagctcaaggattcacccgccttggcctcccaaagtgctggtattataggcgggggccccagggcccagctgcactttgctatttcttattaataggattgatattgtatctgatttatatcatcagcattcttgtcttttgtaccctaattgttaagtcctaggctaacatgttgctcttttttacttccaacaaataggcttataagaattttgctagaacttttacaagcatcaagaaccataacatatataaaataaaagattgcctttagttataaagatacagatgaaatgtgtttaatgtaatcttctttctctctcctcttttctcccctgctttctttgcatatggggaatattcccttgtagacttggcaccttattttacttctgagccgctctctgctgtccagaaacttggtggacctgtagtactgcattgttctgctcaacctgtgaccactcgtatctcatggctgcataacggaaaaacattggatggaaacctggaacatgttaagattcatcaggggactctgacaattctttctctcaactcctctcttttgggttactaccagtgccttgccaacaatagcatcggtgccattgtgagtggccctgcgacagtatctgtggcaggtgagtttaattttgtccctgttaggtatgggttttcttgaaattactgttagtgcttatatttctgaagaggggaaagaccatgggctttggtgtaaagcatataggagtttttatctcagccttgactcttgctgtgagtatattgtggaagtgcacttagacctctgtgagcctggcctcatgccctcatcagtaacaatgatatggaaatgatttttttaaagttacgcagttaggacagttttttttttttctttataatctctgcagctttgccagggaaggacactttttaaatgtgaattctgaacaatttctttgtgagtgcttggaaatccatgatatcattaacaacaaaagctgttgtctactctgacagttattt

SEQ ID NO: 67951 - DNA, 1042 bp, Homo sapiens
aagtgttatttggaactttagtctttctttttaggtttattttaggttataattgcacagttgtatgtgtttaggaatagattaaaatagctaaattctaagggtgctttttttttgtttttttgcttttttgatctttgacatttctaaaccacaagctctgcattctagatactattgacctaatggaaaacattgaagcgcattttgcctaaggtaaaattgactccctggtatcttatatttttaaactcattcttctaaagttcttctaaagaagtcatttcattttcttttcccctagccactgggatccttgctttttaacgcttttctttagagcaggcagaatacttggatgcttagaaattctttaacggtacatcctggctgaatatgaagtatgaaagccctttccaattatatgtaaagaagttaacgaggaggatgttttagttcgttatttgtgtcttggttatagaatgaatacaaaatctgaattgggatgctctttctcttattttaactgttgttccatggtgcccctgcacccaaaatggggccgattatattgaaacaaaatttgtttttcaatttcttggatgtgttacaacatgaattcaggctttgcagttttaagtgattcctttagtattgcttttgtcagttgttaactatttctgttttgttttatatcactgtgtaatgcaggccaaaacaaatgttttggcatttaatgatagctaattggtgtagattaaaataattattaactgtttaatgggatagtttaaaaatgactttgatgacttctgatgaccatattgagaaggaaggaaagaaaaatagatgttcctcctcctctgttgaaatgaagactgagttgtaatagcagtggagtgcagctcccagtaagaggtgtgaggctgtttattttcactctggagatgtatatactacagaaggaaaactctggccttgcttaacctaagcaagtcattacttatctacgatctgtcaagcaatttgattaaggttgaca

SEQ ID NO: 67952 - DNA, 1034 bp, Homo sapiens
cctccttgaaagtaatatccaaaattatcttaaagaaaacactatctgtgttttacttgttattttagggtgtgtcttcccagataggtagattgttagggaaaagataaggaagtgattacccttataaagtagaaactataacacttggctagattcacgtttccttagctgtacgtgaatacaggacacttaattcattgtgattacaggtgtcagctggccatggaatcagagcagcagccaccacatctcaaatgctacaggcctttaacaaccaagaatgagaaactgatttttgagtttttcatttgtgcaattaaggattttttttccttcatgttgaaatgtgagttttctggaaaaaaaaaaatttacatcgagtaggcgaagtccccatttgcttgtaaaggttctttctcattcactgagaaatactagtgtctttttccgattcacctagagtgaatgtatgctgcatgtgtacttgggcaatttaacagtaactaatatggtgtcagaggagtgaagtattgctttttgcagagccaggtccttgtctgtgtgtgtgccctgcagactataagaatggaggctccaggggattgggaaagaaaagtcctgacccaggctgtgcatggcgtgcacagacaggcttaggaggagccacggcacaccccgtccttggtcccctgctgaggagtttgtatttcggcaattacaaatcttgttttgtggttctttttattctgtatacagcataattttctcctttcctgtttctgataatgatcatttcttaaataacttttatagagccctttgtattttggagtattttacagacttttttttgtttgtgtgtgtgtgtgtgtgtgtgtgtgtgtgtgtgtgtttgctacttacaggaaatgtatgagattgtaaaatctttgttagaatggaaatcatgaagactaaatgatcgagcattgatatcatataaaagttttaatctagttcaaagttaggtgtccttcaaaatacctctttcg

SEQ ID NO: 67953 - DNA, 1030 bp, Homo sapiens
ttgacttaagccttgggggtctttgtctgtaaaatgggtataataacagaaattatgtcttaccattgttgtgggattaaatgagataatgaaagtcaagcacttggcatatagtaaaacctctgtaaatgttagctgctgttatttttattaactcctcctgtatatgtaagtgtacatgtatttctcagaagctagtaatagtgcgggcacgtgaaacaatacagctttcttaaatttgcagctgaaacttagaaggcacttggacattgtgtgtaatttttttccagttgaggtgtaacatagtaatatcacaagtgtacagctaatgtatactaagtgaacagctagatgaattgttacatatgcacatgtctgtggtaaccagtacccagatggagatatagaacatttccttggccttagaaagctccctggtgcccatcccaggcagccctccctcttgctagcaggcagcagctattctgaagagttggaatagatgagttttgcctgttcgtgaactgtatgaacatggactcctacagtatgtagtcttatgttggagttcttgcactgctcaataatgagcattgtaatagacataagcctgtgagatttattcatgttattgaataacatttatttatgtatacagtactaattcatgctttgtaaattgttgtagagtcttttgtgcggtttgaaattcataataattcattttattggcacattggatacacagtctttgggggaaaaaagaaaataacacttcttcctacattactagaaaatcagatcccaatggctatcttaggaaaacaaccatgacctcatttttattcacagaactgggtttattcactacttgaaggtataattaccttcagttacaattccataaaccaaatactttgaaaactgtattcatttttatgtgtgtgtttttaggagggagcctcaaaataggggaaaaggaccatctaaggtagcttatatccttcatgcttaggactaaatgccgtaa

SEQ ID NO: 67954 - DNA, 1352 bp, Homo sapiens
gtcagggtatatacagctgaaggcagtaggtaggaataggaactaatgtcctagggctttgttctaaagagagcaggtaaaaatttgttgactatttcttgggcttgcttcttattttcccacttcgcccatctgccttcatgactttgtagacaatttcatgtatggttttgtcgaaatgtaagttgaagtaaaattttccttctgtagaatttttttttttccacgaacgtttagactaaaaattggtgattgtttcgaagttaaatactagggaaatgatttcaggaattaaatattatcgtagtaaaaatcagggaagcgttagaaaataaataatgagttgaaaaatgtgttgctttaacgtgtaatgatatgagccagcgccttgtgatcagctatggcatgatgtagaagtatgggtaagacaatacagtggagctgtagatgagctgcgtacatggtagcccccctttaagtaaatgaacttaatacaaactaattagattagaaacagaatttggagtatggttgccaaatattttgagttgaaggacttgcttttttacagtattttttaatggggaattttttcaagaaatttcgtgaacttgaatttgagaatgttttatttttacttaaatttttatattgtatgtaatcattccatgtgataagtttttgttgtgtatttggcactaactcactttcaacagcacaggggagggctttacttgattcttttttgttaaaaagaagggatggtgtatggaatattcttaatgtcacttgaaaaatattggattacaattaaatgaaaaactggtttcttggtttttttttttttaatccttcaagttttccctcattgcttgtgctctttcccccattgtcaggcttaaaacatacagtatcattgtcatctgtctcctgaataatggtcctgaggtgatattattaatgtggctttttaaaatcaagctaattatacttgcctaaaagagccacatgtgtgtgattctagctgcctggtgccttttgagagccctggagacaagctagtgaatagagctgaaaattcattctgtatttgattaaatggaacagactcgctgctccttaccccagcgggggctatgagatctcttgatccccgaagcggctccaagaccctgggaattccattagcgagcacctgaggaatttctgccctgcagtgccttttttgtatgtgtgtatgtgtgtgtgtgcagagggagtggagcagagcggggattggggggatgcgggcagggggggttgagggggtggagggaaggctacattagaagactccatatgttggcagatct

SEQ ID NO: 67955 - DNA, 2069 bp, Homo sapiens
taataatagttaatgcttatatagttccttctgtgcaccaagtattattttaagcattagtcccaaattacaaatgagaaaactgagacatgaagtgccttgaccatagtcacacggctagtcagtgtcagagctcatattaaaactcaggtaatctgtgtctagaggctggactcttaattattacacattaatgtctccctacaataatgggaagtatttttattaatatcacttcaaataaattgatcagttaaactgatctgttcttttttagcaccatttgctcgcagtgccgcctcctgctcctcctgccgccactgccgccctgagtcactgcctgcgcagctcaggcctcctggcttcccatactagctgccgatatttggagttcttataacatggcagacactgacaatctgaacttgatcgagatttggatgatgttgaagaagtacatgaagaagaaactggtgaagaaacaaaaatcaaagcacatcagctaactgttcagataatgcaaagtcctcagattcttgcagtccttcaagaaagacttgatgttctggtagaaacaccaacaggatacactgaaagcctgcctagggtagttaaaagacgagtgaatgctctcaaaaacctgcaagttaaattaaatgtgcacagatagaaaccaaattctatgaggaagttcacgatcttgaaaggaatatgctgttctctatcagcctctatttgataagcgatttgagattattaatgaaatttatgaacccacagaagaacaatgtgaatggtaaccagataaagaagatgagatttcagaggagttgaaagaaaaggccaagatcgaagatgagaaaaaggatgaagaaaaagaagaccccaaagaaattcctgaattttggttaactgtttctaagaatgttgacttgttcagtgatatggttcaacaacatgatgaacctattctgaaacacttgaaagatactaaagtgaagctctcagatgctgaccagcctatgaattttgtcttagaatttcactttgaacccaatgaatattttacaaatgaaatgctgtcaaagacatacaggatgaggtcagaaccagatgattctgatcccttttcttttgatggaccagaaattatgggttgcacagggtgccagatagattggaaaaaaggaaagaatgtcactttgaaaaccattaagaagaagcagaaacacaagggaagtgggacagttcatactgtgactaacacagtttccaatgactctttaatttgtttgcccctcctgaagttcctgagagtggagatctggatgatgatgctgaaatccttgcacagacttcaaaataggtcactttttacgtgagcgtataatcccaagagcagtgtcatactttactggagaagctattgaagttgatgatgatgtttatgatgaagaaggtgaagaagcggatgaggtaatgtttaccaaatgagcaaataattctctgtgtttaacacattgagaagcaaattgaatgacttatgtattcctttgctataatcattctgcaatttgggttaaaaacattttggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtgcggcctgggcgacagagcgagactccgtctcaaaaaaaaaaaaaaaaaacattttggaaaatatgattttagaattctacagccaaacagtgtatgtgtaaagtttcaataaataaactgaaaaaaagaaaaaactttgttgagcaccttttaagtataaagcacaaaattaaagacatacaaggaaatacctgtattaaaaacatcttggctgggt

SEQ ID NO: 67956 - DNA, 1051 bp, Homo sapiens
gaagggttgaggttgtcatgtccaaagctctttccttctcatcctcctaagcacccagcatcactcatccctggacaatttagctgccatcagcacctgctgtttgatgcagaaagaggggaaggggaggtcagaggagggaggagagcagaggggacaccagaggctttgttcccaggtgcccacctcctagggagggaggggtgggggtcagtggcagccccatgccctatctggcaggcaatcctgtgtctgagtttgggaattaagctgtcctcgcctctccagcatgaatgaggcctgggggactgtgacaagagctgtcagtgctggtatcctgtgccagtaatcgctcaaaaggccaggcagctcaggacgcctgggaaagatgggatggagagggcagggtccagggcctgctggggaggggccagacaggaacacagacacctttgtgtgcacctgatcagtgccagccactggctgcttcctgtcggaggggctttgtccctgtcctgtctcccatgcctggactttaggcaactctgggcctagggccacatccaaccacactgtgttctgtccccagcgcttgctcggggccaggctccgagcttcccctgaaagcttgtcctggaggggatcgaacttcaaggcgaggcaggtgacggtgaatgtcttgacggccctcagcagatggggcttttactgaggttgagtttctttctggcaagaagttttggggaccagggttctaggccgtgggccccagcccagctcattccaaaaccattaggccaggtaaccgcagcagcacagtggggccaggtgacagctggagcagctgcagacagcctcagtccccagcgtgctgacatgttagaagtacacgtcactatctcagcagtcagccgccacatctggaactgctctcggcctcctctaattgcctcattattttccgaggaaaagcgcccccgtccccagctctccgttgctgtcccttccctctggcctgtcccgaaatccacctgaatgagccccagaccag

SEQ ID NO: 67957 - DNA, 1036 bp, Homo sapiens
cagtgaccattgggggatgaatggagaaacaaaatgtagcatacacataaaatagaatgttattttcagctttaaaagaattaaaggaagggaaattctgacacatgctacaatatggatgcaccttgaaaacattatgctaagtaaaataagccaggcacaaaagggcaaatattatatgattccactcatgtgaggtacctagaagagtcagatgtatagagacagaaagtagatggtggttgccaaaatcttagggtagggtaaaggaggggagataaatagggaattgttgtttaatgggtccagagtttcagtttgggaagctgagaaagttctagagatggatggtggtggtggttgcaaaaacagtgtgaatacacctaatgtcactgacttggcatttagtataatgccagtggttaaaccaggaaattttatgtatatgttactacaattcaaataatgtgcaaatcaatactacttatgtagtaaaattactaaaaagttggggtaatggtagacggcaagttcatgataatggttatctatggtggaaagagggaattgtggtggggagaggtacttagagtatttacggcgtttacttcctaaactggctggtgctacataacttatagtttgctatattattcgttatactttattatagttgggacttggccagtttactgcactttgatgtaacacgatttgaagcagatgccaatactggtattgtttctgtagctcctcacgagttttctctctttctctctctctctcttttaaggaataaaacatcagcttcgagttcacttgtcttttggattggattgtccaatccttggtgatcacaagtactcagactggaataggttggccccccaggtaatactaatttgacccaatgtgcagcagatacgggagagaacttaggcgttccttttcttaaaactctgaaatgagttacaacaaagcctactgattgtcttcagacatgataccaagctcattatcttgattttagagaaat

SEQ ID NO: 67958 - DNA, 1022 bp, Homo sapiens
gacgcagaaaacgttaaaccgttgaggcaccggcatttcccagccccagcccggcttccctacacactcaccgagtctcctccaaacgccactgctccagctgcagctaccggccggcgcagccgcactgagcgcgcaccgtccccacgtgactcgcccaggccccaccccgcaccacgtgacctgcagggcccacccactcccgcctcattgtagtcgcccttctccacgtggtcttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgagtccaaagggaccagaactccctagaggcagtgcgctcattggtttcccagacggggagtaggtaggagggtcctctgagtgaaagcgtgtgagtcaatagcccggacgcaaggtgggagaatggggagaaggcggaggggaggggtcagtaagggtacggtgttttcccgtgagctggatctttggctactgtcaggctcagtcctaaccactgcgtcggtacgcaggttagacagatgggtatctctgctctcaaattagtcgaaggcggcgcgggtctgatgcaaagatagtcattccctactcagattctcacccagacctttatggaaggtcttctccacggcttccgcaccaggcattccccacggctccttctttctccctaggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtaaggacca

SEQ ID NO: 67959 - DNA, 1116 bp, Homo sapiens
ttcaaactcctgacctcacgatccacccacctcggtctcccataatgctgggattgcaggcgtgagccaccgtgtccagccacatctgagctcttgagcctggaataccagtatgatttattttgggggcttaagttaaagggcattctagaatttggggtttttcttctcaatccttaatgtctttcagaaaccttacctctagtgaggtctttctccttaccttgttcagatggggtcattgtttgctagtaaaatggcaagaacaagtggcatcagtctggcatttcctcagtgactctgttaaagcacatgttcaggaaatgagtgtgatacagatcttatctgacagaaggtagagggtctcaggcatgctaagggataaaattaggagccaatcgagttcaccatagatgaaatatttcaagactgggatccacagaggaatcagatcttggcacagctagacatgattcctgtctccctgtgtgctgagatagaggaaaccgtgagtttgctttatccactgatgggaaaggctgcagtctacatatggaactgaattcatcaactacccaagcaaagtctttaggattttatttaatttgttcactactgacaagcttgttgggaactctttagtagtacttcactttgggtatctttcccttcctcccaaatccgatagttgctaaaaacccagatgtgttggaattagtccaagagccacagttagaaaggtttggtttcttctcaagtcagaggatgactcttttcccttaagaaatgaagttaacccttttctatatttatgctagagaaataaaccattctttattccagtcacttttattttttaaaagggggtggaggaagcttgctgatccttttacagcaagaaacgtaccactttctcaagctggtaattgtagatcttttatttccaggcaaaaatactttttaaaacattagaatttttctctccatttgatttatttcgtctgctaatatacccaggtgtatcactctgagctccttctggcatgtcacttgtttgagctgaggagtatgcactggacttacaggagaaacatagctcagaatgaagaaggcggg

SEQ ID NO: 67960 - DNA, 1088 bp, Homo sapiens
agcatgtgcctgtagtcccaggtgatggagaggctgaggtgggttgatcgcttgagcccaggaggccgagactgcagtgagccaagatggcgccactgtactctagcctggacaacagagcaagacccagtctcaaaaaaagaaaagaaaagggctttctaataaaacagtaaacttgcagtaattattagtaattcagttctatatgttgccagtggaatgtactaaaacaccccaaacggtggtagtatgtattgtcttctatattgtgtgtgtgtttaaaatactattactatttttaaattcacagtctttagatttaacaagtttgccaaagtttgagcacttagaactttatagtattcattctaatccatggtaattatttacttttgccagttattccagcacccgaacataattggccatttttcatacatctttgcttgatgatacatttaccagtcatcacagtggcttgatttgaagtccacttcatgtttagttagagagacatgccccactggctacaaggtcaccatcgtccaacaacagagaatgtcattcagcaaattagtattgattgttctgttcttgactcagtaatttcttcagctgagagtaaatgggtaattgggggctattaatacacttatctatgggtggtttttatcccctgagtcttccgcaaacccatcttgtgggagaataactggtttttcttaagttctacaaagtgatggccagtaattgacatgagttgacactgtttttggtgggaacttgggggcaggccttcagaaacagaagcaagatggtagtatggagcaccaaagtcctataatttccagattacttcttttagactaatttaatttagctccttgtttagaatgttcattaattaacaaatttctgttaagtagggggcacctccaaaacacctttaagggtatacagcttttttaaactgtttaatatatgtgctattttgaatagtatactttacagatctaattgtggttcatggtgtttaatctattttagaaactggatggcttctacagggagccaggcctctgatatag

SEQ ID NO: 67961 - DNA, 1034 bp, Homo sapiens
gcctgtaatcccagcactttgggaggccaaggtgggtggatcactcgaggtcgggagtaccagaccagcctggccaacatggcaaaaccccgtctctactaaacattcaaaaattagctgggtgtggtggtgcacacttgtaatatactcgggaggctgaggcatgagagtcacttgaaccagggtggtggaggttgcagtaagccgaggtcacaccactacactctagcccaggtgaaagagtgagactccgtctcaaaaaatatataaagcataaaaaataaagaagtaaactactgcaccagtacactgacaccagctctatgaaacgctgattagagagcctacagaagaatggcaggtaaagataaaattttagaccaatcatcaagttacagcaataagcaagagatcacactccttgatgggacataccaacccacttaagtcttgcttaattggtcatcacagtctgctcaacgtagcatgaccttcttgtttcagacttgccttgagtgtgtcttcacaatgtcaatatgttgtatcttttccttccagagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcaggtaagatgcattttgaagctgaggggaatcagagaacaacagctcttcagccttttgtgtatttgtgatgtgatgggcaaaatagttgccaagatgaggaatgtaatgactgaccaaattgtaaaggaggccacagtcttcaggttagactaaagtgccacttggattatgggaagacagacaaaaagga

SEQ ID NO: 67962 - DNA, 5069 bp, Homo sapiens
acggcccccgcctctggtgtctcaactctagccgaattccggcgcctttgggattctcctccgctccctctatttatccccagcagcttggttttgttgtttcgagcctaggtgaaataacagatgggaaaacacctttacaaaactaaatggtgtatagctgctagtaatctgattgtttacatgactacttcccttttggctcccatgtgtcttgctctctctctcatctttttcccccaacttggttatcttatttctggtggaatgccagagagaagtgccccaacatcctcttgtcctggggacagatttgagtttgggggaaatgtttggctctttcccaaaggttatccaaacccagggcccaaacctgggttttctggggatagtctgaacactgagacatactctttctccaggaacggggaggtaacaactccttcacccatgaggcactcacactcaagtataaactggacaaccagtttgagctggtgtttgtggtaagtggggtgttgtagagggacgattgcattgttaacatagccctgatttttaagagaactctgattaattgcagccagtgtatatgatgacgtaactgaaaaaactagaaaggtagatgggggaaaacagcagctactgggcccaggcagggagcttggctgcctctcaggacagggaaaccggccaggtagctgaacctatctctgaaagccagggttgagttggcgtccctccattctaggctagtatgtaagcagatctgttggctgtttcttcccctaaacaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtgaagcagaggagagcagtaagatccgtgctcccactaccatgaagaaatttgaagattctgaaaaggccaagaaacctgtgaggtccatgattgagacacggggggaaaagcccaaggaaaaagcaaagaatagcaaaaaaaagggggccaagaaggaaggcaagtttgagttctttggatatactgggacatgaaaggtgttaacacggtgctaaggactgaggtggtccttccttttgtcattgcttacctgcttctcactcaaatggtcaccatcctataatccccaggccttatgaactccaagatgtttggtccaaatttcctttgaacaatttggaagacttttagccattgtctagtggttgggattggtcttcttttttcttcagtgagttttttccccaacaggttctgatggtcctttggctaccagcaaaccagtccctgcagaaaagtcaggtcttccagtgggtcctgagaacggagtagaactttccaaagaggagctgatccgcaggaagcgcgaggagttcattcagaagcatgggaggggtatggagaagtccaagtgagcactctttctccagtactctcaaaatactgttatctagacacaatgggtgcaagggagttctggtctctggctcatgtttcctttcctacttctccaccataactctttgtatcataacctgttgcagcaagtccacgaagtcagatgctccaaaggagaagggcaaaaaagcaccccgggtgtgggaactgggtggctgtgctaacaaagaagtgttggattacagtactcccaccaccaatggaacccctgaggctgccttgtctgaggacatcaacctggtaagaggtaacaggggtcaaagtgatctttaacaacaaattgggaggaagtagagtgtgggaacgtgatactgggatttgaatgaggggtaagttatacttggagcttcccaaaatgaaagagatagagcaatgtggacgttttcctcagagaccttagtgttcctgaccccacatcctttccccgtatcttccagattcgagggactgggtctggggggcagcttcaggatctggactgcagcagctctgatgacgaaggggctgctcaaaactctaccaaacctaggtaggggaatttcaggtgggggttggtatatgcatctgcaaaactggtaagatacaactcctgcctactggttttatgtgtatgtgtaatctcctgtccctgcagtgcgaccaagggaacactgggtggcatgtttggtatgctgaagggccttgtgggttcaaagagcttgagtcgtgaagacatggaatctgtgctggacaagatgcgtgatcatctcattggtaagttctgaggaccgggctgactcatactcgcgggataggggtagttgagagcagaatcacctagcgtttctcacctgtaccataaagattggtcattgctgacatggaactgacatacctgtccccctctcctcagctaagaacgtggctgcagacattgccgtccagctctgtgaatctgttgccaacaagttggaagggaaggtgatggggacgttcagcagtaagtacttacctaagtgagaaagtgcttatgtgtaggttaagtgcatagacctcagttcttactaggtatgtgactttcggcaaattccttaacctctaaacctctgtaacctagattttaagggttattgagaggattcagtgagttagtccttgtaatgtgcgtctgttctggatttctgggacaagagtctaatttactgttttagtccccttagctcagaaaggtgttaggcatttttgagagcattccttgagtttcacagctgcaacctcctccacctcccctttcagcggtgacttccacagtaaagcaagccctacaggagtccctggtgcagattctgcagccacagcgtcgtgtagacatgctccgggacatcatggatgcccagcgtcgccagcgcccttatgtcgtcaccttctgcggcgttaatggagtggggaaatctactaatcttgccaaggtcagtgcagttccccagcctatcgctgatatttctgtacttcttgtgtctcaaaatcctggctttaggtgacttttcttacgtctttttcacagatttccttctggttgttagagaatggcttcagtgtcctcattgctgcctgtgatacatttcgtgctggggccgtggagcagctgcgtacacacacccggcgtttgagtgccctacaccctccagagaagcatggtggccgcaccatggtgcagttgtttgaaaagggctatggcaaggatgctgctggcattgccatggaagccattgcttttggtacagtgcatgggaagtgtgggggcttatttggggtccctttttctccttgggttctcttggaatttgcagaagatcaggcttgtgctactacagactcgttggtcaattacagtaaaaagtcagatcagttacttgccatgctctgcttttggataacagatgtagttgcaggcaaagctaatataccttaaccagagaaacctgaatttggtcaccttcatcctgttgtcctccttttcctgaatatgtttggtgatggccaagcatataatcaagtttttctcacattaccttggaaccaaatccagagcccaagacagtgaacaggtagtcaaactaggactttttgagaggaagctgggaacgagcatgagtggtagtccaggtgttcagagttgactactttctttctctagcacgtaaccaaggctttgacgtggtgctggtggacacggcaggccgcatgcaagacaatgcccctctgatgactgccctggccaaactcattactgtcaatacacctgatttggtgctgtttgtaggagaagccttagtaggcaatgaagccgtggaccagctggtgagagcgtgggcccagttccctttacaacttgagctttggtcaatttagatggttcttacacttctatcactttttctttccaggtcaagttcaacagagccttggctgaccattctatggctcagacacctcggctcattgatggcattgttcttaccaaatttgataccattgatgacaaggtaaacgtgagactggaggctggaatgggcgtcctgcacaaaggagctgaggctgcaaggaaatcttggctccagcgcttcctgttcctgagagggtgagtgaaaagtgggcttgtgttgatgggctgtcctctttctccacttaggtgggagctgctatttctatgacgtacatcacaagcaaacccatcgtctttgtgggcaccggccagacctactgtgacctacgcagcctcaatgccaaggctgtggtggctgccctcatgaaggcttaacgtggctcttgcccaataccaaatcgccgctttccccacaagcccttcttcctgtatcaagaatgtgctttagagtatgtgagcaacctgtcttcagtgtagtacaaaggcagagtgagggggcttgtggctccttccaaccccactccccgttcagcacagccgccatctgcaaggaaggcctaatcatgttacaatcactgcccactgaccctctcccagcgggcctcccccttcctactcaggcacccccttcactctgcctacagactcagtcttattacagctttgaccaatggttggaacccaacaccagagctttgctaataattagtgtggtcaagagccgtctgagcctaatgagtcccagctgcattaggttaagagactcttccagagccagcgccaggtcttgaatggcacctctccctaggatacacagcctgcaggtccccaggacctggatgacacccgcc

SEQ ID NO: 67963 - DNA, 1014 bp, Homo sapiens
acttttctgcagggactggtttgctggtagccaaaggaccatcagaacctgttggggaaaaaactcactgaagaaaaaagaagaccaatcccaaccactagacaatggctaaaagtcttccaaattgttcaaaggaaatttggaccaaacatcttggagttcataaggcctggggattataggatggtgaccatttgagtgagaagcaggtaagcaatgacaaaaggaaggaccacctcagtccttagcaccgtgttaacacctttcatgtcccagtatatccaaagaactcaaacttgccttccttcttggcccccttttttttgctattctttgctttttccttgggcttttccccccgtgtctcaatcatggacctcacaggtttcttggccttttcagaatcttcaaatttcttcatggtagtgggagcacggatcttactgctctcctctgcttcactaaacaaaaaggagaatggtttatctttctaccccatgcagaaggaaaaataacggtccagagaaaggactctcacacccaagaggacaatgagaactgggtagcaaattaggaatgtctttgaacacatcaatttaccacctttgaaccaccttcagagaggtcatcaaatcatggaaataaattgattttagagaaggcaggtctctcaccgaaggagccgcaggaagtcattttggaaatcaaaagtgccatttaataaacttaaagcactttgctgttggatctctgtgcggtacttgtcccgaaacagccgatgcacgtcatctatcaatttgtctacatatgtcagtgtcaggatcttctgaaaaccaacctgtttaggggaagaaacagccaacagatctgcttacatactagcctagaatggagggacgccaactcaaccctggctttcagagataggttcagctacctggccggtttccctgtcctgagaggcagccaagctccctgcctgggcccagtagctgctgttttcccccatctacc

SEQ ID NO: 67964 - DNA, 1037 bp, Homo sapiens
tatccaggataagcatggcaccgcttagcggtgacatgcttcagagggtgccgtgacttggggtgtgccagggcctcttggtccaaggcctggaagacccaagtggggatgacagtgcagttgaatatgtgagttgggatcaggagaggtctatgcaggaggtaatgtagaaaattaattttaggaaattgaatcttgcagtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacggtgaggtctggggtagggcagagtcatgagtggggcaagaaagatgactcattttattaaggactctagcgacaagggaaggagaggaggggaagacctcaatctcggagggtccaacggacagagattgtgctttggactttgttgagaaattttcctaggatcttcctcagtcgaaccaggaagcttggcaataaggtttgttcttttgaaagcagatatcaccatattggatttttcgagatctcatagctctggtcatgagagcctgcattcaagctataattaagtgtctcaattttctctttttttttttttttttgagacagagtcttgctctgtcacccaggctggagtgcaatggcacaatctcagctcactgcaacctccacctccca

SEQ ID NO: 67965 - DNA, 1028 bp, Homo sapiens
aacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaaaaaaaaaaaaagaagtcatggaatagactgggatagcagggagctctgtgtgctgaagggagacaagggagtagggaaggaaaggcagtcaaggctgaagagcctgactaggaggcttggtcttcagccgctcagcaatgaggaaaaataggggcatttggggcagagaagtgacatgactgagctggactccccacttgtggagttggggtccatacatcatccccctgcacactcccctctctgacacacatacaccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactccacagccaagctgaaggaggaacacttccctcctgtgtcacgggaactgccctgggccgtggtagttctctgtccttcatcaggctttgtctctgtggttcagttggttaagatgaccttccccggcttacaagccctagagaggggttggggggcacaggaaatacaatccaagagcagaagtcctcatccctctttgtgagttctctttttcttatcacagggatggaggacgaaggttggtttgacccct

SEQ ID NO: 67966 - DNA, 1040 bp, Homo sapiens
cctggctggagagtgcttttgatgtccaggtcgagtggattctcttttcttgcattccaacagtccttcaaatcatgctgctttttagtttgtttcatatttgaaccactgttttattagcttttactttttcatggagtttttagttgcctcttttttcattgtggttaaaggaataatgtacctttactctgctcttgaaattatccagtgtgataatccattacatcaagcttgtccaacccgcagcccaggacagctttgaatgcggcccgacacaaatgtataaactttcttaaaacatgagattttttccgtgatttctttttttttttttcagctcatcagttattgttagtgttagtatatttcatgtaaggcccaagacagttcttcttccagtgtgacccagggaagccaaaagattggacacccttgtattacatcatatttccttccttgctggtaacattgtttccagaaagctctttcctgcttctccaatctggacaggtgattctttaagcaagttgttcaggtctcaatctgagacttccttttgcaacttctgtgagttagatgttttctgtattctacgtctgtttctttcttgttttactctcttgattagctgaagtacattttttttttttcatgtttttcttgagatggagtctcgctctgtcgctcaggctgtagtgcggtggcgtcgtgatctcagctgactgcaacctccgcctcccgggttcaagccattctcctgcctcagctcccaagtagctgggattacagacacccgccaccgcgcccagctaattttttgtatttttagtagagacagggtttcaccttgttggccaggctggtcttgaactcctgacctcaggtgatctgcccacctcagcctgccaaagtgctgggattacaggtgtgacccaccatgcccggcctctttttttttttttttttttgagatggagtctcgctctgtcacccaggctggagtgcagtggcgcgatctcagctcactgcaagctccg

SEQ ID NO: 67967 - DNA, 1174 bp, Homo sapiens
agctgggattacaggcatgcgccaccacgcccggttaattttgtatctttagtagagatggggtttctccacgttggtcaggctggtctcgaactcctgacctcaggtgatccgcctgcctcggcctcccaaagtgctgggattacaggcgtcagccactgcgcccggcctttaagccatattttcagctttgggtccagaaagccacatacctagaaatttggtatgtgagaagagttagagacctctcattcctgtgcctggaagatggagcaggaagggctggggtttgcctgatgaggggcccagtgacccacaggtaagaaccttgtgttttccagattctgagtgtggctcagctcgtgaatgcagtggcacaaggcactctgtgggagtggatcttgggtgcatgatcctcttggattttggcttccctcagggaatcaaagccagggtgggagttctctcctcaccgtggtgcctgtggcatagagagtgggcattgcttccctgtcacgggctgtgctgtatcattgcagatgtaaagacgaccgtggtttaccctgccacagagaaacacctgcagaagtacctgcgccaggacctccgcctgatccgagagacgggagatgactacaggaatattactttaccccacctggagtcccagagcctcagcatccaggtgactggctgcatgtctcagacgcagagcactgctcccgtggctggtgcctcctcttacgagtgtctattggggtcatattaggggccaggcgctgtgctgggcgaggggatgggggtacagtagagagcatggcggacagaatccccacctcgtgcagcttacatcccatgcacagtcacacggtgtgtgaccatacacagatatctcaggatctatgtgctctgtgagataatgagggctgcagagagaaatagacaggataagtgggaccagaaggcctggggcgggcaattgccattttatatcgcatggcgagagaaggctttgggggtgggggaactgatgctggtcttggtcccacctgatgtgcttgggcatgccatggaggctctctggggacctcaaagcaatccagtcctttggaagaatgtgtgtctgctctgcagtagccttgatccagcctcgggatgactgtgccattgcttt

SEQ ID NO: 67968 - DNA, 1315 bp, Homo sapiens
tagctggcccctccacagaaggaaaccgtggtgccctcagcctcctacctctctttgccccatagtcctgaatagagtgaaataggatccatggaggcagctcttcccctgagtcctgtgagcggtggagggggtcactgctatagagggcagacacagcctgggtttggaggcctccgcagagcatgtgcactatgctgaccaggaagagcctggccccttccaagctgcagagacccttgtgatgacgcatggctgagtgccagctggagtgggaagggggaagtcccttctggacccctaagaacagatgcttggggacagggcagcccggatgtagatcctctgagcgtggcggccttttatggcttggttctgtctcctggagaggccagggaatgccctgagctcagtttggggtatctctcaaggggtgatgagtggatttgtgaaccatctctctccccctcctttcagtgggtgtataacattctcgacaagaaggctgaagcggaccggattgttttcgagaacccagatccctctgatggttttgtcctcatccctgacctcaagtggaaccaacagcaggtaaaggtttctggctggaatgtcctgatctctggccaccctgctgtaagtgctggtccttctgactgccctctttctcacgctggcctgtctctaagcagattataattaaccaacaagggttggcctgagctctctgtggggactgggtggatacctgtcatacataagtgcttttgctttaatgggtcagcttaaagccctttctggctgtcctcccacccaagaggtaaaatggggtgatgtttgtgcccatgactacataggccattccttaccagccaagtggtctgggcagccacctgtgcttccacccgcatctggagccctcgggtggggtgtttccattttctccattccccttgacaccagcagatccaggcaggcccgtgttctgaagcactggcaggcaggaaccatggtgaccaacccaaggcatctcctcctcagcccgagctgtggagtagcttagcccagacttctactcaggccccttggccccgtgccctgcctccaagcacctctgcttctcctactttcctaaggagcaggtttgggaggagccgtcctccctcacaggtatccctttccagttccctatggtcttctgtctctcccagaccagcccaccaccagagttatcacttaccaccacctcttttatacctgagagtatcagaagcttttataccctgacagggtcagaaacaggcagagccactgt

SEQ ID NO: 67969 - DNA, 1006 bp, Homo sapiens
gtttgaggggcaagagagatgggacagagttcacccaacaggacagacgaggctggcagtcacagcagagggcaggcactcaggtctggagaggcagggcatggagacagggacccacactctggaaggtttctcgactcccccgaggggctggccagttctgtcttccttctgcccactctgtggggaggagcctctctgggatagcgtcccctcactcctctcccagcctcgtttatcttcaccacagtacagaagggggcccctctccaggcctcaccacttaacttttcttgtacatggaaagacaagcctctgctagaggcctggcaagggttccccttcagagccagccagtgctctgctgctgtaatctccagggaccctgccggccacggcccccatgcagctccctccctcaatccaaccctctttgggcttatcaccctcaaggtctagagtgcaccagggttggctgctctgccaagtcctgttgagactccaaaagcatagtctgtctttattagggtgaccttcatatcagactcccaggtaactcaagatgatagctttgcaatatagtgcctccttttattcctatttgtgagtttctccgctttcctcactagactgagagggtcttgagggtaggagctttgttttagttatctctctatccctggcccctaagacactacctggctcagcaaaccaacctttgagacaaagcaacattataacactacattcatatagcagatcatttcatgacccacattctccttcctttttacgaagaaatgggctcaggatgtcttgtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggac

SEQ ID NO: 67970 - DNA, 1036 bp, Homo sapiens
ggaacaggaccctgccccagtttccccagtgagggaaggacaccgttccccgtgggatagagcactgcaccctttcttgattctcattgttcccgggagcgagcgccttggctgcgctgggcatacccaccctggcgccattcacaggcagtgcctgccctggccctgtgctcaccccatcaggcctcctcttccgcctctctggcacccacggcgcccctgcttgcctctgtccgggtctcggaggcgcgaacaccatcccaagcctgcgaccgcgcggcatcacccccgcccttccccctcctccaccccgccctttctacccctcccgggagctcctgggagtcgggccgccgtgtgcgcaagcgtgtccagccccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaag

SEQ ID NO: 67971 - DNA, 1752 bp, Homo sapiens
ggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctg

SEQ ID NO: 67972 - DNA, 1002 bp, Homo sapiens
ccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaat

SEQ ID NO: 67973 - DNA, 1046 bp, Homo sapiens
ttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaac

SEQ ID NO: 67974 - DNA, 1029 bp, Homo sapiens
ggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccc

SEQ ID NO: 67975 - DNA, 1085 bp, Homo sapiens
cctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggat

SEQ ID NO: 67976 - DNA, 1028 bp, Homo sapiens
gggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggc

SEQ ID NO: 67977 - DNA, 1093 bp, Homo sapiens
cttggggaatggaactggcagctgtattcctggctttctcggaaagagttgcggccttgaggttttgagacaagccaggctgggacaggacagataaagaggggcagcagtttgggaggaacagaggaagatgacatggttctccacagagcgttggaatggccttgtggacacccacttcatcccccagaatggccccaaggaccctcccagggaacagaagggctgctctctcagcagcctggctgctttgccaggggagaggggggttctgagagcgagtagagccccagcatctgcagccccaagcccactcccctccacacgggcaaactttgtcttgaaggctgtgtcctggggagcgagcttgcagacagcaggggttgtgagcgtgtggggatctcaactctgctcaccccgatgcgtccccagctgccgctcatgtggagatgcaagggagtgtccgttttcccatccggggccattgagaatggctgtctgcatacatgatccagctggcctggactgaggccactgcctgttactgaacgtgcctaaactcaagctagaatccggcacacaggggtgggtcagacccgtctaaactccacacacgcacacatgtagatatgggagcattttacattcttggtgggttgtttgtgattctgtgtgcggacagtccttcctgctcacatactgagaagactgtgaatgcggggtgtgtgtatacccaaatagaccattgtttgcttgggggggtggggatagctttctccagggtgcccaacatcctacgcagattgaggcaatactggccaagggtcggagctgagaatggggctttgatgtggggctgttggatggggttctttggttttctgggaaagggactttcagtcttcaattagcccaaccaacgggaatgaactgcctgccagcctgcctgggactgattaaaccataccctggaaatgaggaggggaaagagcacagtagggcacgtgcttgagggcaagtcaggagatctgggttctccaccagcctctgtcgcctttttctgtaagaacgtgggccagtcatttctctgcaa

SEQ ID NO: 67978 - DNA, 1042 bp, Homo sapiens
actgaggagccctgatggcacaccaggaagttgggctttgtccagcagatgtggggagccaccgagggattttaagtgggcaagtaacaggaccagatttgcattttagaaaggctgctttctcaaggctctcgagggtggattgagaaaagagacaaaagactacaaggctgagaccaactgggaggctgctgtaatcatccaggggagcaatgatgaggcctgaagtaaagaagtgatggtggaggacaggtggggcacacatttgagacactttttgaagtggaattgacaggacctgaaaatcaattggagagagaaagcgtagccgagggaaaagtcagtttgattcagtaaacgtctgtgagcctctaccagggcctgtgtaaggctccgaagaccccgggatgaacacagcagcagctgctcaccctctagcaacataaaccgctaatatttcttgagcacttattgtgttccatgggcttcaagcccttctgagttttgtccacttcaccctcaccacagccctgtatactgtggctttcagacccatctcatggatgaggacatggaggcaccagaaagcccatctactatattccttgctctgctgcctccactccaacatgttacgaccgaggcaaccagaaacttctagcatggttgtccaggtttctgcttggacaactaggtagatgatggcccataaatggggattcggaagaggaggagcaggcttgatgtgcctggagaagtgatgagttgactggcaatccagtccccaaggaggaacctgtgtttcttgcagactgttttggtggggtgcgggggatgagggagagggacatgtattgaatatctataatagctatgtgtgtgtgtgcgggggaggggaggggattatatgttatataacaacatattgtggcaatttatgcatatgtcttttctccttactgaagagccaggctctctgaagggtagactgcatttttgttgttgttgttgttttgagatggagtctcgctctcacccaggc

SEQ ID NO: 67979 - DNA, 1022 bp, Homo sapiens
aaggaggagaccactctccctgaggcttcgcctctcttgggcccatggaggtggtcggcagcgtggggcctgggaagaaggtgctggggaccaggttctgcctggatttacccccacggctctcatccccttccctctgtctggatcacgcccggtgctagaaagctgcggaagcccctccatcccagtggcgggcaggggccctcctcctgccctggaaatctgggctcttgggatcttcatgcctctgccttcaagctagctgccatctcctccagcctcagccttcatgacctggaatcgagtgactggtgcacctctggggtgggatgggggctctgagatgcagggtgatggaggcagggctctcgtgacccacgcctcctcccccagggtttcccacccggtgctctcaggccaccctcctattacagccgttccagcctctgtgtcacgcccattgcagtggagcagccctgggttccacttccgacccctctcctaagcattaaagagctgaatgcaggctcctctccaccttccctagcatgtctggagccttctgtagaccaagcttggtctacacagtgggggccgtgtggggattccaggctcagggtccgaccgtggccaggcaggcctcagagtgctccttccagggagcagacagagcctgaagcctggtgccaggagactgcgattagtcccctgatgtaaaaagggagtaacagcactttcttcggaggcttcaagggcaagggggagggccagattttttcaagtttgtaaaagcaagtttaaaactgtaaggggcggtgcatgagctaaggatgcttgttttgaacacatccagccagctagtccatggcagtgcgctgccttgctgcgggtccctgctggacctccagtgaataagaggggatgggcaggtgcggtggctcatgcctgtaatcccagcactttgggaggcagaggtgggtagatcacgaggtcaggagattgagaccatcctggccaacatg

SEQ ID NO: 67980 - DNA, 1006 bp, Homo sapiens
tgaattcagttccaggcacagctagggaagtgtgtccagccccgcagttcctttcaccctgctgaggcgagggggccaggtggtggatgcagcgtgaggccaagcgggcagctggctgggctgggaaggcagggagccctggctgctcacagctgtgggtgccgggctggggctggagggtttgggcccaggtgatagggccaagcatgcgtcttcctcagggcttcctggagaagctctcgcctctcctctccttccagggcccctcaccaggagcatcacggagggtggaagccccacctgcttggccccaagtaatcagcagaactgctgctggctccgggagccaaggttccctgccctccctgtcctctcctctcatggtgagggagccagagacggaagaggaccggagccgctgtcggggctgggtccgcaggagcccaagccaggtcttttggggaggtgcctcaggacccgacagagcccgcagctcacatctcgcccagccggtctttcttcccctcctgcactgaaaaaccctctgagaggtccctgccaaaagcacagacactcaaaccactgcatccacgcagctggccaaggatccaggccaagagctaaagagtgagtctcgccccaccctcttcgtgcctctcctgattttggtgcagtttcttccctgtccttcctctttgtctcctcccctctccccacccacctcccccaactcactgttgcttccccacctcccccagcccctctgaaagtggagtcagcttaagcctctcccaatcaatgtctaatttggtctgaacaaatgtaagaggattaattatttatatcacagaatcaggggggctggcgtgtcacagccgccaggttgtcctcaaatagaccaaggtttcatctcgtgtgggggggccacatcccgctatctgctggggaacactgagagactctcagaggaaagggccccaaagcactttgggctcctggtccctag

SEQ ID NO: 67981 - DNA, 1050 bp, Homo sapiens
ccctgaggtccaccctgtgggttcaatgccataatgccacgctgagtagttgctgttgggggccagatgagatagaaggtctccctggaggtcttgcagccattgagttgaggtgtgcgggtcgccccagccctgccctcctgctgcactccaaggtcgccccccacaatctccctgcccccataatctgcatgttaccatgggcaggcatggcctctgtctctttacccactccatctcccatcctcatcacagcctggctggatgtcaaaactctcccccagcctggggtcgtccctcatgttgggaaatgaggtgggggcaggacactcaagcattaaacgacttccaaggcccggaggaagagaggatccctcagggatggaggcaaactcagcgcatcttttcccttccctgcctgagtgtggagaagggcaggcaggagcctctccaagaaggagaagacctgatgcaaggaatgcacagccccaccctaccccagccagtgccaccatgagcgatttctggaggggcccagaagctcgacactgcctatccaagtgcccactcgccactgaaatctgggggtagcttcccaaatgaccatgcccagggccagcccccataccccccagcatcttttgctcccaacaccaggacaagggaagctggggaggttcttaggagcccactcatggtctactgcttatggtaggggttcagcctcctgctgttgcctggccccagtggctgcacccccatcaccaagagacaggctcttcagggcagccctgggaagttctggagtgtgtcaccaccatccccagggcattggaaactctccagacccaagcaggacaaacggccctcactggggagctgggacgcattcactcctgccccagtcctgccaccatccagctgtgagacaggggctgatgatgcttaatctctcagggcccgccctctccatggtggagccagtagcaggagagatgaagtgttaaacccacttcacgggttgactgtgattctctctcatttgctcat

SEQ ID NO: 67982 - DNA, 1048 bp, Homo sapiens
aaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttat

SEQ ID NO: 67983 - DNA, 1088 bp, Homo sapiens
tgctaaccaaccaccaattgcatcccaggacagttgctgaaagtctcagggctctgcaagctggagatgagatcggctaatcctgactctattctttcgtctgctctgctagctggccctacttgtacaattaatattctccctggtgttgattttgttcaaatatattgggcccatcaatcacccactttccaactcatctgtctggatcagtcatttacaaagttatttttgagccactaggattcttgtgaaatagacacaagaaggagctaaactcatttcaggtttgacctctgtggctgggatctgagaaggcttagtttgattacgcttcatggccatccaatccaatctggcttgtagaatagaaaggccacttgcttaattgggaacactttaatatagatatccattaacttatgctaaattacagtaaagcatctatggaggaacttgatgtgacatctgcatgaatactaaataacttcattacgatcagtactgtgacaatgaatatgaaatgaacgtgcccagagaagacaattaatctcccaccttcccaagccagtactgttttattttaccctgcattgtactaaaaaaataaggcatagaagctctatgattttctgtctatctcactcacccttcagctggtgagtggtccccgagagcttctgtcatttgtagagtggaaactgacccaccctgaggaatagccatgggcagtgggtatgtggggctcctggggacccactttggtttgggaaaggaggttgtcaagactaactgaacacaacacacacacagacgcgcgtgtgcgcgcgcacacacacgcacacgcgcacacacagaattaaaaggcatcctcatccggaactagcaaacagactgtcagttcagattagcaacatcaaaagcattccaatctgttccctgcatacattacatgcatagatctgagagaagaatttggcctctgaattaagtcagctttttccttctgggctgcttgtacctgaaatgtgtggcgaagagggtccagcagtcagattaatacacctcatagcatttagtctgaacct

SEQ ID NO: 67984 - DNA, 1080 bp, Homo sapiens
ttcattctcttccacgtcatttggtggtagtggcatgggcaacttcaaatagatatcaacttcaactaaaatggttaatggcagaaaaatcactacaaagagaattgtcgagaacggtcaagaaagagtagaagttgaagaagatggccagttaaagtccttaacaataaatggtaaggagcaggtgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaaattttttcagcatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaagaaaataaatgcgaatgtgttggtgcattcaaaaaaaaaaaaaaaaaaaaacagaaaaaggtcctaggagaaaaggaattagtttcagagactgagttaccaagcataaagcatctttcttgctagtgtgtcagagcaaaatccttctgaaaatgaagttctgcaccctagctgaatctgcatcttcccctccaccaaactgggtcgtctcccagaccagcagtatcagcaataactgagaact

SEQ ID NO: 67985 - DNA, 1041 bp, Homo sapiens
atctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgctgtggctttggcttgattctttcttgtctggatcatgtattaaagcaggacaaatcaaccaaccagaggcaagcacagagggatgcagtttagtctttctgatctcactagctcaggaccattggagataaagatttcctaataaggtgagaaatataacaggaatatagggaagtcatcgaacatcccaatctttgaatatattgtgtcatcctttgtggaatgtccctggccttgtcagacctcacttcttcatgtccgaaggactaagagccatgtgaaggaaacgtttaatgactcaacagataaacatttgatttcagctacgtaccgttcctgatatgaatacagaaagttgaacatctttagtggatcctgtgggaaatgaacagtattcttgtgtccaccactgatactaattttgctctatggcaatttgggcccttcacatccatctccttggccccaactc

SEQ ID NO: 67986 - DNA, 1181 bp, Homo sapiens
agaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcagg

SEQ ID NO: 67987 - DNA, 1048 bp, Homo sapiens
ttgtaagagggccggaggatagtgatccttcttactcacaaatcaggggccacaggctccctactacagagcagtgcttatgagccataacttgtgtttggaactggcaaagacattcattccttcgttaatatgtttcttacttctgaaggcaaaaataatgacttagtttttgcaggtgtaaaagattatgctgccttagaatatcccagaggataggcacagtgttctctttctagaatttgtttagcaataaaaatgaaccgatccttaagttaatcaaaataaagcacttgacacattttcttccatgcttttgttttatagggaggcctttgtcttttctatctgttcgagctcataacacttcctccgacatgtgcactgtctgttgccttcattttctcctggctggatgggctgagagaagagggatgtgggagtgccgtgtgtggggattagctgcgtagagtgctgaatatctggtgtaatgattcacaatggcttgtgtttctaggcagtggaccaatccagctatggcagtttcttctggaattactcactgataaatcctgtcagtcttttatcagctggacaggagatggctgggaattcaaactttctgacccagatgaggtaaggaaggaggggcttgcgagtactgtgttgaggaaggatgagagaaaactcctggaaggggtggcgtgggcctgaatgacgtgttccaggattgggattcccagctctgccacttgccacccggagcaagctaggtagcctgtctgagctccaggttcattatttggaaaatagagaaaagatctatgttaccccatttgtcttacaggattagctgatagaaggcattaacgtgcctggcagtaggtcagttatcacccatagagctgcctcctgtgacttagcctcttcctagcccggtggctctgtgagtgtgaaaggggccagacagttcaagaggccttgggagattggctcattagtttcttatttcattacacacatgtttatggagtagtggttccgtgcc

SEQ ID NO: 67988 - DNA, 1048 bp, Homo sapiens
cttcccctttctggctcttttttatttttgggtgcatgtctatttaaatacatacacacaagtgtgtgtacatgtgtttcttttttatcaggcgagtcaaagcattaaaacgactttcttccttgtgggactttctgtacatctacacagtgaggccaagcctgtgggtttgggctcagccatgttgtaactttgggtcgatctcctgtcacattgttttgaaattgcatctggctttgcatttgtgtaattgtctctttccctctccttttcttcattcttggttttggtccctaccacccctccaaccccaaactaatgactgtggaccaaaagtgacccttacaaggagacatgaggtatttctttctggctccactcttcttccctccctccaagttcaggccacagaaacttgaggggaagaccattttgtgcagggctgttttctgcatgttagaagtgctgcaaacagggcctatgcaaagggccaattgattctgagatgctgtgattggtctagaccgaaagcattactgttagctgattgttatttatactaaccatagtacagtattcacgggctgcattacagcgtacagagtgcttctatgccccacttatttgggccctaaggactgtctttgtacgagtctactcagtgggtggctgggtgctgccgcatcttctgttttgagtgctctgaggtctgtttggtggactcagatagctttggaaggagctcgccgaggcccttctcagaaaggctggctagtggacagtttagagaacacaggtttccctacatgagcgcagcagcataactgagtatctaatccagttggattctacccatttttggagaaaatacccgtaaatgaaggttcccagcaccagggttgtgaaatcgagctaaaatgaaagctgcctaccgctgtaaaccacaactctcaacagggttgcatttgcctcatgtttggggggttgccagagactggttctggcttggtttagtccccttgcttagtgggactccttggaaactcta

SEQ ID NO: 67989 - DNA, 1035 bp, Homo sapiens
aagtattcttttggttgctggtgtttccttgggagtggatgtaaaccttaagtagccagtagtgaccttgagtacctctggattactagggaaggggaggtagggatgggaagttgggcggtacacctgattatagcaagcatgaagataatagttttaagtttgctgttttgaatctgggcactaacttcaatgcttgccaggaaaatcttatcttgtaaagcaaatcctagtgaggtcacgaagtgtgtctcctcctccaattggggttcagcactatggcttggtgccctccatgtaccaatagttttgggtcaggcctaaggggtccttggtcttagctttgcccggtttgaatattttctctgctgttaactgggcagggtggcataggtggtcatcttattaccttctgttgcctgatgtgagaatcaggatacccaagtctggctttaccttaagccaccagatatggacacatgtctgcattatctttgtattcttctccaagaaggatgctcctagtgagtgagctgcctttctttgagagagagtgggaaagttaatgagttcacatttagaaagtactctggagtctttggtgattcaaggagtgttattaaattagtgggagatatgatacggagtggggatgctaaatacatatgagctccccaagggtgagtcatgtgtatgtgtacaggaaatgcatccttatttcatataagatcaagagttcaatcttacacctcccttgcctcctaatggaaaccaaacattcttcaaaactgctggatgcttgcttttctttacataactgcagttcagttggaggagtgagagaagtgaagctaatatttacagagagtacctactatgtgtcagatactttgcaatgtgctttacagaaatacataatcacattctttaaacaaccctttgaggttgatgccttaattcccattttgtagataagaaattgagtccagaattaagttcagataatttgcccaaagccatagagttttcaagtca

SEQ ID NO: 67990 - DNA, 1024 bp, Homo sapiens
tcttaactttgagaaacgtccgaccctattcatgtaggttacttactttacccatgtttctaatctgccataaatttttcttctggtaccaaaggtccgttggaaggaaagcatcaaacacccaaatgtgactttgtgtctttggtacatggtgttgtccaactctttcatttatatgcatttgaagaagagaaggataggaagtaattttttttttttttgtctttgacacaaatattggtgctaagcaacttaagagagtctggccttacagaatttctgaaacaaatgtagtttgagagggaaagatgctttcttttaggataaggcactgccagctatccttagagatgagtgattttggaggtgaaagtatatagaaagatctagggagaaggcagtgcaccctggaaaataattaatttcaagaacaggctcctctgttgtatctgattatcaataagtttagttgctgccccctgtggttaacacttctttgcctctgccataatttattgcttactttaaccctttcttacgctgcttaaactttcagcacaaccatactgatgttttgtcattctgaggtccttcagaaatattaataaagacatgtaggtcacgtcccctccctctgggtcccctgacattcagctccagggctgctgtgcacagaaggctgagattttgtctcctcgcaaggatgatggtggtgggagcaatgctgagagcgcagctggaaccatggagacatttaaggcacttaggcctacaattcagaaatgctgtttctatgatggttgtgtttgggggttcgaggaagctagaatgagttctgtttgtcagttgattgaaaccatatatagaagtgaaaagatagttcacatcaaagatataaactcaactaataggtcctttccttaagaacagcttgtttatatgtgttgttatgggtgtttatgggggaagagacagatttggtcatctgggaaatatcgtgtcgatatgtcagtccacataccta

SEQ ID NO: 67991 - DNA, 1051 bp, Homo sapiens
cacgtgttaggcaggtttggggaaatgtttctttcagcttttcacatttattttcctccaaccctggcacctgggaccagccctgccacctgtgcctaccgtacatggccataaccataaaggctcactccatttcagtgagtcctgaggtgctgacttctctgcacagcaagaggtcagtttttaactcagaaatccccaggggcccggctgatgtggaaaagaatttttccaaatatcgtatccccaccgtccacaaacgggaggagcccggggagtgtgccctcctgtcccaccatcctgccccctgctgtagttctcctttccgagagacccctgcccataccctatgccctcttgctctgggggtcctccaagggaagagcgtgcagtgtggagcccacctctcccacagaggccgcctgccaatgaaaaccttgctcacttggttgcaggccaacttaatccttcaaacttctgcagcacttggactgtttcacaactgacaaggatgcagggaaaggctgccagaccatgtgcgtgagtgtgtgtgtatgcacgcgtgtgtgtaatgtgtatgcgtgtgtgtgcactgtgtttgcatgtgtgtgcatgtgttgaatgtgtgtgcagatgaagtgtacgtgcatgtgtgtgcatgttctctgtgttgaaatgtgtgcttccatgtgggtgaagtatgtgtgttccatgttggaatgtgtacagtgcatgtctgtgcatgtgtgttgaagtgtgtccatgcatgggagtaagcatatgtgtgcacgtgttctctgttgaagtatgtgcatgcatgtgggtaaagtattgtgcacatgtgttctgtgttggagtgtgtgtgcacatgtgcatgcatgtgtgtgagtgtgtgcctgcagttagccccagggcgggtgaggggacccagtgcactcgggccagagctcagctcagatgcaggcaccagggtctgactgggactgcttcatctcaggccaggtccttccgcagcagaagccaaagggccaaacgctggtgaaaagtcctg

SEQ ID NO: 67992 - DNA, 1794 bp, Homo sapiens
cacacggctttaagtaactgagagcctaaagaaagtaacccagggagtccggtccagttttaatatttgtggatttgttgtcacacacattgtttagtcctgaaactaaaacctattttataaatagtagggttaattcctcgaaacaatttctttattaataaatgtcctgtgggtttagaaatatcaggtaaatatttgaatacagaatgatgattgcaattactgttacaagcgtgaaacacaaacttcagatcaaatctagagttgcttcatttaatgcatgctagcaacagccttaactttggattcagttatttgaaacacttttccggcatctttccctttctaatgttgtggggtggaaaccggatggcaaatcactgtgagccggatacctcagcacagtccaccttgtgtgtgacttcacaaatgggggacttcacaaatggggtaactgaatgttattactttcaaattttgacatggagcattatgatcaaggaaatggagctgccttatacattaaacccgtgatttaatcctattgacattttcatagccatgcctccagattttatctttttggcaaaattctgattccacagtttggtctgattgaaataaatattccctggacgtctggctaaaaattttgctaacaatcccagaggtgccattttcttattaataaatttcattggagccttatttcttactatattcaatttcgtttcaaacctgcaagtccctgggatggtcccacgactagggcctgcacatttcttacaatggcaaagcattttttaaaatttagggtcaggttgaaaaattctaggactaattctgtagagaggagggactgttaactaacgtgagtggggacggaggagtaggttaccacatttggagcagtaatagatgcaaacgatgtaaatttgaaatttgcccctttagttaaagaaggagcctgcaaagtccatttctctgttttcagccctgtcagtcacccatttaggatgttggcaaagtactgcttgagcagaatgtgtaagaaagtaataatgaaagcaaaagtatgtcagacagttacttcttccacatggttagaggcatgtgattttcagcactgtgtgttacagaaatgtcaggaatggtgtattataacgtgtgcaagataatgtcagtgtgcacagagggtcttttttccttatctgattagtactgttaatgttcaaagaataaaaatggttttacagtttagattctgagatagcaaaacctgatttttcaaccatgacctgcatgagagaagcatcctaggaagtcttagatcatacttttgagtttttaattttaatttatatagtgtttttttatgtcttaatatttttgtgaactggtgtaaattgttaatgcatataagcttgtgtatttttgtaaatagttttgtgatttatttcttgccccatatgtaaatatttagagtctcatttcttgcaaacttatttgaagctgagttgtgggtttgggttttgtttgtttctttggttgcagggtggggtggggggtggcaggggagggaggaagggatttttgtacctggagatggagatatcttgtggtttaaagcaaatgtcccactgaaagtgattcaaatatcaacagaattatttcaggttaaaacagactgctttgtgtatgtgtttcctttttgacctaatatgaattataatgagatagtgggggtgattgatttggggaattaggaccaaaggacacatgttttcatga

SEQ ID NO: 67993 - DNA, 1052 bp, Homo sapiens
ttaagtagctacgcattatctattattagactgcaagttcctgcaataactgcttagttcacagccccgtttcaccagtggagttctgggcagttattgctgtcctaaggcattactgtcgtttgcttactctatacttgtgtggtcacagtcttcttgtaattaccatctacaccagcatttcaggtatagctctttataactctggagacatgtaaaacatgtttaacacccacgagttttgaaagttgcattccttattagagtaggaactctctagcccaactccattctatgttctcagctccctccaccccccaaaatacatcagactagcaaggcagtcctatgtttacaaaacgagtttagattgtcatttcattccataactcttaataatactcaagttttatacattcacgtattttaaatgctcggtctgtagaagacactaggagaattgcattccaattactggatggttgctgctctggctttttagaacttgaaattaatttttatttagagcaaaggaggaaatcttttaagaggctaaaatcatgctgctattattgctgtgaaattgtataaagattaggattcatgccagtttttattttaaaaaataatgtgcattttaagggtttatatttagaaaaaaataaaatgtttcaagaacaacacattgatatgtggaaatattctataaggttttcttttgttcccttagaattcattggagggatgcagtaaaaactgtagtagaaaccttgaaacacccatatgtgaaaaggtctgtggaaattgaggcctctacattaaaagtgcagaaccaactgttttacagtcaaagtgctaggaaacctgataggatacttccctttggcacaaaaacaccctgggtgctacatacaggagtatgacctttggtgaatatgtggcactaattttttttaccttaatcatattcttgtcaagtaggcaacccattgccccttggagaccacaccagccctgtaagttctcaccagcagcatggagattaggaagag

SEQ ID NO: 67994 - DNA, 1050 bp, Homo sapiens
gtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataaccaaaaagattaaacaaaaaatactataaaacccctgaccacatttaaaaaatgataataaaagtaaacaaatcagcatctttttccccttccctgcttcattaccccctcttccatctatagactttgtcatttttgtctttagaaaagatctgaaggatggtaaagccccgtgctgaaacccagtagagaaacctgtctcaggacacacttgccatctagggctagcttgaaagagcctgaggactgcctttaactgaatttgaattcagcattgtcctttcttcttagtatttgctgcataattgagagcagttcacatcgatttcctggtaggcgtctgcattccctgttgtgttcctgcttctccttcagtagctgcacaacttgcgcagatcgacacactgttgtcacttcattctccccgtctgagaaggatcttgtgttcagttagagtcgtggaaaaatccctgatccttcaaggtcagtcagacagttggcaacattataattaaaaataagaaattaagactttaaattaaacatttggtagagtcatcataaaacaccagaccacttagactcaggctgaaccatactctttctattcttatttttcatccttgttcctcacggttcagtgaacaggctcatatcatgacagaatggacttttaaaagttagtacttaaggaaacttctttaggtggaagaaagtaaagttcttattgtcagtgaactttattagcaccagaaatctctattgatgcttttaatgcattgcctgccttcaggttttcttcttaccccacccctcaataagatttggtgaattgtaattctagtaaaacatgtcataccattg

SEQ ID NO: 67995 - DNA, 1105 bp, Homo sapiens
tgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggca

SEQ ID NO: 67996 - DNA, 1008 bp, Homo sapiens
aatgggaactatctcatggaaaccagccacagggcttaaaagtaattgttgtgtctgactcaaagataacaacacaccctgctgaaaagtgacatacctttggtaatagtatatttcatctcactgatatcttccccttcttaccttgtgggaattatttaatcctatattggttgctgcttgtacctgccccacaactggtggctgctctgcagatctctgggaaggcggagggggaaggggacgattagttctgtgcgtgcgctgaagtgtggcagcagcaaaatcagcagtggtgggttgttcagccacatcccagctggcttccttggtgctcatttgggctgttgctggagtagttgtcatgtaagtcatggtggctgtgctggtattctcttcgggggacccagaaggagggtagattttatcgctaggtaaattaggaggtgtgggagatttgtctgcaaattctaaagggtgatggagtttatccacacttgcaccaagataagaaggaggctgatctccactgtagaaacggggtggagactggtcctgatccaagaaggagacagttggcatactgttcttcccagactggtcttcagggaaacttacatgatcatcagacttctctgagtctaagggaactgaagtaattctggccttttctgggtccccagataaatatgcttgatgtggctgattccctgttaagtctacttggtgatgttgctccccagattcagttgtgttggaatgggtaggatccccagtagctgttgtctctggtagaggatggtcacagtttcctggtgcattattctggaggtggaactgctctgctggtcgatcggtttggaaataggccttatctagagcaactgcagagtaagaactggacagattatcttcagttgtagccaccgctatgtctccataatttgtatacccagcctgagaggtccctggtctcttcaatgactgagttgaggcttgctgtgcgga

SEQ ID NO: 67997 - DNA, 1012 bp, Homo sapiens
atcatctaagccatcctcctttactgaaaaggtcgtctatgctttctctccgaagataggacggaaattaagcaaatcaccttctatgagcatatctgagccaatttcagtgaccctaccaccacgggtgtcagaagtcattggtacagtctcaaataccacagctcagaatgcatcatcttcaacctgggacaaatgcgttgaagaaagggatgccacaaatagatcccccacccagatagtaaagatgaaaacaaatgagacagttgcccaagaagcatatgaatctgaagtccagcccctggaccaggtggctgctgaagaagtagaattgccagggaaagaggatcagtctgtctcaagcagtcagagtaaggctgtagcttctggacagactcagacaggtaccgtttgttttcctccattctttctttaagttaagagggatcttcaatcctgtgtgccatctgtgccttttaagagagaaatttgtccacagctagcctttaatcaaagagaatgcttttctgggtggtgctgatggctcagagccctaaattaaaagcagtccaacaaaactccccaaaagggccaatggtcctgcttcaaatcttcacaaaagtccccttatctctttggacggtgagaattcgtggataatttttgcacaactgcgtagctcttgattctgtttttctcttctaataaaatatctttattgtagccttccaagttaacaagccagctacaccatcaaatgtaaaaactgttcataataacagtctacaagcacttgaagcttgttttctaagcaatcttttctgagccaggtgagggacatgctttttttcccccccatctctgtaacaattcaagaagagattgcagtctttatacactgtttgttttagttttccttctgaaccagatgtgttttcaacagcatttgcatgtgggatagaagatcatggattgccattttgaaatatggaaggcacctattttttaatga

SEQ ID NO: 67998 - DNA, 1080 bp, Homo sapiens
tgaatatatatatatatatatatatatgttagacagagtctcgctttgttgcccagtttggagtacagtggcgcaatcttggatcactgcaacctctaactcccggtttaagtgattatcttgcctcagcctcccaaatagctgggactacaggcatgcgccaccatgcccgggagcataattttataaagtgtataattaagcagtttttatatttttagtagatacggggttttgccacttaggccaggctagtctcgaactcctgacctcaggtgatctgcccacctcagcttcccaaagtgctgggatcacaggcatgaaccgctgtgaccggccaatatatttatatttattaagatagtttctgcctctttaaattactttttaactatggcaattaaaataatcctaatagaatagagagtttcttttttaccagttggatatttagcaacatcgtaaaattatgtaatactctctgccactcttgaagactgcttgggaaacttaaaacctattcttaaagaaaaaaatgaagttcttgtttagtatctgaaaggaattttttactaaatatatgtaaatactttatgggattatgaagattttttaattgagaagttcaatttatttagaaatttgaatattgtaaggatgtttccccacaaaaaaaacatccattttgctattatagattcaaaatgccactcaaagtgattaattccacctcataagtcatatgaggccagtgataaaataagacacaaagaaatgaaaaacttgcccaaagtcacaccaagaatcagtgttggattagtaatagaatccaagcattctgagttcttttcctctccagaccatgaaatactgcattcgccctctgattctatcacatgtttgctatttagcatttggttttggagttctgttatctcaagtgtaaatgatctgtgtgcactgaaagaattttcagaaagaaaatgagaagtaacacttccttcacctagatagtaagttactgctgtgctgagtaggtgacttaccacagcattctgtatctacgatgttcttactttg

SEQ ID NO: 67999 - DNA, 2469 bp, Homo sapiens
gacacttaatatttcctattcccagatacgtcttattttcacttatttttcagtttgtgaggttggatccaaatatgaagatatatataaaaatgatctttgtgaaaatatttactagtactaaaatctgcatgtttactatccattttctgctttggctgcactgtgtagagtgtgctgtctggaaggtggatgtttgcttactgtttcacttatgcttctccagcctgtttggttctttctgtcatgtgttcatttcttttctgtaagaaaagacagacccatggctatcttaatgttgattattttttctctttcatagaaagaggcctcaaaataagatgaaaaagtctcctgtgggtagctggcgttcctttttcaacttggggaaatcatcatctgtttctaaacgaaagctgcagcggaatgagagtgagccttcagagatgaaagccatggctctgaaaggtgagtgcctgggagattctcacttctgctgctgtcatgatggtcttcggttgttctgggcacgttcttcacatattgttatgatctgcttccataacgtgttcacagttgtgtcacacatacagagtgtcttctctcaccgattctttattcctaaattgaagagtaacataaattatatataaatatgtagaagtatgcaatttcttttcttaaggaaactatatagattatatatagtgtaaatgtgattaaattcacatataccttgtatattgttgtaaataaatactgctatggtatctaaatttattgatctgtatttttacagatctaaaaaatttcaaaactgtttcaacataactttcaagtttataactcttttaactaaagaaggtattttttattagatgtctcattaatagagtatcttattagatcaaataaatctattactgtcgaaaaagtactcttttaaaaatagtttaaaagccatattctattgatattaacaacttctgaatctaggaaggatagtagtacttcttagataatgttagaagtataatgttcaattcatttaattcgtcattcagtttgcaatcatgtagagcatgtgctagctattttgatagcaggctctgcagatagaaaattagggtagtacctctgccttccaagtcaaattgggaagtcatacgtgtgagaaagtaaattttagtgcagaatcatagttattgaaatagtggtttaggctaggtacagtggcttacacctgtaatcccaacactttgggaggccaagtcaggaagatcgcttgaagccaggagttcaagaccagcctgggcaacaaagtgaggccctgcatctacaaaataataataataataataataataataataataataataataaattgcaaataagcgaggcttggtggcacatacctctaggcttagctactccggaggctgaagcaggaggattacttgagcccaggaggttgaggctgcagtgagctatggttgtgccactgcactccagcctggatgacaaagcaagacatagtctcttaaaaaataaaagaaatagttacatgagacagttgtggtaggaattgtcaactcttgtagaggagggactagtggttaggaaataacaacctttgatatgggttttcaaggagaagtagggattcacctaactgacaggagactaagaatggtatttcaggagatgggagcagagtgaaaagaagccagctgagggctgaatgctggagagaagcaatgtttaaaggtgggaaaggaagaattgtcatgagaggagagtaagaagaaatgattacaaaggtaggcagagaaaaaaagagatgcatgctatcctcagcaggggaggagggggttaaaaagaaagtgttcgtagtgctgccaaggggttaaagaggatgaagatatttagcgaataagattcacatatgtacgtaaagttacctgtgttagtatcccagagttcccataacaaattaccacaagtcaagtggtaaaaaacaacagaatttttttccctcatggttctagaagctcaaagtctgaagtcaaggtaccagcagggctgtgcttgctccagaggctccagggaaaaatccttccttgcctttccaagctcctggtggctgctggcattccttgatgtgtggcagcatccctccaatctttgcctccatctccacatggccatctctgtgttttcttacgaggacaccagtcattgggtgtagggcccactctaaatccagtatgatgtcattcaagatatcatattggtctttaggaaatgtaaaagaaagaagcatcttagttaatctctctgctcaaattcataatcctttagaaaagagatttttcacacgggaaaccatttgagaacagtataacacattatataatagagtactaaattgctgtcaaaatgtgcagtataacacattatgtaata

SEQ ID NO: 68000 - DNA, 1050 bp, Homo sapiens
tggcatgatcacagctcactgcagcctcaaccttcctgggctgaagcaatcctcctgcctcagcctcccgagtagctggcactacaggcatgcaccaccacacccagctaattgtttttacactttttgtagagatggggtttcactgtgttgcccaggctggtcttgaactctcgagttcaagtgatctgcctgcctcagcctcccagactgctgagattacaggcaatagccatcacacccagcccgttgtctttagtagttttactctgggcactattaggtaggacgctttgagacatgctaggtgatagataatacctctgtgtgtgcatgcgcacagacacacacacacacacacacacacacacacacacggcacttacctggtttaacttacatttaaggtgatcatgtcttgttttcaaaagtactcttccctattgtttaatcacaatatatgtggaattgtttaagtaaagcaaattttaagtagtcaagataaaccagaatatgaggatttgaattaggctctttatttcaaaagcatatcctttgctcaaatattctccccttgatgcctattggaatttttcttgtaactgttttaaggcttttgagacattactgttttctttcatagaagtgttgaaatcctttcctgttagtatgtctgctgcaagtagaatggcataacttcaaaatattatttgttccagaaactagctttggtggaagattcacttctaatagtaatatttcaacctgttaagcaggaaaaaaaagttctcttgggtttgtatggtccctttcttcattttgctattgcaaacttaggaattaattagcaggcttttatgttctatactgctgcatcatgtttctttctgttaatatgttgtattttatttccagaacactggagttcctgatgagacacttgtctcttctagctgactattgttccatcacaaatatgcatgcaaaaaatctagcaattgtttgggctccaaacctgttaaggtaatttgcatttcacttattaatttt

SEQ ID NO: 68001 - DNA, 1209 bp, Homo sapiens
ctttatgttgtttctgacttttttatcctgcttcgggaaagcatttctgtgttgtacaatctgtatctgaggaatttctgctcataattgttcatagatcaattgccattcaacactagtctctggaattgccaaaatattggatattcaagtcattagcaattaggagtcctgttttcagactgttgtactataagagctgttcattcatatgtatctcagaggctattgtccattttaatattaaagctgtgcccttaatttccacatagaaagacatctatcttgtactaagacatccagttgttgctgaagtccaaacacaacttaaatgaaatataattaatggaagataatagcaactcactgagatagagctgaacacttttggagcttatgctttctgtttttaagacacatatttgctctcctcaatcaaatgatttgcttgtcctcttctgtctacgtcagccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgtgagtacaggctacttttgaatctaattctttgtggaactttgctgtgcttttgttcaaaacacatgaactttggtttggtcacatgtaagaaatagttctgtgactgaaatgactccttaaaaaaacaaatattgccagctagtcggtggtctttgctgttttcacattgtcattcttgtgctttctgactttgagctgctagtcttgtcacacttaatactgatgaccatcaagcctttttaaaattagtttcgtagatctcagtgttcacactgtgtggaaacagtttacttcctgaatacaatgttgtgtttcctcgccatttcacatccaagagcaaagcaagttgatctcagagtgaaaactgaattgtaagtgaactttcatttttactaacagagctcactagtttattttgtactgtgactcttctaggatgcagtttcagcagcaacagatgaagaaaggctgataaaaatccacgatgtcatccagcagctccccccaccacactacaggtcagccacagtgggtaaataccaggcagaggtagaagtcggttgacctgtaaacgtttttttttcctttgg

SEQ ID NO: 68002 - DNA, 1050 bp, Homo sapiens
actatgaaaatatagaagatccttttctagaagcaaaactttgtagcacttacaagtaattatgttgttgggacaagcatttaactttatatattcatttgctatatatgaaagtcagctgaacagctgtatttcttaaaaatctggcatggtgttaggactaaacagttcactttgctgtaatgtgtaactgtaacatgatctaaatgagtctactgcagaagaaagactgtcctaataatgtatgaactctcttactcacttaaatatcatgacatagaaccagtcttgattattcaggaattagttatctaatttaggtgggcaattaaataaatataccctcatcattttttgtagtggattaatttttgctccttttaactttaatttacaaattttattttacttttgtaaactaagacaatcttattttttggcaactttggttccagtgaatactacaatttcatctgtttctttacaaattctctttagtgccgcaggttcttcaaagctgcacagcattcattgagagatatggcatcgtggatggaatctatcgcctttctggtgttgcctccaatatccagagactacggtaaaatcttatatggcactttttcactccttcttaactaattaaaatgcaaatattttaaaacagattcacttactttgataacctattttcattaaagataatttagataaaataggaaataatatacatgttattgtctctgtatacttttctaaatggcatttttttcatctgtagtatcagagaaccatgcaccttaatctcttcagtacttgtattttgcctctttatagtgtttgaagattttaacaaattgagtttgaaccgatgacagccatgagagaggaaatttgcattataataaaattattctttaggtgttaattaaaatggatgggaatggaacattttctaatctcctttgaccctgattctgtgtttatgttcaagtatgcatctctacatatttcacatcctccccaaatcttctctgagacaaaaacagt

SEQ ID NO: 68003 - DNA, 1058 bp, Homo sapiens
ctccaggttcaaatgattctcctgcctgctgagtagctgcgattacaggtgcccgccaccacacccggctaatttttgtatttttagtagagacaggttttcgccatgttggccaggctggtctcgaactcctgaccttgtgatctgcccgccttggcctcccaaagtgctgggattacaggcatgagccaccatgcctggcctaaactttttcatagatgaggaaaatgaaatactgagaatttaaatatttctccataatcataccgttaggagctgcagaggcaagattggaaccccagaggtctgactcctgagtctaccctttgcaaccatgctaattgcatttctgtacaccaataataaatgattagaaaatgtaatttagaaaacaccattttataacatcaagaaagtcataaagttcctaagactatctacaacaaaagttcgtaagacttttatgaaaggaaatttgaacaatttattgaaggacataagcaaattgtaaataagtggagagatctattatgttcatggaaaagaaagctcagtatcataaagaagtctgtcctccaaaataatctataattcagtgcagcttcaatgagattccaaaaagttttttttctccttctaatttgacaagctgattctaaaatttatgtgaaatgggaaatggctaaaaataaggcagttttagaaaataatagtgaatgaagggactcatctttccagttaagacttacaaattaagaaagtgaggtattgatagagagaaatgagacaactcagaaacagacgtcttacatgctatatgcatttttcacgtaagatagaatcagtcttacaattcagtgataaaaaggttattcgattaaagatggcagaatagttgattatacatatggaaaaaagtatatatctctccctaaaaaacatgaaaaagcaaaagtttttagaagaaatagggcaatatgtttatgacttataaggaaaatctcttgaagtacagaatgatttctgtacctaaagacatttaaaaatttgtgcaataa

SEQ ID NO: 68004 - DNA, 1015 bp, Homo sapiens
aacttcatagcttaataaagtgcagaggactgtgacattaaagtacatgtgattacaatttaatctgacaaaaatttatctcaaaagagagtttttacaccattaaaattaaggttctaagttttccaatttctagaactaatgtatattttggtagtcctgttacctttgatgtacctgaattcctaagaatttgtgtgtgttatatttaatttttgtaagaatacacaagcatgtcttcctgagatagtactagcttttaagcttcttatcaagtagtactagttcatcctggaaaaataagagcccagacaatttaaaatttcttagcaggttttaaaatctatattctgtatataatatcccattccaattttaaaatactttaagtgtcaggaatttatatctacttcatgttttttcctcctgcttctggtaaaatgcaaatcttccttttctgtttttagaaatgaaattagtcatagtctcttatataataaccgaggtggtaaagtcagcaagttaaaaatacttcttactttgattttgtaccaagtcgagaaacagaaccaatcgtatttattattttaaatttgtaatttaaatttcgaaataaaaattagtatcacttttagcaggaaaaaggtgtaacttatttatatcaacctaaaataacataatctaaatttgaaccttctttgatatttataactgaaatctgtagcttctagaaaagtaagtgtgtaatgtagataataatagtcttatcttaaccgtatgaccattttcccaagggaactatgatttttaaaggtctagcatgagcaggttctgtgttgtaacagtttgtgtactcctctaggaagggcagcagcatagtgatgttgctttggtttcatctttaaccctggagaagagatacagttttattcaaatatcccaatattttagttaaccattggtatgccattcaacatgagttgtgctggatattctgaagaagcagtttgtggcc

SEQ ID NO: 68005 - DNA, 1223 bp, Homo sapiens
ttattttaaaggagcctaaagtgctatcatttttattggatacactgtctcccacctacttagcaaacaactgaaaagcaattaacttttaaaaagagaaaagacataatttaatatcaatttcatactggtgttttctgagcaggaagtgctcacctgtgtggggttgatgggtggagctcttctggtgaagcctgttctgcaagtgtgagtttaggctggggcgtttctgtggtgttgcaaagcagtatgtgctgagagaggaggattaagctcctggaggcagagctctcccacacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgatgaatctactgctaaatatagtcatttggaataattttaagtattgatcttaaaacttgtaccacaacaagaggtaaggagatctcaatcagtcatttaaatatttgactcaagcaacattcagaatttttcactgaaactatgtttagattatatttgggcacatgttaccttggttgctctcttaggtaaatggttaattatttaattatctagaaattcagcacttgaacattagtatttgtcatgtttgtcaaaaagtttatactttttgaagtaggctttgctgattgtacaacacagatgttcccagtcggtttcaagaaatatctttttttctcctatttccaatcagcttatttcttgttttctatacattagtttaatataataaaagtttttatgattaaaagaacctgcctttatttcttaagcagccagcttatatcatctttttaatttttttcctggtgggttaataatatttcaattattgattaatggaaatgggcagtgctaatgcacttaaaataatttggtagactgtgtaaagaggctcctcaagtttgcacgaagaagtaacctttctggccttttcccttcaagtatggttcttccccgcctctttggtattggcattggtaaggataaccatctccatccataaaatattttgtattaaatctcagagattttaccactaaggtggtgttccgtatg

SEQ ID NO: 68006 - DNA, 1258 bp, Homo sapiens
gtttcctaaacccatatgccctttagtcagtgctgggagtagccccctaatcagtctttttcttgccctgagtaaagaggcttttccgcttttggccatttccgatattcattcattaattgatcaagaatttatcgagtgcatactaagtgctatggctaaaacagtgaacacaccagacagaaattccaccattttggtgtttgtattcacgtgtgactagaaggagagcagtaaataaataaataaacaatatagtatgatagataagggcaatgaagagaaataaacctgagagacggatgccaagactaggaaatgctgagaagtggcttatgtggggttataattttcaagggagggtagggtggtccgggaatggctcattagaaacctacttttgaacaaagacctgaaggagatgaggaggggagatctgcatgtaatctggaggaagagctttccaaagacggaacagcaggtgtaatgataccgagttgaatgtgtgtcagacttggtaaagggtcaggaggaaggccaggttggctagagcagtgggtgaagacataagatgaggtcaagaggggagagggatcagatcttctctggggcctgggtgtcaccataggggttttggcttttattcagaattagttgggtaggcagtggaagactttgagcagtttttgtttggttcttgttaagaggatcactttgcttgctgtgttaagaggaaaggcagagataggtagaagaagaggggctggcagtggctgttgaaatgagccaggtgagagatgatggtgacttagaccagtatggtagctgtgtaagtgatgagaagtgatctgcttctggatatattttggccatggagctggcagaatttgcagacatgctgtgaagggattgaatcatccaggtaattttttttttttttttttgagacagagtcttgcgctgttgcccaggctggagtgcagtggcgtgatctcggctcactgcaagctccgcctcccgggttcaagagattctcctgcctcagcctcccgagtagctgggactacaggcacccgccactatgcccagctaattttttgtatttttagtagagatggggtttcactgtgttagccaggatggtctcgatctcctgactttgtgatctgccctcctcagcctcccaaagtgctggtgttacaggtgtgagccactgcacctggccttttttttttttttttccaagatggagtctcac

SEQ ID NO: 68007 - DNA, 1163 bp, Homo sapiens
ctgaaagatacagctatagtttgagactgaaaatttcaagttcctatactattacacaacaagggtaacataggaaaaatattctctttgaatctgttcttaaatgttattaatatgttcaattatttgtgtgtacagaaaattaatcaccatatcctgaccaagatagaaagtacccatggtaccttaggaaaaagaaggtaagagtttgatagagagagagagagagagagaggagaggaaacaaaagagggggaagcttgtctataagaaattgtcattttattcagtcaccctagggcatgatatagtggaagatgaggtctaggtggggaaaggtggaaggggaagcacatgtttttctttgtgtttgttttgcttgcaagtcactgaggagctatttactgacacttttcttgaaggctttatgttcatagctattctcttttcagatatttctttttccgaattctctttctcctctcctttacatatcagttacattatttgatattgtctcacagatctcagactctgttttttctttttttttttttactctgttttctttttcttctttttcttttttttgagacagtttcgctctgtctcccaggccagagtgcagtggcacgatctcctgttttctttttttctctctctcttttttttttttttttgttttcagtttggatactttctgttgtcctatcatcaagttcagtgattcctcactctgctatgtgtggtcagtcttctcttaaggccacctaacacattcttcaattctcgtatttttcttttctcgcataaagctaaatggtctttttacaataattgctatgctggaattccccatctttttgcatcatccaccttttccaccagaaagaaagaaagaggaggggtgggggatagaagagagaagagggaaagagtgggagaaatggagaacagagaagaaaagcaagcagagcttattttgaggcattaacttctggaaataaaagactagtgatttaggcaaccttccctctgaggacagttaaaaaattttgacagaagtataaaaacatatctttgaagcattagagagttaataaaactgtaagcaattattgtgataaggtgatgaaacagaaggaaatctgaagagtgacccc

SEQ ID NO: 68008 - DNA, 1059 bp, Homo sapiens
ttgaatttctttataaatatattcaattctttttaatgctattgtaccgggaattttaacatttcattttcttattgttcatggcaagtccataggaatataatttttgtatgttgatgttatatcttgaagccttgctgaactgtttattagttctaatagtttcatagtggattccttgggattttctatatacaagattatggtatctacagtagccactttttacttcttcccttccaatctggatgtctttttattgttcttgcccagtggtccttgtgagaacctctaatacaatattgaatataaatctcaagtacaagcatccgtgtcttgttcctgattttaggggaaatcatctagtcttttaccattaagtagctgtgggggtttcatagatgtcctttatcagggttgagaaagttcccttctgtttcttgtgtgtcaagtgtttaaaagagtgcaggaatttttccaaaggcttttattcatctgttgagattataatgggtttttatggtcattattttgaagttactaaaattcaacatcaaacatttaatttcctgcacatatttttatccatctttctgtggtgtaagcttaacttatattagttattatgtctcatctttgatagtattgactcagatgtactataaattgggtttttaaaacttagcctaatattggcattaaaataaactgtgttagtatcaatcaagtgctttctctcttttttttttttttttttttttttttgagacggagtttcgctcttgttgcccaggctggagtgcaatggcgcgatctcagctcactgcaacctccgcctcctaggttcaagcgattctcctgccttagcctcccgagtagctgggattacaggcatatgccaccatgcccggctaactttttgtatttttcatagaaacgggttttctccatgttggtcaggctggtctcaaactcctgacctcaggtgatccgcccacctcagcctcccaaagtgctgggattacaggtgtgagccaccgtgcctggcccattctcatg

SEQ ID NO: 68009 - DNA, 2651 bp, Homo sapiens
atgtcccatatcccctctcataactgacttgtgtaagaaaaaaaaatgaagatttttttaagttgactcttacctggttctaatcagtcttggaagcatttctacttgttccgtaaaataggaagttgagtagaatatattaaagaatttcaccagtaaaacaaatacctaaagcatcattttggaaggcagtgcataggaatcccaaattcacatcttgtgaacaaaactgatagtctgataatgatacctcatctctacacaaaataaacaaaattagccaggtgaggtggtgcatgcccagagtcgcagctactcaggaggctgaggtgcgagaattgtttgagcctgggggatcgaggctgcagtgagcctagattgtgccactgcactccagcctgggtgacagaatgagaccctgtctcaaaaacaaaaaacaaaaaaactgataatctgttaataccccttttcagctcatgataactggtttatatcttcacaattttaacaactaccatagaatatggatctagaaattgaaataagaatgtagcaaatgagtatgtgaaaataatttcacacagatggaaattatacagctcagaacttggtgatgaatcatacccttggaaaactattccattcttccccagagtctgtcaacagagggatacacaaagtgatggagctttcatatttcagctttaacatctgctgcatggcagcccatttatatttttatctaaggaaacatctataaatattgataaagatttcctctttgcttttgtttccaggctgtttatctcggtatttatccttttggctatacagtatctctggatgatctggaactcagcattttcctaatacggcttgttacaatgccaaaagcaatgcctgcggttctgctactaggtcactgtggtgtgttcctcaaagccagagtctgttgacactgctgagattggctgttttcttctctcttactttccctcttttccatgcgctactagtttttaaaagcagtgaataccaggattttaaatgagagattattttacacatttattttagtcatgtctttttttttttttttttatgaaacctgggagagagtgaagagaaaattcacaaaaagtttgagttgtggcttagtgttgatttaaaaaacccatagagaagtcaataaacataagttggcaacagaggtatcaacataactggattgagatttcagtaaagcgcattattaaattataaaattttacctacttgcatgcatagctcattgtcagactaaatattttaattcatgtaaaaaaagattgggaaattaaaaactaaaaggaaaaaagcagacttagatatttggacaaataaaacagataactttatgtactcatagcaacagattgttttattatttgtttgtgtaattggcatcatctgttatttagagtcttggaataatagaatcatttgggagggactgtagaatacattactggaattcagttggcagtgttcacataattggtctgtttgctggtttagaatcctttctttgttgcttttcatcaggtgggactcttccctggacactgtgttgagttaattaaccaaaaagttccccagtcagtgaccaactcagtgccaaaaccaggtgagtacacttttttcactagtgtagttattttatcaactgcttgaagacacagattttctgtcagtcaagtatttagcttgttttgctagttttgcatttataggcataataattaacattcttaattttatatggttttgatttttaaatgtattcttatatctctgttgatcattttgaaaaggtttacatgcactcaaatttttaggcaattgctccattaagctttgtcattatttacttttatagttgcataatagcattgtaacttaatgaataaaatgatttaaaaaataggtttaaagaactaacatagaaattgtaggattaactgaaaattaataaatgaaaagtaagtatattttaacagggcatatgaacatcaaaactattttaaacagcatttcttattacttatacagtatacttacagtgctgcataaatatctagaatatattacaaataaagcattgttgaaggggataaaaatcaagaaaatgtgaatttcggtgtttattgaggtgatttagttttgggaagattcaacagaatgcctcatctgaaactttttgatgatgtcgattaaaaaaaaattcaaacaaagtctaaaaagctttggagagaagagggagtcatccaacttatttttcctagctatattacatttcttctgtcctttcccacctcccaataaaaggagaagaaaaaatttctgggcctcagaattaatttgaactgtttaccttatgatagtattttctagttttaggacctgtatgtaagagttaagaaaaaaaaaacagttattctttactcttttggtattttcccacttctgctcccaaagcttacatccaacaatctttgctaatagtatttaagtaaaggttaataatacctttcaaagcttatttcttcacaggagactagggaatcattgttcccatttctctcattggaatttgtttattttagactaac

SEQ ID NO: 68010 - DNA, 1025 bp, Homo sapiens
gcagagctgtgtttacatgtgttgcggctttgcctgaatatagggagtctgggaaactgtctagtttagctagtagttagtgatattacacttatgataaagtaaaacaagagggcagggattggagttaggtattaggtgagcctactgtagatctacctctgtatagtatgcagtggcatttccccatatacctaaacctaattcattgtgatgaatttaaaaggtgaaaatgtaactaatgtatgtgatatagttccctgagaagtgcattaagctctctttgttcagtctttgtgggaagtgatggaaaacttttttttttttttgccaaaagatactcgaacttagaaactaggcagttactttcacataaactctttgaggtataggtagtgttatccctaacgttacaaattaggaaactaagacagagatgttaagcagtttgccatagatcacagaacctagtaaatgggtgagccaagtttagaatctggacttttctctcaggcagttgcagattttatatattgaaatgaattagaatgttttagaaagaatgatatttgagagtcaggaaacttcagcagatatatccaaaaggtggcattttgtgtaatatccatttgatggaggagctagagccctctagcagttctggtagccaaatactgggataataatagcatttacttatgcattaacccatttatgcttagtgttccattattggaacgctaagcttgtgggagttatttatatcttactgctcaaggtcatcgccaagttctgatttttcacaaaaaaattttgcaacctctgccataaatgggttaaagctttagaaattgccacggctgcagaaagaataatgtacgaaacaggctgccgtagttaatagatcatgttgttactagaccatttagttaacaaatcaatgcattttactctatgcattttatttatactagcccatttaattctcataacatcccttatgagataggcattattattaccat

SEQ ID NO: 68011 - DNA, 1817 bp, Homo sapiens
acatgcacatgtatgtttattgcagcattgttcacaatagcaaagacttggaaccaacccaaatgcccatcaatgatagactgaataaagaaaatgtggcacatatataccatggaatactatgcagccataaaaaaaggatgggttcatgtcctttgcagggacatggatgacgctggaaaccatcattctcagcaaactaacacaggaacagaaaaccaaacaccacgtgttctcactcataagcaggagttgaacagtgagaacacatggacacagggatgggagcatcacacatgggcctgttgtggggtgggggactagggaacggatagcattaggagaaatacctaatgtagatgacaagttgatgggtgcagcagaccaccatggcacatgtatacctatgtaacaaacctgcctgttctgcacatgtatcccagaacttaaagtataataaagaaataattaatttttttaaaaaaactttcggctctttggaagtcatatttactagtacagaaagacaaaccacagactgggagaaaatatttgcagtgattatatctgataaaggatttgtatcagaacatacaaagaactctcactgggcaagctcagtagcatgtgcctgtagtcccggctacttgggaggctgaggcaggaggattgcttgagcccatgaatttgaggccagcctgggcaacatactgagatgctattttttaaaaaacaaaaactctcaaaattaaagaagaaagcaattcaatttaaaaaataggcaaagattggaagagatatcatcaaaaggatatgtgaatggcaaattaatacatagatatccaacatcaatagtcattcgagaaatgtaggttaaaacaacaatgaggtattgattcatacttattaaaattgcaaggatgtggaagaattggaattctcatacagtgctggtgggaatttaagatgtcacaactcatttgaaaacagtttagcagtttctcaagttaaacactcagtaagtcatcacttaatgttgttggttggttcttggaaactgcaactttaagcaaaatgacatactgtctaatgaaaccaattttatcattggctagttgatataaataagaattaagttcccacagcacagagtaagtcagttcacagtttccaatgtgaacatcaatgacgttaagggaggaattactgtacacttaccacacgatctaactgtttacagaaaaagcatgtgtccatatagaaactcatacatgaatgttcatagcatctttatatgtaatagtttaaaactggaaacgaccctaatatctgtcaacagcagattaatagacaaatggtggtgtccatacaatagaatattacttagcaatgaaaggaatacacagttgataaatacagcaacatgagtgatcctcaaagatatgctgcatgaaagaaggcagacaaaaaagagtatattacataagacttcatttatgtaaaattatagaaaatggaaagtaatatatcgtgataaaaagtagatgagtaattgcccgaggagcagtgatgggaggatagggggaaggaaggattacaaagagatataaggaaacttttggggttgatggatatattataatcttgattgtggtaatagtttcatgggtgttttatcaaaatgtacattttaaatatgtgcagtttactttgggttaactatacctcagttaaggtggaagcaaaaactgcaggagcattcttgacttcatgttgttcatgcatccaatccagttgatcatatctgtctcttctac

SEQ ID NO: 68012 - DNA, 1052 bp, Homo sapiens
gcagtgaatgagagtttctgctgttccacatcctcaccaacatttgataattgccagtttaaaaaaaatagccattctaataggtccaacacataaagttagtttgaggaatagtgtttaccaaatgtattgaagggtgctgttctgctctcttcattttgttaccagtaattctttttattctccctttgccactgactcttaaacttgaatgtttaaaggaggctatgtttaaatatcaaatcccagggcctaagccctacagttcgtttcagtcgttgtggggtaggatctaagactattttggtccatgtgtgctgcaggtcaattctgctactcacctgcattttgccaagttctattctaagtattgcactagcccagaccataatttagccgtgggaacagaaggataagttcatccatgtgtttaaattatactgtgactctctttcttttcttaaacttctgggagtaggaagtgtgaaattatattaactacagtaatttgaaattttgaaatctgtgttttttatttgtcacctaaggagtatattgaatctctcatctttgttgtctgaggtatttcatcatataatatacttcagaaagtaaaagtaaaaactcttcccttttttttatttttaaactaactggcattattaatagatttgtgttcttgtctgtaaatgattgttagaaatatgaggtgatacctcagaaaacccttttttctaggtaaaggcattacacaaatacaacatgttaatatattttaggattgtttgttatgtgcagtgtctctcagagttttagctaggagccattggtatctgaatgagagaaacgtgataaaaatgggtattgatcatcagaatctcaggggatggggtcaggagtctgaattttaacaggtttttcagatgattattatgcacagaacatgagaactgctgatgtaggctcgcactgtttatcttgtgtgcaggtaaagggagcaatcagacacagtttagaaattgtgttttgtttctccctcccctcagaaaatc

SEQ ID NO: 68013 - DNA, 1014 bp, Homo sapiens
ggccaggcggggaacagcatgcacctcggtcagccagctcgcctggctctggttacatgtgaaccctgtcaactgggctccggctgcagaacacggaggaggctgtgcgtcacagaggtggcagtgtcttccctagcagtgtaaaggaaacgagggcctcgtcttggtgttggctgtcaccggtggttttcctagggattgagatgacttagtgcaggcctctctcaggagagaagggaagaggagcaaggatgtgggctactgcttcccatgatggaggctgagtgagctgaggtgtcaccctcttgagcgctgctgcaacactttctgaagctcgttgttgacacccaggcccgatatgtctgcatttgcagctctgctcagctcgatgtgttcatggcatgtgatctggactccagttttcttttgtcaaggtcacactatgtgtgtgtgatctcctttctggccagctgtcagggcatgagaaggcacaagtctctgtgcagtggtccttccttaatattgctgtgaactcatgctatatagtggtggtattgtgattttaatattttaaaaatagagctggatgtggttcctcatacctgtaatcctagcactttgggaggccaaagtgggaagattgcttggaccccggaatttgagaccagcctggccaacatggtgaaacctcatctctactaaaattataaaactgacccaggcgaagtggtacatgtctatagtctaagctgcttgggaggctgaggcaggaggaccacgtgagcctggcaggtggaggttgcagtgagccaagagccagaccttgtcaaaaataaaaataataatcaatagacttgatttttgtatagttacagatttacagaataattgagcagatagttcagagtttcatgtaatacccctgcccactcccctcacctataccttcccgtcattcacatttgctttacagtacattgaatagaatcagcaaaatgctgatctttaccaacc

SEQ ID NO: 68014 - DNA, 1301 bp, Homo sapiens
taactgtacatcagacatctttccacatcctgattttcaagtttaactgaaataatagcttagttcggtggtttttatactttttcttttaatccagtggaattactaatcaaacagaatcatgcgcagaacctcagtgcaagaaaaagtaaccatggagctgccctgattggtttaagtgggaaacgctgggccttatccccatgcagcccacctggctggcctccttcaggccttctgcagcagccctgaggggcctcagtaggggtgaaaaccatgagtttagcttactagtggacctcactttgtgtagtagatacatcaaaagctattttaaaattttaattttgaaaagccagccaacagtctaaagttaatagggaaacatgttctttataagaagatttttcatgactcctgttagaaggataatatctagagttataaaatttctctaatgtaaattatgtctgaattcctggtacttcatatattctgatatggatgggggatatcatatattcatatattctgatatggatgggggcaaataatcacatatatatgattgtatatgagatatatatatatatagagagagagagagagagtgtgtgtgtgtgtgtgtgtgtgtgtgtgtgtgtatatttttttttctgttattgggcataacagatgacccactgatacttctgccagtgggagctgtttctaggatttattcatcccttaattggtctgttaggtactgtgttcatttgctagggctactgtagtaaaataccacaaactgggtggcttaaaaattaatagcaaatatattttcctacagttctggaagctagaagttaaggtaccagaaggtttagtttttttcaaaaggcttctctccttggctcacagatggtcactttcttgcgtgtccttacatggcctttcctctctgtgtttgtctgtgtcctaatcccttcttcttgtaaggacatcagtcagattaggttaggggccacctcatttaacctaattacctctttaaaagttcccatctctaaatacgcagttaatccatgaacaacgtgtgtttgacctttgcgagtccactaatacacagatttttttttttttttttttatcaaacgctattgaaaatacagtatttgtgggatgtgaaaccctcatatatggagggcaggcttttggaatatgacgtgggatttgagtatgtgtggatttggctatatgagggggttctggaaccaatcccccagctatgttgagaaatgactgtagtcgcatcctga

SEQ ID NO: 68015 - DNA, 1085 bp, Homo sapiens
ttatgggactattgtttacctcacatgattatcttgaagattaaatatgtgagaataaaaatagaacatgcttattagaccaggtctgatgtataatttttttttaatcaataagtgttgatttttaaatttaaagaattctggtttttattttacaagtttaattttatctatccctttccctattatgaaagcatctatagtaatttaatttggttgttaagaccagaaaaaccctatcacattaccccagaactcttcttgtttgtgctattgggatccccctccatctgtgctctgatttcttaccagctatgaataagtgcttttgattaaatataaaactaaatagaagactacagttatctttttcctattaaggagtcagttcttcatgttagtggaaatgaacaatagacttaagggtctcaaagatgatcaaaagattaatttggctttaaaataatagttatgttgtggtcttgatgttactactaactttcttctgtctgtctgtctgtctgtctatcttatctatctatctatctatctatctatctatctatctatctatctatgtgtaacaccttagggaagtcatttgctttttttggatttgagtttcttcttaaaatcagagggtttcacttaaaatctctctattccttctcaacatttaaattctatgattgtcttccctttgtttatgtaacagatatttattcagtactgattgtgtgctaagtgtatagctttataccccaaagttttgttgagacgcacacaattagttcattgcctaaacaaactaattcttttcaaagtgagtataaattaactagtctaaaactagttaaacatcagtttattgccaaaacaaattattgaaaacaaaaacgaaatttctaacttcaaagattgatttgtaaccgataatgaaaaatctttcctataggaatgctatttttcatcttgattggtcttagaaaggcaatcgtatctccatggatcatgttggagtgtgcctgtgagaagaggtattgatgtggggggtgcccgtgtaaccaggaacaagtctttaaatg

SEQ ID NO: 68016 - DNA, 1056 bp, Homo sapiens
ggtaagcactcactaaatgtaatattaagggaatctgttactgtttctaaacatgaatatttaaaattatcttttataagtgaatctgatcactctcagtgacagcagtaacagtattttaacagaagtgatgataatggtgtgatgcctagcattaaaaatcttatgctatgaatctggctttctgaagttactgcacctgtgttagttgaatcacagtctttgtgctgcttaactttttgtagacctctctttaacaaatcataagataattaaatgatttttaaaaagaaatggtactttttttggaaattactggccagagcatgaatagtactttaccttttcatacagttcggatttaaattctaggtataacaattggtttaaaatttaactaaaaccattttgcttaaaattttgattctcctaggtgggagacattgtttctgttattgacatgcccccgaaagtgttaagcacatggtggagaggcaagcacggattccaggtaggcagcagcaaattaggtgtgggaaaattcaaaggaaagtttttttatgattcagtaatacttttgtttacatgtgctggtaatggactttgtcatcagaaattttgtctgcaacgatagaaaatgcagatagtaatgataatagatttagatttccttttctaattactattttggttgtttcttatctcctttttcatctttaaatggtggtgaagccaaaatgtgaatagcatctcagacctcatggccacttttaggttacaaggcctgtggagtgaccttgcttttaatacaggttgttaatcgggattcacatatatttcctctctggaattaagtcagtttgattaatatttctctataaaaaggcattgtaactgttatgtaaacttacttttaattacagaacaacagaatctaaagcaatctcatttctttttctatattcagtagtcccttatctacggtttccctttccatggtttcagttacctgaggttaaccaaggttcgaaaacattaaatggataattccaaaaa

SEQ ID NO: 68017 - DNA, 1396 bp, Homo sapiens
attaagtgctaaaatataacggacactgcagcagggtctcaggagtgtcttaaaacacggatctctttgtaccatagaaaacctgaaagtccctttatctgcatttcccatttctgcttcatttcattttttttctgtttcatttttttctctcagattatcctaaaacatggccactaccaagaggtcccaggtttttatccccttttaagagagcagccagactgagctagaatctgtgtcacaattcctaattcctgggttagctcttgattggtccaactaatactggggcatattcctggaccaatcggctgaaccatggtataggatcacgtatgaacatggctgctcctgccacaggccatgtgcatggaagattacagtgggtcttggggaaaagggtttctgagtagtagggggaaatttaggcagaaaagccaaatatgtatctgctatagttatctttttgcatattcagtacaaaaatagaaagtgtcaaaattagaaaccatggaatagtatgatcgctgatgataaggggctagaaattgaagctctgcatgagacaggggctgacttgctatgtaagtgcccatagtgctactggtaagtttctgtgaagagtcctctgtaactattaaaatgcctaaagatctatagatttttttcttccagaaaccatccagttttccctgccagagagcatagtatctttactcagagttacactgatctttttcttttcagtcggtcactcagatgcttatggcttacctgtcacgcctttcagctatcgctggcaacaagatcaactgtgggcccgcccttacctggatggaggtatttcctaattcacttttcatgaaaaatgtatatttaaattatctacttaagaaatttgatattaacataattttgatgtctattgagcttcaggaatcaaagaaatgaagtatattctcagcatctgggaggatagatacgtgatacacgaaatattttttcatctcaaatctttctttgataatcttggaaactaatcttaatatattttatgaatctcgatgatacctgttattttggtgtttagtatactaatgtatatattcagcaaggtgtacatttttttagttgacttagtaattgaaaatatttttcagttattagcaagggacaactttttaaagggtcctttttaagagtaagtattgagtgaaacattattcagtaaatagattacatatttattcttaatgtgcatatgtagagttatattgttttctcctcccactggaaattgggaatgcaagatggaaagtggaaagaatatagaactatgggccaacctgcgttgagatcttggaaaaagtattgaatctcttgtaaattacat

SEQ ID NO: 68018 - DNA, 2351 bp, Homo sapiens
aactagttcatgtaggtttcttttcacccttaattattttatttcttttttaaactatgcttttatcattaacctggcttttttgggctaatgggaaaatgattgttatcttgtgaacaacttgtacttaatatctgaagtttaaaaaaatactttgtgataccactttcctcaatagagaatatatcttcatcaaccttgtacttcatatagtatgaattataatggtacattacatttattaagtattagttacctgggtggacactgtccatgcatcatctcatttaatacccacaaacttgagaatacataatattatatcatcctcattttccagttgagagcctaagcaggtaggtcaatattacattgcaaattataaacacatttgaactcagggttgtccatctctgggaccgcgtttgcaaattgacgtccaaagatggggcaggtgtgtaacataagtgagtaaagcaagtggggtataagaaaaataacaaagcaagtagcatgatgaatgacaattaatactcagcctagatactggcaaaaaaactacagggtagtcagttctgtgacaaactttcttggggaatatacacctcatttaaaggtgatggtcatttctcagctgtagctagttgttgcccgtgtgagaatgtaggtccaatcttcccaattttctgatttttcagtagaagccagaaatctgtatttttcacatgaaacctcttagcttctacatgtcggtagctggtttaaataaaactaaaatccagtatgcagacctacatggtgaatttttttttgaaattttaaatttcaaatctttgtggatacagagtaggtttatatatttataaggtatatgagatgttttcatacaggcatgcaatgtgtaataatagcatcatggaaaatggggtatccatccttcaagcatttatcctttgtgttacagacaatctagttatactattttagtcattttaaactgtacaattattattaactatagtcaccttgttgtgctatcaaatactaggtctttttcattctttctgtttattttgtacccattaaccatccccacctcctccccaccccactacatggtgattttgaaattaaacacgtccataggcccaacctgttatctgcagccagtttttaatctatgtaataaggtctgaactcttttaaactgttatgtcatactatctctcagtgcttagtttcatgtatgtactaaatagattaaggaagtgaagacccttatacgtaagctacacagatacagatatatattttatctgaaacaccaagtccttcattcatctgccttaagcaatgaagttctcatataagatatgtctcacattaagctgatgctcacccggagatgatgctccaggtattatgaatgcttagtttattctcgtttactaatcatgactttctttccccctcttcttttttttctgtgatgtagctttcactttcagaagaacagaatgaagtaatgaaaaatggctgtgaatctaaagagctggtctacctcgtgcagattgcttgtcaggtgattttgtgaatgtattctccatttcatatgaagttaagaattaggttgagtgatgattaaatttatttctataacgtgatttgcctaaaggatataatccacagaaaaatacttatataatactgaaatgagattgtgcaataatgactattgtaagaaaataaatggtattattttaaaacagaaataagtgtattcatacaatactacatggaatgtagagttgagcattgcaacttgcatgtctcctctttgcacttttagaaagttcctaaggcttttgacacttatgagtaaataacaatgactgtggtaatcaagattttttgtttcattctttaatctatacccttaagtgaaaatacttttattaagactaaaggaaagatatttattgatcactacattaaatgattcagctattgatcacatattatggcaaaagagtagattatgttatctctgcttcagatgcacactttttctaactgagacattaagtttctcttcggtgtaacaataggatatgtgcatgtttttgtagcttgttatttcttgacttttaatattggaactgttttgaaggtaatgaccatgacttgttcttaatgagacttaaaatatgtcatttgtagcattgattatttcccccatcatgtaagcacttagtatagttcttttattcacttattctacattctttgagctttttgcctactggtgaattagtcattgtaaagaaagcatttaggaggaaagctttctt

SEQ ID NO: 68019 - DNA, 1130 bp, Homo sapiens
tcctggtgagtctgccgtttttccagaatcttctctttctcgtgtgcttttgcgtgttgtttgcctgttgaactgtattttagaatctcaattatatttaatttacattctctttcttattatttttatatctggcccaattctgtgtctgctttattttacccttgcctctcatgaccatgtgtcacatttgcttgcttatctgtgtgttttgtaattctttaatgtgaaatatataagaaacagctgagactaaagtcagtaaacttacctccaggaaagggcttatctcttcttctttcagtctgttgaaatgaggtgctgcatcaggctgatctgtatttgataagatctggtcttttatgacagctttactttgattgagtttatcactactttaaatattttgaagttaaggttctgagatttctttcacaaggaaaactgaagagtggtgagatgctgaaggtatctttgtgctttgctatgaagcccagatcttctgaactgagggagaacatgttctctttctctgctttgcagcctggatgcttattctcttgtctgtccagttctttcccccagtattttgtgcctctggagagcactcttccccttgccctatgcaagagctttgagggtagctgtgaaggcctgcagtttctcccagcttttctgtgccacctccatccttcagttgttgagtgtcctgagtgccttcagaggggtatcttccagttctcctttcctctgtttcactgccctgctcccagtcaagggaggttagctgccttgtccttggggaggcttcccatacttcacaggttcattctctcagttctcttcctctcctgcagccttggtttactcacccgatatccctggtgagtacctgtgggaatcagttgatgggtgagtgtcaactctctgctacagagagttgtaattttagtttatcactttagtgattacactacagtgtaattttagtttatcactttagtttatatgcagttactcaaggtttggctggcttctccttaccctgtctaacatagattcttttttctcttgtatctctgccaggcgtccaagcacatctttgagtcacttctgtctcatgaaagtgt

SEQ ID NO: 68020 - DNA, 2273 bp, Homo sapiens
cttgtttacttgaaaagtaacttatgttggttccctaggccctggttctccataaagtgatatggtgacaaccagagatatcctgtgtttacaagtgggatttggtaccacaagagaactctgcacttatgaaacttgaagcttatacaggatagctggcattcctgcccattctcctttctcgagatggagagagagagagacctttgctctgaaatgtaaacaaaatctctgggaaaaagaagcaaggatctgtatttcacaaacactctggaatgtaaacatggcttgggggagagagaaaacttttatctctagagggctccatctttagggttactgggttaagttcagtcccttagcccaggtgccagtgctctttgcttagaaagccctgaccatgctgaaatgtgaaaatatgtatgaagcagtttcctgacaagtatatgttcttgagtgagcatcagtaagatgagggctgtgattctgctgtcgtgttatttggtctcattttccatgtattcttcatatgatgggcatcacagtgaactgatggtgattctagtgtttaaagatgagcacatcggttactttatcagatactcagctgagaaaacagtgctctattcccattctgggaagaaaaactcttaggtctgttaagatgcttgtaggtctctagctttttcctggtaaatctgaagggtaattttgccttttattgattttcgccttatgtgctggaattagaacttatttcacttattaaccatgtaagatgtaattctgctgtagaattattcttcctcttggcgtcctgaactcagtagttttaaagtagtattttcagtgtcaaatattaggaggttgaaggtagggtgggtggaccacataatattatacaacagaaatcatttttttgtgtctccacgtctgctacacaggctgtgaggtgaaagaaaacttgtttacaaaccccataggtatgacacatgaaattgcagccattatagaactacaaaagatgaataaaagaaaagaactctttccgtgttccatttgcaatccgttgattaggctttggtgaatggtttcttctgtgggtgggtggtatatttttaccctgctctatgctactgatttccattctccatatggagaaagaacttttctgaacatttgaagacttgctgaatagagttgtatttttaaagatcctaacaacactaattgtaattggtttccatggtgatagaaaagtgaactcaatacaggaaaaataactccaaagatagatttggaagaaatttagaaatgtgggatttggaaatcctgtttgccatttctaatagatgaaggactgaaatattattaaattgagaagtgaaaattatttaaatcactgagttgctgtcataaatttctacaggcaaatatagttcagtccttcatagtgtatagtctttgtacatgtagttcaggtactgcataaaatacattaatattcagacatgtatagggtgtattaaaacccacagttctcttaggatagttttattgaatatcttgtatgtgctagccacctatgtgagtaccactgatgaagcagataatctttcctcagagaaaacaagtaatataccaataagtttaagagaaaaacaatgttataaatgttataaaagtgcttgtaggtattcagtggtgagagagattatgtcctgtggcattcaaaagtcttcatctttattgaagattgaatagaatttggatatgcagagatagaagtgaagaaccctcagccaaggaaaaatagtacagacaaaggtgcttgtgttttcattgttcagctccctcttataagtgagaccatcaattgctttcttagtaagaactgagaaagtattgcaggattttgagaagggagtaccatgatcaatgtgtgatggagatggagagagaccatttgaaatactgttgtaattatccagatgtaagggggcctagaaccagggaattagcagtggggagtaggaaaaaaggggatgactgtaagagataagtgttagcagacatgagagactaaagaatcaaaggtgaaaaatgagaccttgagcctggaaatgtaaaaagagagcatgtgtggaaaggaggagaagtagcagaatctagggcgattaggttggtcagctgggtgaatagtagtacagtttgttttgtgaattcaggaggaggaggagaatatgtgaggaaagatgacgaattcagttttg

SEQ ID NO: 68021 - DNA, 1327 bp, Homo sapiens
taaacaagtgagatgaatttgatctataggatttatgaaagtgaaggacatttctatttcaaataaattgacagtttaaaatagcactagagatttataatgctgtgacatcaaacaaaggatattttgttccattagtgtgtatatccttgagattgcagttaacatgataaatttcttaggtcaggaagaactgattaagaaaacagtaatgagtacatttttcattttgtgactgttaagcatttgatatatctgtttgagtgatttagtttactcagcttgcaatttaggtaaattattttctacttaatttattttgcttttttttttaatctttacaaggttgaatgaactcttttgggggcagtaaacattgtgaggagttttagcaaattgaaaagaaataggaggctagagatctaaaaacagtccaaagaatatttaaatgttaacattatatgaaaggttaggaaatctctaaagcatctgatttaaaataaaaacaaaactgttaatggtaaacattgtataatgaaatagaaaaagcactggccttagttcacaaacatagattctaattttctttttgcttcttaggaaatttatgaccttgggcaagtagcttagcctctttggttttatttcctttatgaggtgaatgaggttgtgctaaatagtatcatagttctaaacttttattattttatatttaaagagtttataatggctgcattgaagatgtgggtagggaatagacagttgttattcagctgcgtttggctctcctgagattttgttaaatgctggttattagagtccagtcctcttaattggaggactgtgtctaatttttatgggagaacacatttggtagacttttaccaatgaacagacctgtaatcttcattttagattacacaccatgtttcactttccccattgcacttacttcaaccctgtagaattccattactcaggcagaagaaggaaaaaaagatgtgatactaactcagtttgtgaccctgcttgtatgaggtgtatgagtgagatgtttcaggattgtattgattgaccaggaggcctggagtatggaagataggggtggttcaaaggaaaccagcccagctgcaccttgccagtccacaccagaatcttctttctgtgtttatggtcctctacttggcacagctctcctgcccagttttgtcctgcctctgttctgtgtctttggagactggcctctacatatcacatctaccagttttgcttgccttctgcttctggttgaattcaacccatgttagataccatcaggaggaaaaca

SEQ ID NO: 68022 - DNA, 1081 bp, Homo sapiens
tacacagaattcaagtgtagaaagagatcagtatcattttctagcagcgctgaagactgacaataacttaccataataaagtacctgtaaaggtaaagttcttagagtttcataggaacctttgtataaaatgtctggtaaaattatatacattgttggaaccctgtatttttagcgagccttctgaatttaggagtatctttaatgataagggactgagatgaaggaaaggatgaatctcagttatagaaaagtataacatttaaaagctttgctaatatgtaaatgtgttaattttaggttgattaaccagctgttgcctagcagaggagttgtgattattatgctaatggtgctttctaatagttttttccaaattattttaaatatcgcctccgaataatttttccctgtggttaattggctctctgaggagatattttctagaagtgaagtttaaggcaacacccttgctgcagaagagctagttttataatcactttcagaaatcatgttttttccttcagtcttctcatcctgttgttcccactcaaaatagagaattgaataagaatagtgatacaatttacccttggggcttatttgatggctatttctgtgtttgtgaattaccagctactgaaatttacctgtcaccttctttgattcctgtttctggtttttggcacttccacattggtggtgctagataacacatgggaggatgtgttcctgagcctggtctgtggtgcccagatattaagacattaggaaatattccccatttagcactatttttagttcagagctcttgagttttcttatatgtgaagtgtttttttagtaaaattgctaggctgttatcaagtctgatggaggtgcataacgctgaaaagaattttgagagaaaccactaaacagcattcacagattcgatttagaaagtgtctgtgtattttaaataattattgccatattctgtggagactcatacctgaactcacaatatataaacatgtaaaagcctaattatttttttccttagtactgtacagtgatgatttttctaaggacctgcaac

SEQ ID NO: 68023 - DNA, 1104 bp, Homo sapiens
ttccctgggcttgagctggagactgggagtacatgcaagtcacttcctctcactgctgtttccacttttatgtttttcatgagtccttaaatttgtttaagctctaggtaagtttaaatcattttcctgtaatctggatttatggattctccagtggggttgtgtgttcagaggcaggttttctccctctcatactttgggaactcagttttttgcctgtcctgtgcaatttgcagtggcatgctgcttcattcaaagatctttgaattcttttgattttcctgatacatttctttggtggttcttggagcaaaagatcatggtaaagatcatggtgttctccacacactgttctgtctgtccaagtgggagctacacgttagcattgtctgctatccaccatctatcttgtccctaagtctattcatgtaagtaacttaagatgtaaggctttcctaaaagtttcagatgggaaatagttttatttcacttcttatagtatgctgttcctatctgtatcatgatgctttccttattgtattaatctagttgaatagtaatgtctttgtctccctactaggttgtgagctctttgaggaagggtaggggtcatcttgttttcattttattgaaggataaagtttaaaagaggatataatcatgactctcatagaaatatagaatgagcacaagccaaagatatttaactcattattaatgaaagaacaagtcagttgttaaaagtggttcaaaggagaattcaaaaattaccatactcttatagagcaaccattctaaaatgcatgcatatggatgtaaatctggcaaaactgttctgtttcactgggtacagtttgcatttctgtggataggaatgatctgtattactctcatttttctataaggcaagttccatctctgcagagttgtaaaatagctgaatcaaaagacaaacaaaatcccatacgcctatggaatcaggcaatcctcagaggtgccagcattccagggaaagaacattcagtaactttttttgcctctttttcaatcccctacttttcctacaatttttaaatcttcagtaaatctgtattgaatttactg

SEQ ID NO: 68024 - DNA, 1026 bp, Homo sapiens
gctaatagagagtagatatcaaatggtctgaccataaaatggacttccagccattgttgccaccagtggatagtaactggcgacaactgttgcagagccagaaccaaatttggcgaagaataagaaataaacaaaaaccgatcggaagaatagaaagagaaagatatcctgcttggaatttattccagggatgaagaaaagatattcctgggagtgaacagtccctgaggtgcagttcctgggtaatatgctatatttgtcttgagaaggaaatccgcttggacttctctgtggaacttcaacattgtcaagtgtaatttttcataagttatgagcaagaatctcatacaaataaagtgaatatgtgacagatatttacataatttcttagtgagggaaacagcaagatgataaggctggttcccataatctttcaatttgggggaagtagttttctctcctatttttcattttcattgaatgcattcaggtttaagtctgaagatgttttacagaaaactctggtaaaaaatacagcagtaggttacttaggtattatggttggcagcccttaactacagcttttttgttagatatgaaactacaatcaaacactttaagcataaaatttgtccataattttaaaagcatagaacaagagagtcaaataaatggatactaaatttcttattgagttggttcatcattgcatggcccataatgtatatataaatataatttttatacctcttaaactgtgtaacatttaccaataaacttttacactttgaggtataacacatataataaagtctacaaatcataaatgtacagcttgataaatttatacaaaatatatacccagataatcacaacccaatcaaggtatagattatttctagcacacacaaaacctttgtcccttctagtcagtacttctcccaaaggtaacttattctgactttgtcacaatagattaatttagcctgttcttgaacttaatgccaatagaattatatagcatgt

SEQ ID NO: 68025 - DNA, 1251 bp, Homo sapiens
taagggttcttcacgtatagatacatacacacaaggtatttttataataaatttaggttattttctttctttttgagctttggagctttattcattcagtgtacatgttctgttttattctgactgttcagaacctatcttttagctgctaagcaaagtatctgcgcttctttgccctttcccctgctgtgttttcttcagtagcccccatgatgcatatggctctgccttgcttgtcttaggtgcacacacccacattaggagccctagtccttctggtcagttgttaaattactttacagggtaattttccagtttttgttagtaccctgggggcaagcatctctcttgttgtggaaaggggtggggtatagcctttgaacttctgtttttctctttaggtcagtatgataccacttgcttttaagtttttcagtcttttagtctttcagaagtgtatcaaagtctgatctctggccttctggtgccattcataccattctgttaaggatttattttttcctatttaacttaatgatttttgagacacttggagaaggagagatttgcttcctcacatatatgcagtctaggattggaagtccactgggaagtttttttcataggttttgagaggaaacttttctgcagggaacattcactgaggcagaatcgtggtgcctttcatgcaatttggtgggtcttaggagtgtgaatggctgcttcagtgtcttcttcagctggcaggtggggtcttccagaaaaaaatagtttaccacatcaggaatgatgaagatatggtcaagcattccacttttcctatctgcaaaacagggcttaaaatagtatatcaaacaataactagttagaagatacaatggaagaaaaagtgccactttcaggagcaacaaagatgagataccagaaataaacttaacaacaaactctaaaacctacatgataaaaatgtaaaacatcattgaagaacataaaagaagtttggaacaattgaagaatatgtcttcttcataactggaaatacacagcaccataaagatgttagtttaaggtaatttataaatttaatgtgatgataagaatcctttttaaaaaactaaataaattgatcttggctaaataatttaaccaagaaactttgtaggaaaaagaaaaagaacaagggtagtggatatagaggacttttgcaactagatgttgtattgtgaagtcttagtctcagtaattaaaacc

SEQ ID NO: 68026 - DNA, 1065 bp, Homo sapiens
taatgtttgtccagtagcttttgaaatagcatttatttttggactcagttggaggaaaggatcctttttattaacactctttcactatgggaagttgccggtctccttcatggtggtagtttaaatttgtctgccattgactcacagatctttcattttctgatttcttatttgtagtcggtattattacctaccttgtcactgtggtaaaatagttattagactagaatatttagtccttagaataaaatagttcctagagatgattagaaaaatccatccctggataagaaggaggaatataaggcagaaaaggaaaaacataaatgttttaattctatcaagaaagaaaaactttacttagaaattgttatatgtaatgtactaggccatatatatgctttatacagtgtatcagttaactgcttatcactcctataaagcaggtatcatttttcctatttcctcggtgaggaatttatggctcagagagtcacacagcccacatttgtcatggtggagcaaaattttgcaagtggtagcacaaaaatttgaacccagatgtaactgactttgaaagtgaagactttaatgaaagatttttggggctatcttctgctaaatgctattttctgctaagtgataacttataagaggctacagctgatatctcaagttttgaaattccttttttttgaggaggttatgagcatcaatgacatatagattatgtgaccatcataaaaatgaagtaatgaacacaataatgtgacttttaaaaaatgtgacctctaggacacctaggaatcatgaaaggttctagttctttggcatttgaaggtagaaatgtttatcatatgattttgtttagacttccctaataccacgttatgggctgatagacagcctggcaaatatgacatataatttgaagcagctacagagatgatatagtgcttaattgaaccatatttttgatcacgatctgtagatgcccagatcgctgatcttcacgtatatctccattattaaggcaattcattttaagtgacgagaaagttctga

SEQ ID NO: 68027 - DNA, 2405 bp, Homo sapiens
gttttttttgttttttaagtacaagatggagactgaaagtgagagtagcactttaggggatgacagtgtcttctggttggagtctgaagttataatccaggtgactgactgtgaagaggaagaaagggaagagaagttcaggtgattatggaattcacagttcctttgtcctgtccactccctacccccacccgcacccctttttcttctctgcatttcggtcttttttccaataagactttctgttttctgggggaaggtttggagctcaagggagcaggttttgagttgtatatagcactcctcattccacaacttgccctgaacttgtaaaatgcattttaaaggacttgttagaacgccaggaggagaaggtgttagacaggttttgtagtagcctttcaggaatttcaagtagacactcataatgaactactaccccttcctgtatctgatttgtatcaaatagatttgatctgaatttgtatctaatagatttttcttcctctttttcttggaatgtggtgtgtgtgtgtgtgtgtgtgtgtgtgtgcgtgcctgcctgcctgcctgctttgtttgccttatgcatgggtatgaaaaattccgattaagtacagattggttattttgtggctttgatctttacccttgtctctgatcttgtatctcatgccccctttcccccaaatctctcttggtttttgaatctctggtagtattagtaacttcataattgaagtttttagaggatgcctcctgatgaagcagctctcagtttagtgtctgtggtgaagaaagatgtcttaaccagtttgtgaaaacagaaccaatgtttcattcattctgttgtactgttgcaaattttagggggctttattctggcttttctttttctttcagagttagcgatgtaatacctttgagtatcacaaaaatctcttgatgaagtttgaagtttgttgctgcatattatcactgccactcacatgtgcaattaaacatcttttataagtttacctatgagaacttggataggtgaatatactgttttcatcagatactgtctttgtgtttaatgctgaaaaagagtttctccttttctcgagtcaaaggatttctttatccacaaattttattttttaaagtctaggttaaatgatggaagggattgaatattgggaactcttgataaccctcactaaattttttactctggggttcaaataaatgagaagtatatttaaaattttaaaagaataattttcagagtataaaaatgaattattagcatatgattattttttgtctgaacttttgtctcattttcccataattttatctagcctttcaaatttgagtaagtcccttcccttccaaggtatgctaattgttagtcacatgttctgctttttaatatggtttgtgtcttgctaacaatgagtaggactgaagtatttgttttgcttgtaataaaactttttgacctggtattcaaattatggaagttatttgggtatttgtcaaaggaagaaacaacttggaacttatttcattgttgtttttataacagatttggtactgtaatcctagatttacttgtaaggcagtgggcgtctctctgggattttcttttgacagttaaaagcaaatttgtgtaaggatgagctcttcttttccttgggagtatgtgacagcattttcactctgagaaactgagctagtgatgtgttgtttaaggaaactatgataccatagggcatttctcttctgtttatatttcctatctgaatagcaccatggctctcctaaatcaattatatctttgtgatttgatctgattttatttacaaatgtaacaaagaggtctgggcaaggcccaatttcatgtagtgtctctcacgcattcagcagtgaggcatgaggaaatgtggcagcagagtggtttcacaacctcgtggtggtgttcctgccgagatgccctacaggaaaatggaggcatgggtgtggaaggggaagggtcggataggagttgcagctgtaaccttgggaggaccaaatagtagactcagtgtggtatgacagttgtttttgtaaaatcaatgtaataattttaaaaatgtcttactgtgtttttataaaaatctctgcaaatacatgtgacatcaagctgtcgtattggttacatttccattcacatacacacacatagctgagatgagggcaaaagattgtgcacttttctttttccctgaatagcttgtaaactacattttaaatgcactcttaaaagcctgctcttgtgtaacttaaggcaccatggctaagagagtaaagtcataccacacctagaatgtaggcttctggtgcttccaggtgccatctgctttaggaggaagtagtct

SEQ ID NO: 68028 - DNA, 2219 bp, Homo sapiens
ttttttttttgcaaaatttgtaaaccaggaatagaaccagtgtttcagttttgagaaaaatgatggctttgcctagtgggtgttttccgtttgcagtcttccaagccatttctgacataagaattcagctcctgtcaaggcatgtgcagtaaaggtacccttccaggtgcctagacaaatccttagtgctgtctatttgtatttagaatcctacttttttttatatttacttttttttatatatcttactttttttttgtatttagaatcctactttttttcttctttgtccgtcttcttgttattgcccttagctgaccagagactccgtgccatccagcccctttcctctcttgcctctctctaacttcttttgtgctgcagatttcaactaaattaagttctaattaaaataattttcaccttaaggtttgaatgctcaaccagcttgacactttcaaagataatttgcttttaaaattgtttatcaaaataaatctctaaataggttatgagtcattgttattaatgagattgtgtgtatcctcgaactgttttggggcagagaaaaaatgttgagaatctctcttctaaagccatgcttttgaagaaacagtcttaagagtttttccttggaaaacaatgctgtttaaattaccattctttcttgtggcatactcatatcttggaatgtgttacaactgtttttgttattaagctcttgaatgttagactatatagttattgaaggattatagtgaattcaattctgaatactttctgttctttggaaagtttagaactctaaagtttctattttagatggaaaatttccactcttttttgtcacttgttttctttgcagtatgtcaaattgctttgaaaatagtaaactgcgatattagtttaaggtggtatttttattatgctggtatgtattttgtaatttatgttccactgcattccagcctgggcaacaagagcaagactctgtctcaaaaaaaaaaaaaagaaaagaaaatgacagaatggatggtcatccactgtccggttgtttgaaggtggccaaacaagcaatgcatgattaattgtcttttccatttgtttacttaagaactcctccttaatttgtggatatatttgatcctttcagaatctcttattgtcttaactgttgtttgatctgaaggttctggtacactggccaaatagtatgttttcttgttgggtagtcggtgggaggagatctagttctccttgacaaaactacattacttggaactaacatgctggacgcccaggctcagcaaggtttattaatgtctgtttctctgcattaatatcatctcatgaatctgtgttttctgaggtgtgcagcctgttacagttaaatcttttcttgatctctagagttggagaatgaagtttaatagactagaatgggatgttcctgcattttatgaaactgatgaattcattctaagataagttgtttcctctttcctgaccaaataggagtgcttgtaatgtttctgtcctctactttaaggatatttcgaagttcacatagcttttatattattcttttaaaacggtaggaatgaatcagagtggcaaacatactaggtggaatcttagtaatagtcatagattgttcagttgtgtgcaggtaatgcccttcttcttagtggattgtgtgggaggacgtagaaatgttgtagatggtgggagaggacaaaagagcccattttggttacaagagaaacattcaaaacctctaaatgtgccatgccttggatagctgccccatgtatacattcttaatatgttgcaagaacagattatttctggcccattggttgtttttttctttgtactttctattattttatcatttttgttattcttttgattaatatttattttagaaggcttgtagaaatggcagaaaacatcagggtaagccattcagtaaagctagagtgaagaggcaacctacagaatgggagaaaattttttgcaacctatccatctgacaaagggctactaacatccagaatctacaaagaaattaaacaaatttatataaaaaaaaacccataaaaaagtggccaaaggatatgaacagacacttttcaaaagaagacatttatgcagccaacaaacatatgaaaaaaagcttatcatcactgttcattagagaaatgcaaatcaaaacc

SEQ ID NO: 68029 - DNA, 1127 bp, Homo sapiens
aatggagttgcacaaatcactcaaaatctatacagcattatatccagatcactaataaaagcaatagcagtctagtaaaacagttagttaaaaacagttagttaaaaaacatgtcagagtcctaataagtaaagaaatattacagtaaatataggattttatctttaaaggtggtggttgctgatggaaagggatgcattgaaggtttgaggctgatagactgccgaagattaggacaaagtacacaaaaaatgaggaagtgctatgcaaaaagccctaccaggacatagtaagtgaccaaattgaagtagcaacagagtggcatgaatgagcgccatgaacagtgcagcagtcccgtgcagttcactgcattggcttgtgtcagtgaacttcgtgttaagctggacatacacggccaaaaagtgtgggaaaaatagttatatataatctgagttatattaacatcataccccatttactaagcttatatgaactaattcactttatgcaaaggagttatagcagaaaagatcatacttggttagtgatcatttcgggaaatagttgagtggttaattgcataatctctgaagtcagactcaaagctccaccagtacgtccttgtgcagatcgcttaatgtctcattgtctgttttgtgtttttggaagtatttgagagtggtatttttgcaagtattgtgggaaagcagaaaggagaatgctttggactgggtaataatttgaaaatttctcagaggaggagacatttaaaatgtttgttcaaagataaactaaaaggcaactaccacttgtaaattgtgtgaccttgggcatgcttcagttttctcagctgtaatacagggacagtgttgtttattttatcacatcactaggttcttctggttatcagaattaaagtgaaatacagtgtgaaaatttcccatacagttgtaaggtagaagaaacaaatatgaatttctagagtttagtttcctagctgacttcagaatagactgttttcaaggtttcttctccctttggaaatagtcaaatgtatgaaatcccggtaaatgctaatagtagtttaaagtgtttgtcttctgacatgaatgcttctctggcttctc

SEQ ID NO: 68030 - DNA, 1079 bp, Homo sapiens
agtaaatgtgagatgaaattctagagcaggtaaagtcaacgtggggtgaaattctagaccaggtagagctcgtggcaggtgctgtgttaggtagctagttgaattggtagggaaatgtttcagaaggtaagataacaggtgaccacaaacttggtagcttacagaagtttatttaagttccgaagggctaaagtccgaaatcaagatgtcagcagggccacactcccttcacgtggccttctcttttgtatttgtgcctcttctgtctcttataaggataattattgttggatttagagcccacctgaaatgcaagatgagttcatctcaagatccttaacttaaatttgtaaagttgttttctaaatagtgcagtctttacagggtccaggtattaggatgtggatatatattttttgggggccactggtcaaaaccagtgaagtcctacttaaaagcctggtaaactaagggaatggtgaaatagggattgaaatagaagaacaactacctgtgtttttttgtttgtttgttttttctgttgctaggtttttgttgctaaaaacctagttgtcctgacagagacgcccctttaaataaatagttcctgtgctgagtatccccaccctactctggaggggtggttttgtttctctaaaaattgccagattcattcaggtggcagattaaaaataagtaaatgattttctttttgagtaagtagtagggagatctttgggaaaaataacctagaaaacagtatatgtatttttgccattcttcttgcagatatatagattatattgatatattttaactttgtcagtgttttcaacatacacagaaaagtacaagataataggtcttagcactcatgtgctcgtcacctaaacttaataaaattttacatttttcatatttccttaggatatatattttaaggaaaaatatatagtagactattttacatatatatttttatagtttcaaaatatttggcacaatgcttagactacatttttgagagttagtcattttttatagtatatacattattggtgttgtcaggaggacttctt

SEQ ID NO: 68031 - DNA, 1030 bp, Homo sapiens
gagggatcagcccattgcatgcctctccctgtaatacttggagaattctaagttatttgtagttaatgctttgaaaacatatattttattcctgttttgctattacaagagttttttttatcctgaaaacatttctactagaatgcaaaggttgtgcttataaattctgcagtgttttaatgttttaaaaatgtgcttcaaaagatggatggaaaattgctgtatcatacctttcatatgatgtaaaagaaagtctttttttcctttaatataaactggaagatgaaataaacatatttttaagataaatttctttgaaggcagattaatataatttggtacatttttattttggaggaagtattgtcagaatagttgtatatttctcctcctttgatgtatgttgtttgtgaggtgtctttaaaatccttaaaaaagtagttactggttactttgaagtcatgaaacaggaagtatgaatacatgagaagacagacataggaatgaacttaatcagtttaagatcttatcactgctggcaacttgcctcatatccagctttgaatgatgaacaaaactgggtctgcacatcatttatacttttagcatgtaaacagacttgatctttaaccaagagttgtttatatgggggcgtaataattttctactcctgagaattgtggaataagcattttattgtttttaatcatttaatatacattattaacaatttactagatgcaaaggatggctgggcctgtggccagatgatgaatgagacttgctactatgtcagtgtatttactatagagcgtggaaggtagacctagtgaggaaaaaagaggtactctgtgggaaatgctgcctttaagctgaaatgaatgtgaaggtgaaatcagctaccatcaggttccaaactgaaacactgatattatgatacacatcttctcttaaaagacctattttaacagcatggttcatggtagagacacgtttgagaggaggaaaacaggcagaggataggcccttt

SEQ ID NO: 68032 - DNA, 1051 bp, Homo sapiens
atcattagacagatttctgtcaaatatgtcatgttaaaatttagttgcacttaaacattgagcttaagcaacttagatgtcattttctgttttcctaaatacattttcatatatttatatagactgcttatttttagaagtttactgttttctaccatatgttttttatagtcagaggcacaatttctacttaggctgttctaaggttctgtgatgtagggtgatggaaatgactcatttagttagaatcgtatttcatagcctaggtttttggagcacatcgtatttcattgaaagagagaagagatgcttgagaaaaaggagagtctgtaaactagataaaagtaatggcatttttgccaacttcattacctcatcatcagcacctttggagttacttagtggtgcctcatcaagataggatccgtttactttcttgtctattgttttagaattctcttaaccagtatctgagaaattgcaacttgctgatttaaattcttagatattttcttgatttaagccaaatttgaggttggattttagcatgcagtgtaactttttagtatttgttacttggataaataactatttaaaaggcaaaaatagtagaattcatacactgcttatgggtgtgctgaatggtgtgatttctacgaagattaagtgtgaggtatgacatatgtaagctagttaattttcttccttcttgcttttctttttaatgtcataatagttaaaactctttcaattgaatgaaaaataccatggagctattaacagaaatacaaatgtgttaaaaaatgagactgttgaaaagcttatgatagtttcagaaataattctgctacaggatagaaagtgagaattttcattagagccaaacaaagaggtataaggtttcactttggatggtaggaggaggctggaatgaagcctcagtgttctgtaggaaccagttgttagtcagcaatagcatggttttcaaagtatggtttattaaaaatttcccacaaattcaacctgattaattttttaaaagttgtgttgt

SEQ ID NO: 68033 - DNA, 1750 bp, Homo sapiens
ctgttccaattattataactttatgacacgtttggttacctgttagttttaatgtatccagctttattcttccttaagatggccttagctaacactgaggattgtcaactggttaggtggagttaatatttattttgtatgtcttctaactttgaccatacagcatccctcaaccagctgactgaaatactggcattaatccagttagccatcaagagaacctagctagacttctagcctcttaatggattttcagatttattgagtgaacagaaaataatttattggtgtacacacaatacatcacatttaaaatcattgctcatttttagcataaatcactgcagtgttcagtagtaaaatatctagttcaaatgtgtgcatttcagtgtgctgatacttaattttctcatttgtaagtaaccagttgtttcctttatcattatgaccagctccgtagatgccatgtttggaaattagtttgcttaaaaaggtgaaacaggaatagtgaaataaaaataagactgaatctatttggaagaattaattatctgtgtgtgacatttaaaggcaatgatctttgttagtaccaacttgatattgacagtttaaagaagtttgttctcagtgccctgccttctttccccttccatttcacattgcttctgttggaggaaatgctaaggtttttatgtaaaatagttactatttatcttcaaaagtgaccattttaaaatcatgtttacttattttctttgtggggtggagaatgggaaggaggaagggaagcagtgagcctttgggatgcagtgactgtattccagattcccatatgacatgtcatcaaatatgatacattctttaaaattgggactatcttaggaaattgaaaatatatgatccctatactaactttggggaaccttttttctacttttaaaaataggttactaatgatcacagatctatgtgcacatgggctgtataaatatttccccccctttcaattaataaatggtgagttacaagggcgtaggggtcatgcttgtcaaatatttgaactgaatgtgagttaggcatctaaagctatgatcacacttatttacttctaattacaaataaagatgcaccatttcatttataatgtaattttaatggaattaaacttgaacagttaacaccacataattatatcctatttcagttagaataactaaccaacccgacttttctatgatatcggtcacagtgtatttatataactgtattatgggcagaaattttcctctgttagtggatcaggtacatatggtgacccagtgatctcagtgacagcatttgttgaacagacctttatggagtgcatattaattttcaaacactttgtaagcactagaatataaagataattaaaatagatatgattcctgttaccacagaactttccaaccagagttggatacctcaggtttataaacatattgtacttgtactacttgaatttgcatactaataataataagtaatttttgattgccctatgaggattcaggctttctattccaattaagtataaggttcttagtacaatgtgttagtatcagattttcacatattgtgggctacttttcctcaacatgtaatttagttaatagtgtataaactagttagatttagacttttgcactccatgcaaagcgtattctttctgaaaatattgtggctctgtttatgagtgcttgtggaaaca

SEQ ID NO: 68034 - DNA, 1536 bp, Homo sapiens
cccttttcctttctaatagaatttaaattttgttagaagcaaaacacaaagctttttgtgcctagcttaaaaactatcaatgtcttagcttcccttcctactgaggtagccatgtgatctagtcctggtcagtgagatgtatgcagaaatttctagacgaagcttttgggaaagcccttttagccatttctctttcctcctgcctagaaattagacatgatgacaagctgtagcagtattctagagacttttagggaaaggctaagagattcgcggaagtcttagcccttatgttcttgaactgccaaaccaatgtcagcaagcgcttctctctgaacttacatttcgtgaggaaaataaagccctatcttaagccactatagtttggacttctttttacatgcatctaaacattatccctaactgatatgataatttacatgcccgttatgatattctttcaggagatttggattcttcttacagtttaacaagggatgttatccgacttcaaatccagaagtctctgagatttttggaattatttcctttagacttgattggaccagctggatatccaattggatggatgttggttacttctggagggtttcttgcctttcaaaaatagcctgtagcatttctcactgtcatttcatcctctctcagtttaagtccccggcttcatcttgctacataatctatattgaaaccatagagctccctctgattggagagaatgtccatgtagttatagcacaattagggtcatttggattggtcaaggacaggaatttgactgctgaccttatctccctccataccagaattaattgcggtcttttttttcctttttaaaaattttaaactttttcatgtatcatacacatgttgagtacgtgcatagaacatacatattcaactctatgacttctcacagcctgaacatatatgtgactagcatctgatcaagaagtgaagcttgattgtccttgtgggttgtcagcatgcaggcttctaacagcatggatttgtttttgcctgtcttattttatatgctggaattgcgcagaacatattcttttgtctctggtgtcttttgctcagcattgtctataaaatttatccatattattatatgtaattatatacattctcattgctgtatagcattccattatgtgactgcatctcaacttatctactgttggtgggcatttggattgttttcagttttgacttacgaatattactcctgagaacatcctacaacatatcttttggtaaacatacgtaagcattctgttgaatgtatactttggagtagaatccctggatcatagggtatcagtaacaaatgagagtttaagctcctctgcattctcatcagcacttgatgtcattgtttttaacgtagtccttctggtgggtgtatcttttgtgaagtgcctgtttatgccttttgcccatttttctgttgggtcatttgtcttgtttgtgagagtcttttttatattctgactactagttttttgt

SEQ ID NO: 68035 - DNA, 1735 bp, Homo sapiens
atttattcactttttatctttcatgatttaagatagagacagggtgagaaaaaccctgaagaacagtcaacaaaagctttcaaaacaatgttatcagaggtatgataattatgataagaaatcataagaccattgccgccagtgatgttatttgtgtttgactagaattatcagttttttatgcccacgtaaacaaattgttttatttcacaaaggaggtttaataatttatggttgaagtgtaaatgaaatactatggctcttcagttgtgtaatgctcatgccggtctcagatgtaaaagttcaatcagtgagttgttgcagcccatttcattgaaggaatggagacaaaagtttgtttgtaactaccatggaactgagcacaaagatgccagtgacctttgaacttctgtggctgtgcatctgaacaagggattgtttgagaatgggaaaagctgccagtagacttgggatatgctttctccttgttttctacagaattgttgaatgaccctactccagaaaaacaaaaaaacaaaaaacaaaacaaacaaaaagcttaattggaagaaattcttactggtctcagaagaatctcatgtctgcatagcaaaatctaattagatattcatatcccaaagtgatagtcattaaaaatactgtctccacttacaaaaatggcaacgttaattactgccattttatgcattgacaaggctggtaggtgcttgtggtttcttcctctgcagttcttattatgttcttattaaaagctatcttccagttctatggttggaaaatgcttctatatctgggtcacactaattccttagcttatttttttttttttttacattgcttaaatgttgggcattattctgagagtgaaacctgtatttgtcaaatgaatgagtgaagtaataaatgtacaggaaaagtatttttttgtgtgtgtgtgagagaggaataatggcatttgcagtactcttttttttcttccaaagtgcttaacaaaaaactagtaacatctctcagtatgaaaatatcataaataacagtatctcttttgcagccattgtatatagttctcttatttgccctagccagtgttcaaactgggcccaaacacgactttatttcagttttgttgtctttagaaagagctgagtattcaatactaatctttccattttggagaaaaagctggttctagtttatattgttgcatatcctgtcttacacatgattaataaattatgaagatgtttatatttgaagttaatgtaccaatttgccattacatagtgcatgtgttttgaagtggttcctttttcccatcagtaatgcatttgtgcgtattatttcatatacttttaggtagttctctttatgactagtggctagcaccataatttagctcataggttatgatagagtgcagaaatctgtcatcatattgcttaactggagtcactgggattgagtttatgatttcattagctgtattgtcttggtacctgataggggtaagatgggaaaaattagtacagtagttataataagaaaagtggttgactattaactttccagtatgtgttaaaatactgatttatcaaaaatttaaaataaaatcttaactggttgatagttggagaatttgttcatcatagtcctgtgaaaaattatttaggaagtttagctttgagtctcgatttatcagctactcttaagaaat

SEQ ID NO: 68036 - DNA, 1304 bp, Homo sapiens
gtttgcaagatctattttaattctattttattagtctggcatgccaggtttattctttcataagtaaatattgttcgtgaacattttgtcaggtttccgtattttctcttaatttgtgtgttttaaaaggcagacattatttccctgtgtatataaaactccaccttcatgtgtcatttggtgttatggtaatcgctaaacataaacatctctaagtttagctgtaaaaatcatcagaacttgaagatttttttcttgttacagcaacaaagggatttctatatactattgcattttattgccaaataagattctaatatgttttggtttccttttttaacagttgcaccattaatatagggatcatttactgagatgtttaagtcaaaattacctttgattaacagaacaaattgccttttcagctgtttgctcccaataagaagcagttttcatccatttatttacttaagagtatttcctgaaaactctggtgaattcctcagcaccaagttgtttaacacagaagagaggtggaaacaaaaaatgcttggtttttactggctttcttttagcatttctgtctagtcgaaatgggggccaggcttgcacacatagacaactgaattaatgtaaccggacctattccatctaggctgacctcttgaaagataggaggggaagtctaaaacaggagaaaagttttagaaatcctttggattaggcttacccagattagtggtatgtaaaatattatgatattcttagtgtttcaggattatggattttagtaaaagcagaaaaaaataaattcttgtttaactgaatctataatggcaccagtggtttggaaacatttctgagttacttgattttatgtgaaaaaatctggaataacttttccttttttcctttagaccatttttcttttatttaacctaatccgagccactttataccaatttcaacaatatttctgaattcctgtgatcttttatttcctttttgctgctttcagctgtgtttctctccactctaagctcattaaagttaaaaaaaaaataggagattggacccatttttttttctgaggagtgtggcgtttagcaccctgtggtggctcaggatattttaagtagtattttcagctttctagaagtgtttgccttatttagaaatagttatggaaagttttctgtttggaggaaactgtttcttatctttgttctggcaaagttgtttgatcctttcagcatcatgattcagttggtttgtgttcatgtaggagtttgcagcctagctgc

SEQ ID NO: 68037 - DNA, 3548 bp, Homo sapiens
gagcggagtgcagtggcatgatcttggcttactgaaacctccgcctcccaggttcaagtgattttcctgcctcaacctcctgagtagctgagggaccacaggtatgtgccatcatgccccgttaatttttacatttttgttagagagacggggtttcaccatgttggccaggttggtctcgaactcctgatctcaagtcatctaccctccttggcctcccaactctgagtttgtttttagaacaagctgaggtgcagagagtcagcctctgacctgaggtcttcttctcttccccaggctccttgaactatgaagtttgcatgtgcgtgtctgtggaactccagcctgtacaccctccaaacagcagctctttggccattctttggcctagggttgtaaatactgttggttgggtcatctgtccttaggagaactgactcaggggagaggcctgagcagaccctggaagaggtgggagattttggggtcccggtcaagatgagggctggggcacgtaggctgcagatgggcacatcctttaggcccttagcatagctggccccatggtcaggggtatggttagaggaaggccagtgcaaggccctctaaagcttgaggcccaggatgggtgccattgtttaggtctaagcagtactgttctatgcaagtaaaactctggttttggtcctattgctagagttggttattgtggaaaatggtacaatctctcttatggtgcctcaaattagatgtgatgttttagttagagcttcctaaccagtgtgccagcagttctctgaatgtgttacagatgggccagaaatactgattcccttagttcccaggattgtcaggggtagagtggcaagagcttctaggctgatcacttttccagcaggatgacctatttaccccagggtgcctgtaccagtgctactatgctaccagtatcaggtgctttatgggcaggtttaggagcatatatatatatattttaatgaacattatcacttggtccacctgaaagagtaagaggtgtcacagtaggttttgtgcccttcttattagtagggaaatagatccaggttaagtcacttatctagtgacattttcttactcaagtaggccagttgaaactagaactccgtttttatgacttattttggtatttctctctactaacccaaattgtgttccgtgtacctttttttgggataacttgtcactcttattcatctagggcttgtaggaaattacattttttagagcttttctctcccaaattttgttacattgttttccttttattgttattttttaatctaaatattcagttttatgtttaatccctactaaacagaattatttttatgagattcaaccaattgatggagcatcttgaaactggattttatgtgttactcattttttatagctctcttctttagattagtattatatttagttactacagtaatgtttgtgtgaaatgtgtgaaatggtcacctcaaactcatttatataaggttagattacataagacaggaaagtgtgcagtacattttagaaatattcctgttgtaaaacagttaaagttctggtgcttacatgtaaattcacttgtttttttatctaatgcctactttgtactgatcttaaggagtgttattttattgaaacctcccagtaactctagtagtagtactatcatagaagggaactgggcctcagaaattgtggtcacttgatcaggtttactcaactatgtgggggattgattcatactttaaatccaggtctttttgcccttcaagtgcctgtgttttcctcagtactactttgtaaataatgtgaagtgatttctgaacacttaactcgggttgagaaggggatgttttccacatttatattcttaacatttagagtaacagattctttgctattactcctgcacaggacaacctctctctcttctctcccaacagagaattaccatctggtcaagaatgtcagtagcgccaaggttgagaaaccctgctgtaagagttctgagtagtcaaggttttactttgagtgcgtttgtgtttgcagttttagctctttaccgtgatgataggtactagaatgcacgagagacatgaactacttgtgcctccatagtttatattcttaatttgtccacttccctcccagtttggaaacaggttgacagtgagtgtagagcaagatgtttatccatttgtattctgtgttgtttctagagaatcagggattttatgttagagactttctgaatggtgaaggttaggctttttaggttttcatgctgatttttatgataactttcaataggaaaaggttgtgagacatgggcagttaagctggctttcatgtactggcttgctaacccacctactcttatgaagagttgtgttgattgattagagcacagatttgaaggaatggttgctcagtattctcatacaggttctttgtgttttcacctgtttttgagttccaaggcatgatcagaacctcattatagcagttttcccaatttcttttcagtaccttcccagacctgattttatgtccctttgatctagattaccgtgcccacctccttaaacttgtttcagtgtgtcattctaaactatcaagaaccatcaaaagttctctgtctcctatggttctattcaactctcttgcttgagcttcaaggagagcctttttagaatccttcttaactcaggattctgtttcaccaaatgataaacatctgtcctattaatattaccaacagctactgttattgctaactgtttaattgttatggacatgctacgaactcttctaagccccttacatgtattatctgatttaatcatcacaagtgcccccatgaggtagttacttatagtgatatttttattgcagtaaaatatacataaaataaaattcgctatcttagccattttttaggtgtgcagtttagtagtgtgaatatattcacattattgtgcaatagatctccagaatgttttcatcttgcaaaactaaaactctatgactgtgaaacaacttgccattttccccttctcccaggcccagtaaccacattctactttctgtttccatgattttggctactttagataccccatatacatgggattatactgtacaatatttgtctttatgtgactggcttatttcacttagcataatgtcctcaaggttcatctatgttgtagcatgcggaaggatttccttcttttttaagggtgaatactattccattgtgtgtccataccacatattgcttatccattaattgtcagtggatgcttgagttgcttccacctcttgactattttgaatagtgctgctatgaacatgagtatgcaaatacctctttgagttcctgttttcagttttttggagtatacatccagaagtggaattgctggatcacatggtaattatatttttacactttctgagaaacagccataccctttttccattgcagctgtaccattttatat

SEQ ID NO: 68038 - DNA, 1129 bp, Homo sapiens
aaaaaaaaagactgactcttggtgttgtaccttctatggatttggacaaattaataatgacatgtatccacatcatagtatcttatagagtagtttgactctgctgaaaatcatctgtgatttggctattcatccctccctctccccagcccctgtcaaccaccagcctttttactgtttccatacttttgccttttccagaatgtcatatagttagaatcatagagtatgtagcctcttcagactagcttctttcacttaggataaacatttaagtttcttccctgtcttttcgtggcttgattgttcatttcttttttattgctgagtaatattccattgtctggatatactacagtttatttattcattcacctgctgaaggacatcctagttgctcctaagttttggcagctctggataaagttgctacaagcatctgggtgtggttttttttttttaataagtaagttttcatcttgtgtaaatacctaagcatgcgattgcgggatcatatgttaagaataagtttagttttgcaagaaactgcaacactgtcttcccaagtggctgtgccattttacaacctcaccaatagtgaatgagagttcctgttgtcccacatccttgtccacatttggtgttgtcagtgttttaaattttggccatacttatgggtgtgtggtatatgacattgtttcttccctttgaataaaagcacgttctgtcttagggatttgtgtttgctgttccttttacttaaaatgacttatttttaattttttttagagacagggttttactctgtcacccaggatggagtgatcatagctcgttgtaacctcgaactcctgggctcaggtgatcctcctacgtcagccttccaaggagctaagactataggtgcgtgccactgtgccgggctaatttttgtaatttttgtagagacgaagtctctctatgttgtccaggctggtgtcaaactcttgggttcaaaggatccacctgcctcagcctctcaaagtgttgggattataggcgtgagttatggcgcctggccatgtacttcttttaagtctcgtcatggctgccttcgtcctctcccagagagaccatcatgattacctgt

SEQ ID NO: 68039 - DNA, 1058 bp, Homo sapiens
ttgtgaccagggaatatcagtagtatctaccttggaaggttgtagtgaggattaaatgaaatggtacatattaaggcttaacacaatctctgacatacagtaagcactcagtaagtgatagatgatgatgattagaaactctaacctgaaagtatgcctaaaatattttatattaccatcacctccagattatagagttattttcctgagtgttatgctgtttgctatagaattttctcctttgctgaaacttagttaacagctgataagcggaataacttgagaaatttcctgtatgctgtagtgtatttttattaatcacttgctgacttcagatcattaagaatgggtggaaagatacttctgttttttatagatcctgattcttgataatttcccgataatgttcttaagtttataaattggatttaaataccacttctattttggtactggtactggcttttttttttttttagaaagatgaatgagaaaagtcggttttgattaggccagggttggataattttccccatatgtatatgtactctaaagtcttccttatgatttgcattaacatctttatggcatgcttctcagagttgaaataataaaagctaattttttttttctaaatagatctagtttactatccagagacttttatattacactgctttttgaagtatttgatttaaattatcttacagttgagaaatttggtgtgcctctcaacttcaaatgctggtttattaacattaatctcaaactaagagtgagcaaataaaaaaggccattgttctgagttaaacaaaatagaattggggtcattgtggctcttgcagttctacaaactgtacagtttcttggccttagctgatgcttcagtgaagtgagatgatccagaggagacaggggagggcactgatgttcccacgctgtcctcggtggaacagtgagatggaggcagaagggctcttccacaaaaccagggaacagcacctggaaaggtgttctgattatagcacctcaaaaaaagtagacctaaagaagatgag

SEQ ID NO: 68040 - DNA, 1031 bp, Homo sapiens
aaaatttcataggagaataacacaaagttctgaattactatgatagaggttcatgatgaaaatgtgatagggaaaggagagaagatggaaagtttatcatttcaatgaatgcatcagggattaataacatctcagtgaacagcagtactggtgttccttaaaatgttgcccatggtagtgggcatggattccatgtttacaggggctgtttcacgagcgtcaatattagcaaggagtatgctacagacagacaacacatctttttttgacatctctttttaatagggacacaatatgcagctggcgctttggccaggaaagaataaataagcaagacaatgtcaattgtcgctttgggaaaattctgtgttaaaattctctatgaaacctggcctactttcagcaacttttctcaatacagctgttgagcattctcaatttggggatgcaaataagcttcttctctctcccttgctcaattcccaggccatctttcaaactcaaggttaggtacgtattgcagtcctctgtgtggctgccctcgtcactggccctacttgtctgcaccgtgacgctgcttcagcgtctagaggggactgcaatgcaacagatctgagatgccaggagtgaacccagatgctacctcctggcagacagcagtgccaagactgagaaaggaggccagcctgaggtctccaatagcttcggcaagagggggaatttgttttttcccctcccctcctacccctcaccttgtacatattgaatcaaaccatacataagctacacattcagttatttaacattggacagactttttcttgtataaggaatgttgcaattttttgtgatttatgtatttaatcattaagggtgttattaggacagaggtaattgattacaaacatctgaaacgccaagggcagatggctgcagagttacccagcaatcacaacttccagttcatatgcaggtttggcaataataactaggacacaggacatttggacagtgtggcccaaggagaggga

SEQ ID NO: 68041 - DNA, 1029 bp, Homo sapiens
aagaaaaatgggcaaaggctacaatcaggcaattcatagaaaggaagatctcaatggccagtaaacatgaaaggatgctcaacctcgctgataagtgggaacacccgaattaatatgagataccatttcacactcactgggtagcccaaaatgaaaggacaaaatcggttgatgacaaggagatggagcaacaggcattctccacactccggcgggagtgctgtatggtacgattattttggagagcaatttggcaacaaatggcaaagctgcagacgcacataccctagggctcagcagttccactcctgggtatgtgcctggagaaaccagtgtatgagtgtaaaaggatacctgtaaaaatgttcacctgtgtgttatgttagtaaaaaataaaaaacaatttagctgtcctttcagaaggaaaaaggttaaaataatatatgctatatccatgcaatgaaattctatgcagcaattaaaataaatgaaccagatacacttgtattaatatggatacattttaggaatacaatgttgagaaaaaaagttgtagattgatacttactgtctgataccatttatttaaatggttgaaaaggcacaaactaatactacatattgtttagagaggcaggggcatgggagtggggagtgctaaccacaggtttttattttcctatgtaatttatttatttattaagacaaaaaggcctaatgtaaatatggctaagtattacgatgtgaagaaacttgggtcatggctacatagaagttaatgacattattctttgtacttttccatatatctgaaatttttcataacatgaagattgaaaagtgatagcacaagagaccgcacatgtccacagaactcttaatcttgtggaacttttgatctttttcttaatagcttttctatcctgaaacagtagcatttaaatacagagcttgttgtacatagtctcacagtgggaaactgagaacactttataactaaacatatgtacaactcacactgaaacaacc

SEQ ID NO: 68042 - DNA, 1024 bp, Homo sapiens
attagcttgggggttggacttttcacttgattgagtttattgttagtgtcccctagctaacctctcttatctccgggagaaatggaaagcaccggagagcatggcctctccctaatctagcatgccctgctgtttgttcctcaccagtggccctgcactccaatgagtagttgtgcgctttaggtattaactcttgagctcctctgtccttcctcaaatttatttcaccaaatagtgattgtgtgcccagcactgtgccatgtactgagggatacagagataagcctctgtcctccaaggaactcagaatcttggactgtgctaaagtgaggacacacctgcctttgtgatttagatacaggttttatcctgttgaaagcagatagatgggttgctgctgcttctggtggcatgaaagaggatgataaaagatcagatttcacctgactatggtatataagtagttcgttagggttttctgggcccaaacctcaggagccttgagaccctggtgggtactggggactgacagcatctgtagtgcttgcttctcagttcctgatgccctggaggtgacacttgctggttttccttacctcctgtcttacaaaacctgactgctttttttttctaggggaagttgcctacacggatcacagttcccctctctgtgatcagccagccaatgaagggcaagagcgtggtcacagcccccatcatcaaaggcaaccttggagccaagtaagtactatgtcatggtaaaggaaccaattcgggggtggaggtggcaggcagggcttaccagtccttgtcaccgagtggcaaagtggctggtctttctggggcccttctttgacacctctgctttattgtgctcatcaacagtatttattgagcatccagtattgttttaggtgcagtgattaaaacagatgaaaatccctgctgttctccaagcatacattgtaaagtagagaaataataaaaaagcaacatgcgtggtgatacatactggagagaaaag

SEQ ID NO: 68043 - DNA, 1020 bp, Homo sapiens
aaaaaaaaaatacaaaacatctacccatgaaacggaagtttgtctagttgtattttgtaaccggtttactattgtgaatccctcatcagtgctgcttctccccattcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgtgagtaactagtggtaaagcttaggccttcttttttagaaaacttaatcaaggctcaactgcccattacccgagaaactccctaaaaactaggaaacttctttttaggagtggaaattagaggccctaaaagcacctcgttt

SEQ ID NO: 68044 - DNA, 1118 bp, Homo sapiens
ttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccaggtaaacagggaagccgtggtcattgggaagcagagatgcagacccagaggtgggctgatgagtcagatgggcagtgtctgggtaaggactggggagccatagattattgctactggtgatgacattcatcggaataagccactgaatgttcagagctgtgtaagcgtttttagatagtgtgtttatgtgttgggaatcagatcttcagagcagtctggtggtttccccgggaccctaacatcaggatcttcgtagaggcgggttgtaaatgcggaccttgtgagtctgcctctcaggctccttctgctgtgcctctagtcttagctacgccatgaactagttgtgtgagtttacagaacatttgtatcctctttgtctcagtttcctttgctataaaaggggtaagatagtatttgtcctcagtgtgtaggaataaaatgagatgttaaatgtaaaattctgaaaattaagatatacacaaatgagacatttacagtgtccattttagagagtggtgtgccttaagtactgtgggattagaagctctttgagagcaatgcttccggggtgctgagggagactcttgcttagagtgctggtctgcatcttagagtctaattaagctcttggcctcatgccctcaactagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaac

SEQ ID NO: 68045 - DNA, 1055 bp, Homo sapiens
agttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaagctacaagagctatttttttttctttgaagaattgcaacttttggtttccagcgtggcatacaggaagcttggaagttgtccctccatcctagcaataagtaagaagctgagcaaatggaaagatcaacatctctccttagatccatcagaaagttgagcccacaggacaaactgctgtccccaaaattggaaagacaaacaggcaaatacagagaatcatagcttattgaacagaaacccgtgagaaaaaaatccacgatcaataacctctatgagaaccagcgccagggtaggaaaacttgaactatatttgatgaattgctgcagg

SEQ ID NO: 68046 - DNA, 1034 bp, Homo sapiens
agcagggtatgtgcatccaggttagctgaagcatcagacagccagtgctctgctctcaactcattttgaccttgttacgggtgcagaatatatttctgccaggtgctggaaagtcatagagcaatatttaaaattcagaaccttagtctgtatctcattccatgttcttagtaagactagggcattaaataatgaaagacaggtttgcatgaggagaactcaccaaagaaattcataccagtgtaattttcctttttccaatagtagttctttcagccaaagactgttgatggctgaattcaccacagtgagtcaccttcaattgtttggtgaattattgttaactcctgttaaccatgactgtgagtgctttggcatcagatggggtctggtgatcctggttctggccaaatgccttattatttgggggcattgcttcagagaattccagcttctggcggtcattatcagaggcattcgtgtagcttctgtttggttaatggggtctctttttctcattggttctttcttttccctttaggtaaatcacttatcgaagagacacccagacatgaagatagaagaggtgccagagttaactctacccatcataaaacccaatcgtgattacttttgtcagtattgcgataaggtaaaagggaaatattcatattggtatgccactggggttccctgcttagagctgacttgtccgtatttataaatatatactacgatttttttgttactcttaccagatggttacctgtctctcagtagtctccattcagacaagaaaggactagaaatacagccttattttaagccaaatttttttcttaagaaatagttgacttcatttttcttactgtcccttctctctgtgatttttgttacacaagaagaggtttattactagtgcttagtgtatgaattaatttcaaattcctaggctctaaaatgagagcatttatcatgacctataacatatatggtagttttggggtttctataaggtggagggggttgggaaa

SEQ ID NO: 68047 - DNA, 1019 bp, Homo sapiens
agcttcaaattctttttctcatggatttcaacaagtaacatttgactgacttgctccagcctgattcctgcatgtgtgacttaacctaagtcttttcctccaaatcttccatttttatcctgttccactgtgggatttgttttattatacaagtcttctattgggaacactttttttgttacttaaaccctttcaaaagaaaacccacatacatagatgtaaaacaaaacacaaaaaaatttcatctctttaagatgagcttctttgaggatggcttcattttcagtgtcttcaccagaaaaatctcctttcaactgtgtgtgtcctagagttgaacttctatgggaagtctgtgattgcagagatcatcctctctttctctgtaaaagtgtgatccagttgcactcttaatttcatcactaaatgatcacatttgtgtatgtctttcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgagtgtctactactgagattcctgtctgcttccttcttttggtaaaagaaacttcgatttttggaaaaccgagactgcctagcacctgcatttccatcccttctttgaaacaactttacaattgagaacaatatttcttcaatcaaactacttttatacacaagattattatgacccttaattgtccagatcagacattgacattgaagtgtttaagtt

SEQ ID NO: 68048 - DNA, 1057 bp, Homo sapiens
tgctaaaggcatatagaagcaagcggaggaatcaaaggcacctttcaggtttcaagtctgagcaactgggtggaaggtattcatcaagatggggaagatgggtggaggtgtgagttggaaagcattgagaattccattctggacatgctgagtttgatctgtttgtgagacatctaaaacatccagtcaaacacactcagagggaacagagagagtctgggatggagatattaatttgggattcattagcatagagttggttggaaatgaatgtggccacctgaggtcaaaataagaagtccctacactctgactaagctttgagccacaccaatatttagaagttagggagaaaaaaaaaagaggccaacagagtgagcagaagtagccagtgggtgggcgggagaaggtggttgccttggaaggtgtcattggtgaccccagtaagggctgtttggtggcaaccactatgactacaaccctgtaaaaaccagtgtttaaatatagataagaaatcaggggaggctgttttatttagttgaagagactatgattataattcttgtgaagttattctagtaacagaaaccattttctgaaaaagaaaacaggcagtgcgtcttggcaaatgaacttcctgactgatctgctggaaaggtattgcaaggggagctcacagcatgatctttttttccattgttaatgggctgtggaaaagcctgaattgtttcctgtaagcaggagaaataatttaagcatgcaaagaacatctggtgatgtccccagttcttgatgatatacttgcttcttgcaggtgtggtatgccgcatcctatgctgagttcgtgaaccagaaaattcatgacatttctgaggaagaaaggaaaggtggttagacgtttatgttttacattttctatatgaattctaaattgtatatatcacatctttatgaaacctctaattttttttttgtctcagtatatttcagaagttattccagtaggttttttagagacacacatctccatctaattcagtgtcaaactacaatgaca

SEQ ID NO: 68049 - DNA, 1042 bp, Homo sapiens
gcgagactggtctcgaactcctgacctcaagtgatccgcccacctcagcctcccaaagtgctgggattacaggctgagccactgcacctgggaaaaattcttacatttttgaggcaactcctaagtcaaatgcacagaaaatcactttatctttaaaatattaatacaaagtagctctgttatttgagaattgtagaaattaaaaataactatttcctaaaccaggtcaccatgcagctggagtaaggtaaagcatgttaagtgtgttaagggttgtgggcatggcctgtgtggtccatttgctctcctccgttttggggctgtacctgtctcgttctggcggttagcttacaggtgggtgctcctggcaaagaggcagggcgtgtggccggactggtgcaaaccgagtgctcttggaatgggcggaaaatgttgtgtcatcccagtgaatgaaggaagggattctaaatttgttcattttagcattatctaatcagacagtatgcactgaactctcagaccgcacaaccctttttccgtttgagttaggctgagatataagacttctgtaactccctttgagaaaattgattcaatagtattgtcagggttcctccccggccccggaatagttttattgagataatgggcatactataaaattcacctattttgtctcatcagatagtgcaacatttagcctgatacgctctttttactcttcagacatgttgtaattgatttgtaaatttagtggccactattcaaaggactctccagcaaagaagtcagtcatggcctgctagttgtttttggcaggcataagcaaattctgtctgattttagaggagaattacaggatttttactggtctcccagagagaatgtattaccgttgaatgggtagcgccattaggagttcattgaattttggcttgaaaatgcagacggggatttttcgggtcagaattttttacctcacatcaagtcacactgaggaattggacttttcttcaagactgtctctcttttgcagggtgtg

SEQ ID NO: 68050 - DNA, 1051 bp, Homo sapiens
ggggtcaggacgcaggtggtcagggccttgccagtgttgactctcccactgctgccaaaggagggagcacctgagccttcttagcagccctcccaggtgtgggacagaaggggcagagggagggcagaggcttaaaggctgtgagcagtcagatcaaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtgtaagtgtgggcacgggtctcccccagggaagctgtgtccatcttgtgtgtctgtgtacgtgtgcgtgtgtgtgaacatagctcccgtgcgtcaggtccttccgtgtgcagccaactgtgctacattctctgcttgcttcatcccacctggccttcactgcagccctttgagggacactctccttcgttttctgatttactgatgagtaaacaagctcagaagattgggaagctcgctgggggtcacacagggacgaaggggcatcaggcagccaagcccaggtctctcacaccagagcttcagctaccaaaccaccatggtagatttgcccgatcctgcgctcttcagccacttcagctttaacaagtttgccttgctgctttgcctcttccatgatagccttttaagaatgctgttctatcccaggcgtgagtgccctgagtctactacctcctttatgccctccatggccctaccatgaggtggg

SEQ ID NO: 68051 - DNA, 1140 bp, Homo sapiens
tgttgtagaaagcacctgaaggtagattcttcttctgtaacttgaaatagtttagggaatggggagcgggtgaggaagtggagtggaaagagggaaggtatgggtaaccctaagtatagttacagcaagactagttaaaatgtggtgaaaacaattataaaatcaatagtgcacaatagtttagaaccttatatggattgctaaaaggttactgtctgctaacataggctgtagtttgctattcattttttagttaaactctcgtttattgcaaacaggagaatattggagtcaaatgctcctcctcctccccccctttttttttaacccatgtccttcactttcactgatggtaaagttgtactccacagcttctttcctgctgtgatttctagaaatcagatcccttagacctgtgctgtcctgtctagtagccacctgtggttttgagcacttgaaatatggccagtgctgtgaagtgtgaaatacatacactcagattttgagatttagtagaaaaaaataatatctttcaatttataaaatattgattaaatgttgaaatgacaatatgttgaatagactgggtaaaatgcaatatactattataattaatttcacctgtttctacttttaaactatgtatactagaacattttaaattatgtatgtggcttgcatatttctttgaaaagtgcagccttagtcagctaggggtagggtgttcccaggtggcattaagatgtaatattttttggtttctataatttgaatgaaaagatactgctaatatgtagatgtctgtttttttagtgcttatgatagctctcacaaaagcatgattattattttgaagaatatcttaatctcaaaaccacttccagataattgagttaactgttactgaattaatgtattcaatggatcatttgaacttaaaagaataaaatgacattggtaagcacataatccattaaaaaaagttgagctaagcataatcagctaaattttcccaaacttggtctgttattcaatacattgatttttagaatttaccatttttcaaatgtttaagagaaacctgaaattgagaacattgaacttacatttttttctcctgtgatttagaaaaagaccaca

SEQ ID NO: 68052 - DNA, 1287 bp, Homo sapiens
gcttgaacccaggaggcagaagttgcagtgagctgggatcacgccactgcactccaacctgggctgcagagtgagactccgtctctacaaaaaaaaaaaaaaaaaaaaaaaaaactataaagaaatgcatgggctgaataatcaccaaatttcagaaagtcgttacatatgttagagatggaggatgctgcaaatgaggattacacagagggtatcagctgcactgataatgttttatttcttaagctctgtgggatacatggatgttcattccattattctttttatcttttagtatgtcttaaatctttcatggtaaccttacaatattatgtagctataaaatagttccatagaaagccaatacaataacatggaaaaacgagtcttctctgggggaggcggggccgcgcggggcatgccgggcggcgcgcgggctgcagggaacggggcggagcgcggccgcgccggcgcagcgaggggagaggcagcaaccgctatggacgtgttcctcgtgatccggcgccacaagaccaccatcttcactgacgccaaggagtccagcacggtgttcgagctgaagcgcgtcgtggagggaatcctcaagcggccgcccgacgagcagcggctgtacaaggactaccaactcttggatgatggcaagacactgggcgagtgtggcttcaccagccaaacggcacggccgcaggccccagccacagtggggctggccttccgggcacacgacgcctttgaggccctgtgcatcgagccgttctccagcccgcccgagctgctcgacgtgatgaagccccaggagtcgggaagcagtgccaatgaacaagctgtgcagtgaagacccccgagaggcccattacccccaataaaagagatttgggagtctgaaaaaaaaaaaaccatggaaaaagtttgtactatgacattaagttaaacaaattacctattcaaaatgattacaactacttgaaagccatccaaaaatcttgcaaagaaatatccccgaaagttactgtttttcacattggatggtgatgttgttacctccttatttctttaaaacatttcctctattttctcttatgattgacactacaaatataattgaaaaacaataaacctattttaaaaataagcatgatatatttattactaagccatttgtactattatgtcacatttgatttctaaattaatgttctgcttggctttgagtctagcatcatgtgtaagatgtgaaagcatggagaagactggagagagaggagg

SEQ ID NO: 68053 - DNA, 1074 bp, Homo sapiens
cctgcgagcggcgggcttcgcctttgttgccaggtggacgcggccccggccttcgcgcgcggcagggatgctgcgagccccgggggagctcccgcgccaggccgcccgctgctccctctgccgcctggggccgggtcgcggacgcgcattttttaagtggcgctgtttgcctgcgtccgtagaccgaggaaacccgctctgggtgcgttgaccgctttcgtgagggtttcagtgagtagggaaggtgcccgcgaaggcgtgtaaactgttggaaaaatcgtcctcttcgggtgtcagaattccatcagtggttgtgcttcgaggtcgcaccctgagcatccccgctgcgagaaaggcgaagcggcagggccgggggttggggaggccgcgggagggggcgggggcggcggggtccgcggtgcgggccggagcgggcagccttggaggagccctgctgtggccgagggagacggcgagcttgatctttacttcccttctcgaagtggtgcttgaactgctggtctggaatgtgtagttctggtgtcgtttatttcttctccctcttcgctcttttaaaaattacaactggtttctgcatacttagctaatttcagagagacctgaagactggatttgattgggcattaattgagagctttcttttaaagacctcaggtttagaatatatttacttctacagaatgttcaagtatttccacgggtaaaaataaatctaataaaaagcctctctgatggaacggcttaacacctttgtattcatccagtttaaagctttgtgactgtgagggtaagaaaggagttcagctttaaagagaaatagttaacgtttatctacagaggattttggattgcgattgtttcagtgtgtccacacaatggtcagagttgtatctgtgatccctgatatgtcgcatgaaaacagctaggtgagtgagatgggaagaaaaaataaaggctttcgtatggaagatgggacttcactagtgggtcgggtgtcagaaaccatcgttcacactcgcactccacttcccactgctatgactaatttgaggc

SEQ ID NO: 68054 - DNA, 1054 bp, Homo sapiens
gtccagaggaggaagagatagtctcttcctgtatatctccttttaagagtgaagaaacctttctcaaagcccaccagcataagacccctcaggtgtcactggatagaagtgtatcagatgcttctagccaaagcaagccttggcaaggggaatggtactgcctccacaggctttgacttctcagggcctgcttttggaagcatgtggccaggaggaggagggtgcagcctctaatcaggttgggcttatcagatggtgatacctcttactaaaaagaaaaagttgggcttggttggaaaagaaagctgtggatgttggtgagaacccagtgtctgctacaggggcattccctgtctgggaagttatgtagctgggatggctgaaagagaaagaagtaatttcttctgaagaaattatctgtgggttaaaagttagctggcaaaatggagacatctgagacatcacaatgcgtttgttagatctgggataatgctatcattttaaagggataatgctatccagaagagaatggctggaatggtgaagaatgtgaaaaatttgacatgacaggtgagtggactgtgagggagatatttcgcctagataagaaaatgtgacattagtggtggtagtaaggatcgttagtattttcacatattttatgctttgtctctggaaggctaagcatgtaacttgcttaggctgaagcaggctttttacccggagaggtgaactattagagcttttattttactctctttaattatgagcattccccacataggatagttaaacatgtaaaacagacccttatgtccagcccccagttttgttgaatcttaacatttctcatgtatgttttagccttaaaaaaaaaaacaaaaaaccactggatacggaaatataacattaccaataaaagcctcatttgaactttccagaagtaactcttgagttaggaatttacatttccattcatattttcattacatttgcttaggctgttattagagttgtaacacatatttatcaacacatagtgttaattatttgt

SEQ ID NO: 68055 - DNA, 1713 bp, Homo sapiens
caaattctgagggaaattatttccagcctttaatttagcgttcatccaaattattgacaagacgtgtacataaaataaaaacctttttgggatctgtcatgtttgaattttccattcacacaccctttcttaggaagctatggagcactgtgagccactaaaacaggaagttgagaaagagggaagtactgagtcaaaaccaaagaaaggggaaggaattttcaggactcatgagagctgtgccgaggcagagagagtaactggtccagatgaagcagggaaatggagggccagaggagggatgcattctagaaaggagggactgaaaccagtgggtcagctagtgtgtctgactacactgaagggaattttactgatcttttctgacaatttcagggagaattggtagtcaatgcaatgcgtgtgaaaccaagcaagtaaaagaagatgcagttgcttactctaatggggaaatagatgcctagaaaggaattgtaatcacagtacgcttttatgttataatgagatagaccagatgcgtggttcacacctgtagtcccagctctttgggaggctgaggcggaaggattgcctaacaccagtaagattctgtctctacaaaaaagtaatgaaaattagctggatgtggtgtggcatgtctgtagttacaactactcgggaggctgaggccggaggattgcttgagtgcaggagtttgagactgcagtgacctatcattgcaccactgcactccagtttgggtgacagagagagacctttctttaaaagtaataattacaatggaaatgaagtattgatttgaccatgggacaagtgggtggatgggtgtagggtttggcagtttaagaattaaaaacattggaggataatatctggactgaaaagatacagaaataaaacatgttgtgtagaaatgtggagataaagagcaggtggaaggcctgatagctgtggaagcacagtctctgcagagcaggctccacttgggtggaagctgtccttctcgtgtgagctctagccttgtactgtgtggcttctcaaactgtgtgcttggagtcacttgacaaaaattaaaattaagagaatggaaacttgccatcttgcataagtttttttgtcatttaatttgtcaacttttagtaggtctccttgtatggagactagtacactgttgatttagaaatacctgcaggttgatactagtttagtgcagtatcttgaagaaaccaagagcatagactttagagtcagttgtttacttgggtataaatgatgagctactgcatgctaggggctgttcccagataacagtggttaggaaaatacatgaggcctctccccttgacgaagtcacattctagtgatgggagatggacactgcagatgaatgagcaaggtcgtttcagattgcttgagagagataaaacctggaatgggttggaggagaaggccttccacggaatgcccctttgagcagagtcctgagggtgagaccaccacacttgcttgggaacagcaggggaaggcttcgagttctgggagttcattagaattcaggacagtcatcctcaacaagagaggacagttggccttgaggtgagacagaccctggcttgtgacatcaagggtggtgctggactggagggatgctggagtgtggcaggggctgcatcatggtgggccttgcaagcc

SEQ ID NO: 68056 - DNA, 1072 bp, Homo sapiens
agaccaaacaccgcatgttctcactcataggtgggaattgaacaatgagaacacttggacacagggtggggaacatcacacactggggcctgtcgtggggtggggagaggggggagggatagcattaggagatatacctaatgtaaatgacaagttaatgggtgcagcacaccaacatggcacatgtctacctgtgtaacaaacctgcacgttgtgcacatgttccctagaacttaaaatataataaataaaataaataaaaaagttttttcctttgcctttcactttgatcatacacatccagaagtcactttttattctgttctagctcctgggaaaaggatttgtttgtgaagatacaaatagtaaataattaaggtttttaaaagatgcattctgtcacatagacctgaatgactgttgcctctgtgctagccttcttggagtaaacctgcaatttttttccctttggtaggctcttgcagccaatgccggaacaggatttgctgttgctgagcctcaaatcgcaatgttttgtgggaagttaaatatgcatgtgaacattcagactgggaaatgggaacctgatccaacaggcaccaagagctgctttgaaacaaaagaagaagttcttcagtactgtcaggaggtaagagtgttgccagtaagttgaaagtgttatttttctggggcagggttgaatctgtttaccttagaaatagatattctgtcattctcttttgacctaagaccaagatgctaatgactggagccccaagccttttgtttctaaatgtgtggcatgactgagacctctcaaaggctttgcctgcgtgttctgtgagctctcagttctttaaggaagggatactgcagaagcctggcaagtgccatgggagtgcagcctgcttctcatcctcccacttgtcttggaagatggaaaacaaaacatgtctccttactgacagaaagccaccagtattgtaaaggatcatctcaggtctgattcaactctgtgttaaagagaaaatgataggagatgttataacttgtatttattttttctgataga

SEQ ID NO: 68057 - DNA, 3488 bp, Homo sapiens
gaggtggctgagcgagaatactgtatgctgctggtgaggctcccaggaaaccatcctaaccctaaggccggcatggaaatcgccagtgatagaaaatataggtctggacatatgcacaggcaggactgcatgccatctcacttttctggtggcaagaagtaccctttcttgtcttctgtaattaggctggctctgctctttggtcagtaatcttcctttggtcaaatactgaagtagtgcttgcaccagtggtgagtatctattaacattgaccaccttatctggctttagtcattattagaaaaaaatgctctcttcctgacttttttccacatttgggatttcagtatttttggaccagatcatgtttccccattgtaaattaaaatttataaatcttacaataatattattacaatttttttttgacagaaaatgtatgtgttcataagagaaagcattgctaagtgatttgataagggtttattttggagggtagagatcggagtgtatttgaccacgtttactctggagtatgttctgatgtggcctgtgggtttcttttaggcatgtctgactcagggaatgaccttatatagctacggcatgctgctcccatgtggggtagaccagttccatggcactgaatatgtgtgctgccctcagacaaagattattggatctgtgtcaaaagaagaggaagaggaagatgaagaggaagaggaagaggaagatgaagaggaagactatgatgtttataaaaggtaactcttctactttgaactgtgaagtcgttttgcctttttgttagcccttctgtaaagacggctgttggctgctagtccctcacttctggataaactgggcattcctttgttctgctagagttgattaagcttgcatttcattctagccattgccaatcacaggagtacctgtgatttttgtgtttacatcattctgagctgttattttctgcaggttactatgatattttttaagagtccgtgtcatttgtttaacataatatccctgaatttggatttgtcttattgttgtatcatgattagattcaaatgttcacaaatacttcccgtttgctgatgtagctgggccccagggcttagtggcacggtgaaatgtgcgttgagcttatttcctgcctctgtttttgtgtttcagaatagagaagggacccattgttgtgctttgcacataggagctattaaccttcctttttttctattttggccttcagtgaatttcctactgaagcagatctggaagacttcacagaagcagctgtggatgaggatgatgaggatgaggaagaaggggaggaagtggtggaggaccgagattactactatgacaccttcaaaggagatgactacaatgaggagaatcctactgaacccggcagcgacggcaccatgtcagacaaggaaattactcatgatgtcaaaggtaaccccatgtagagccatggctttgaaatccatgtggtaattattcacttagacttttgcattgcgtctgtcacaggtaagtcagtcacagaaggaaaggtgtggtacctctgcactgaaggtgagttcagctctccagtgcagtgatgggatggtgccgtcttaacaaagtgggcaggcaggcacatccagggagagatgtaggattgaattagagaacggggactagagagtaagagagacaacgtagtccgcccttcagcaggattcttccacattcatcctaaaatgttccctccccaaggggagctcccctcttcgataccactcaagttctggcctcctagaatagaaatggttttcttggtttttcttttcctgcttgtcttctaatctgtaggctgccctatttgtccagatgttttagttgggagggtgaaatttattgacctgctggtaacagattggggcctgcagttttttttttttctcatcttgccaattaaaacacgaaaaggttgcagtagttccagagccattaacatgcagcctcctgctgatcgtatatttgaaaccaattaagatgcgaagaattatttaggacccaagttgggggaaattacttaaccagttgagaagtttgtgatttgccttagagaacataaaagtgggaaacaattgtccgttctaggtgcttgtctttactacgggtatcaccacttaaagcagcctttccactcacactgtctcctgaatagacaaactaggcagatacctccactgaacagatcagaaatgtgaggctctcgcagctgtgagacaaaggaattgctctacgtcaatctaaactcagatctagactccagagggtgccaaaaaaatatttatcccagttcctaaatgtctctactctgtggggaagcaacttgtcctcagcaaggctggcctgagctggagctttcggccaccgggcctccaggctccgtccagtctcaggcctcccccagcccatcccccagctcgccagcctgtagcattttgaagcatttgacgtcactgcctctgtcctgctgacactctgaccattttcacacagctgtctgctcccaggaggcgatgacggggccctgccgggccgtgatgcctcgttggtacttcgacctctccaagggaaagtgcgtgcgctttatatatggtggctgcggcggcaacaggaacaattttgagtctgaggattattgtatggctgtgtgtaaagcgatgagtaagtcctgcctcgcgctggtcccgtgcggcagcaccgtcctgtctggcgtccgtctccctgccgtcttcgtggctgcatctgtgtggtgtccctgcccactcgggtgtttgctgtcggtcgtcttcccctcatctttgtgctttctagatctaggctttgctctcctgccggcagtggtaagctcagttctcgtgtcctgtgctcaccgtgtgtctggtggtgcttggtggtgatggtgcgtacccaccttggtatagcgggcagcacagccaggggcttgttctttcttgtctggctttggagtctgcaggtccccaggccactgtagtattggtggggaaggcagctgtcccctgggctggctctagcttagaggcactgaacattcctgtctttgaactgccctgtcactgacccctgtgatgcatgccagctcatggggcgcctcctctcgaaaggagtgacagtgaagtactttgggcagtctagaatattgaaatatcttgcataatgcactctagagagagctagcagccaagtggtagtgactcactctgtttcttcaatattttgcaaccgggtcacacagctttaggaagtgagaggatttcagttggtgtgtgctttggtgtgacaggaaggtcagtggttcagttgagttgggtttatgctggacgttggtagaaagagtttctaccaagagttttcccttttctccatggctactcctttttctcgttaagaccttcagt

SEQ ID NO: 68058 - DNA, 1552 bp, Homo sapiens
tgtggaggtggtgatctctacccgaagggtcagctgggtggtgctgtgagacatgatggagtggcaggtctgtaaaactcccgtttgctgtggcttggatgagatttgcctcggagaagctttgtgttcatgttcttgtggggcctctgcctggagggctttgcaggttgagaagcatcaagtttacttccagtgggagcgtttttgttcttctttgaaggggctgaggctggcggatgtgccggcttcatgagtgggtgattccacagggaccgagggtgtcttcagaaaaaagcatttcggcccgctgtcctctccactctggtcccagggaggctggaagcagcctgtgtttgctgttccctttttccagtccagcaatgtgaaccaaaggctccgtctccagcgctcaggcctttatagcacaggcatgtgtcactgatccgcatgatggactgcagtgcttgaaattctcctccactgaacttgcgagtgtcttggggaatggcatttaccaagttatcgattctaatttagttaatctgaaagtgggatattgacacccttttaaaacttatgtagggctcatattcttcatgactttagttgtcgtttttaggtctgttaaatgggcaaataaaagatgcttccgacagaaaaaagttgaactggctggctaatttgtagctgtattcatcaattatatggttgttttaatgtattaaaatgatacaattctagaaattaggtgaatttgcttctgaattaaaaatcagttgaaccttggcattcactctccacttagctctgaaattgtgtcataatctatcaagcaagtccacaccagcttgggaaatcttgcatgaattaggctagtaagtgttaccttaggtatgtcttgagaggctgactgagtaaacttgtcatctcagtcctttcccttatcaggctaaattccatcgtgcagagacttgcttgggccccatgagagattatgcccatccagcagtcgggggtgctccaatgggcctgtgctctggggaacgcttgggaagccctattggtcagtgtcatggatcaaaaagccctatcttcatatcggtgaaaggtgtccttgtcaaatagagcaactcagttttatccttgttggttctgtcactgatggtggggctaagagtccttcactgatactgaaaactcaaaattatagctggagtgatggggactttctctacccagcgtatatgcaaagaacattcacttgagcctgttttctgttgtaaattaagactcaaagatagccagaagagcagaggtacctgagtaataaatttctttaaaaataaggaattgcataaaagtgcctctacagggtctgattcctgcccttgtctctgttcagatgctcagttacgagcaataaggtagctattgtttaggtttccagggttcgagcactgaagggaaggtatagaagaaaccacctctttttcagccctgaggtcttaagtagatgcctcactggtgctgaagctgccaataaattgctgta

SEQ ID NO: 68059 - DNA, 1052 bp, Homo sapiens
ataccattatctgccctttttttttttttttttgccattaacttgctttaaaatttctttattttaaagaaggaaactttatatcactgttatcaataaaaagctagtaccatttgccgtgagaagaaagtgaccaaccatacaaatatattagatgaaagcaaacatgtactaatacatgctagctagatactgctgtctctggaaggttctgagtctcagagatgtttcttttcctttaaaagggttataagagagcagcaggaacaccaaagtgcaacttttcttctggatttactcaggattgaagagaattgaaaagggaatgccttgctaggcctaagctccaccccaaatcccacacagtcccatgttgggcttacagtttgcaaaatgcttattgttttatccacatcagctctgaaaagtaggtattaacctcaatttttttggtgaggagactaaggcacagagacttttaaataacttactcaaggttatgtaacaaagaggtcatggaattgaggctccatctggggatagttgaggcctggaaccttctgaggcagtaacaatgctaagctcctaagagattgtgtgattggtttccttttgcagtttcctgtgagatttagcatctgacagtgtttttagcaaatggaggagttgtttcggggtattaatcactgctgacggcgtttttgacctttgttctaggtaaagaaggaatgggaagaggcagagcttcaagctaagaacctccccaaagcagagaggcagactctgattcaggtaagatgccttctctggggacatagctttcagcctgaccattggaaaatacggtcagagccccattcccaacgaaattaggattggacaccacctccttttaggtgagggcttacaaggaagttgtaactggcctgtttttctttttcacctcaagtattgctaacctatggtagaaggaaaccaaacccccaccagagcacacctaattcatgccagaaggtaaccttagctcagctgcctttcgttaattctgcttt

SEQ ID NO: 68060 - DNA, 1978 bp, Homo sapiens
tcaacagaacttaccacataactcccattggtcagtggtctcagagtttggaagttagtgccttgctgcaatgtgggaaggacagtgttctttttttatagtgcatattgagaaaccaggccttgggcttgcaggcactagcacttgtagttacacagatactaaggaggccctttgacactgaggtttaacttgctctctttaaagaaggaagtaattctcctgatagaagtagaatgaaggtaggatgaagtagactttggatcttacccttgctccactctccgaacctgttactgtctcgcatgggcactgacaggagaagcactggggtctcagggtgcttgcttaggcttcctctgggtgccacaaatcatgtgtggttcctgctttcttggtttagcacttccaagccatggttaaagctttagagaaggaagcagccagtgagaagcagcagctggtggagacccacctggcccgagtggaagctatgctgaatgaccgccgtcggatggctctggagaactacctggctgccttgcagtctgacccgccacgggtgagtcctgcccctagcactgcctgccctgaggtggtatatgtaggggaccaatgtatgacactcaggtcagtaaaagtgacatttgtatgacaagttctggcaaagctgaagctaaggaaagatgatgagggaggaaaaggtattacattctaatatctgtgtatataagctaagcatgacatcgctttatgcctgcgtataccacctgtgatgtgaaagtgttttacgctggaaaagtataacctcgcgaaattgatgggtaattatccagttattgaacttcctttcaaagaatgaaaacatgctattcatgaagacttttgaacaagttacattataaataagattatgaagaaaggggtaaagtaatttcttctgaaactcttgtgtgagtggtctcaaatgattttgtcccttaacactaacctgccttgctttgggggatggaaagtattgggaggatatttgtgtccttaagtaagccggttaaagtcttctctctttgggtgacacaggagactatctagcttataggtgtcagaggctgagccaggaaaaaggacagatcagaagagaacgggagtgggcaggagattctggaaaatactgtatgttaaggagccagtataactttggaacttagttttgctattttacctagacagtttttttgttacttggtaagctaaaaaagccttccagttacagctttcattcttgtgcctagctgagctttacattcttaagtgaactttttaagcttttgttttcctgcctattttcaattctctagtctctggatattaaaacaactgttctctcttgcagcctcatcgcattctccaggccttacggcgttatgtccgtgctgagaacaaagatcgcttacataccatccgtcattaccagcatgtgttggctgttgacccagaaaaggcggcccagatgaaatcccaggtacagtagatgtagtagaaattgctgccgtgagggcatttccagtggggaacataatgccttgactaatggttgaccagcactgctagttgcatttgctactagtccttagaaaatgagttttgatttccgaagacattcggtacgtgaactggtttttgcaaggtcactgtttttaaaacatctttttaaatacttttttatattaactgctttatacttaaacaatttctgaattttttatatcatttatttctgatttagggtattgccagaaccaatattcaagatccttttctaggtatatttatcaagcagatcttaaaaattggtctcttgttttgtgcagtatagtttttgtttagacagacacttttacattcctaggttttgtccagctttactttcatctacagaggtttgtttctggttcctacttctaatattggtgttgtt

SEQ ID NO: 68061 - DNA, 1022 bp, Homo sapiens
agtgcagtagcacagtcatagctcactgtagcctaaacctcctgggctccagtgatcctccagccttagcctcccaggtagccgtgactgcaggcacacagtactatgcctggctaatttttgtatttttggtggagacagggtttcatcatgttgaccaggctggtctcaaactccttcgctcaagtgatcctgctgtctcaccctcccaaagtgctggaattacaggtgtgagccaccacgcccaggctgaacacgttcttatactttagcagtcagtaaatatggcgtgaggattaatacatttcccctgaccagttgctttgctagactctgtagagaatatgctttgtaaagtggtttttccagaagttgtgtcgatgttccagctgcaagttccctcctggcctagttgttttcagtcacaacacctctccaccataactctgcttccaggtgatgacacatctccacgtgattgaagaaaggaggaaccaaagcctctctctgctctacaaagtaccttatgtagcccaagaaattcaagaggaaattggtgggtaccagctctttgtgtcaaggtcatacgggacttcttgcagaggctcaggagtgaaagctgggcaagagtagagagagatgagcaagcaaggccggtgaagtggggcattagcacatcctggcttcagaagcctggagtccactggagctttcatggcaaggtgaaggaggaaccaaggacaggtgcactggctgtgagccatggagcctcgggcttcactgaccttcactctgttagcggaagaatatctggggtgtgaaattgcaagagactacgagtttcctgttcccgttttcctccttcgttctgattatttcaagcacctgattttatataaattctcacctcctcctctcccggtctttatcttcttcatttattcaacaagttttattatggctgctgcgtgcgtgtcacagagtaaaatggtccacgagcagatggtacctgctggagttga

SEQ ID NO: 68062 - DNA, 1292 bp, Homo sapiens
ggacagcatgaggactgtagttagtaatatcgtactatatactaaaaatttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccaaaatctgtggagttgtggataccacttaactggagtgtggaggtggatgcaggggtgcctgggacggcgccctggggtccctggtgttggggctctgtggtgccacagaatcaaggaaggtgtttcaggcaggaactgggagccacagtggggtcttggagctctagagcatcctgtgcctggacaccaggcccttctgaagcctgctttctgtcccctgccctgtcttcatcagatgagctccttcaggagcagcgtgcagatatggaccagttcactgcctcaatctcagagacccctgtggacgtccgggtgagctctgaggagagtgaggagatcccaccgttccaccccttccaccccttcccagccctacctgagaacgaaggtgtgtatgggcgacggtgccacttctgggcagcagggggaggacaaaatgagagaattgaagtcagtttttcgaaaaccaaattgagttgggagatggtgttcctgcgagagtcaggggaagggagactggattcattgagcgcctactgtgtgcaaggaccctgctagatgctttcaaatcattggtgtcaatgtcaccatgaagttaagactaattctcccatttcaagatgggtggcttcaaacccccacttcttccaacttgtgcacttccttacatgggggaggcacttggcagttgaaacagcgccttcctgttatggtgttacctttgcccagccgtcttgggaggtaggtgctggagaggctgaggaggtgacagggctggcgtgggtcatatctctgacatgaggtggggataagaagctgttcctctgggtcctaggcagacgttctttcctctattcccctgctggttctcagtgtctaagaggatctctaaaagctgtgagtctgctccagaaataaacaagttgctgagaccagtgccctgagagccgtccccctcatcagttctgtttgttgctgttgctgctgacagggtaatgataagaatggcccacagctatgccgtagtccttgttatatgccagctttagctaagcatctcagcggatgctctccatcctcacag

SEQ ID NO: 68063 - DNA, 1414 bp, Homo sapiens
cctgggcctgtgctgcgtcgtcgtgctgcgtatttggatactatccttcggagcgccacactcgagtgatgttgctcaggcagtgtctgaccttggtgagaggagagttgctgttcttgctgctctgtttagagaaaggtgccttccatgctgatattagaatgcttcctataggtggaatgcacgcttcctgtttatcttctaatagccacttaggatatgagcatctaggatctcggcacagagggattcagcgtggtgggagatgcgggaagaaatccgtaatgacagactgttgtcattactgttggaacctccccaggaccaactgaaacttgaagggaaaataagagtttaggttggggagggtatttgaggcagaatgaattccctgtgggctaacctactatgtccaaggcaaacgtgcaggttattgtgaggatgggtgctgtggcagccgggtgtgggtagtaggtgctcagtaatttctcctacgatggtgtgtatttcccatgctaggatgcccctcggctccgcttctatgtgtcttacaataaacattttctctgaaggcttgcatttcattttcccaagttggagacaagtaagcactccctcctcctccattatacccattggtctctgcaaatgcctgtctcattcatctttagagagcacagggcaccctcagacttgtgaacatggtggcagatgagtcgcgtggggaggtgcgtgttgaggggctcactggccctcaggagggagtttgctgcttctgtgcaatgggtgtgagatgggccatccttgggaactcagccatgatctctctccacacaggatctggagtgggagagcaggatgggggactgatcggtgccgaagagaaagtgattaacagtaagaataaagtggatgaaaacatggtgagcctgttctttcttctgcccaacacgctttacttttgagactcattagagcgagtgacctgatgtcagatgcttccaggtgcacgtctctgtgttcgttttccgcacagtagaaggttggagggctccaacggctcccacagactggctgtggtgtttagcatctgggtatgaaaaggattaaaaagcccttttcagcagtagctcatctcttgctatagagtaggaaaatatatttacaactaaagatatgaataacctgttagaggccattttcaagtgagtagagagttaataacttggattagagttgggttttgttcttatactgccttaggtttatacccccttttattcacctagtattttctgtcatttatagttctggattatcttcaactgagtttgatatttcaatgtggctttttttttttttttgaaatggagtcttgctttgtcaccgaggctggagtgcagtggcatgatct

SEQ ID NO: 68064 - DNA, 2210 bp, Homo sapiens
gaaatccagttgactgtcatcttccgtgagggctaagctttcagggctctcgtttcgaaagcattgcctctttgatccccttattttctttctcctgtgtttcaccaccggttctcatttggcctgtccggtgggaacgggctgctggctgcatttggtcctcaggggattgtgcagcaaatggctcaggtctcccagcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgagactgctcgtttcactgactgcggcattgatctgcgtgatggtcctacccccttcctccaggagggtgataacttcgttccacgaaggaccccagctgcacctcacaggcggaaatacgtctgctcaagctgtgactcaaggcttccagcgccgtttcgcatttagaaagcaaagtaagagggaacatctgcacagagcatttgtctggcaaaatttaggctactgatatttattaatatgagacttcttaatgctactgggaacaatgagtagggcttgtggctgaattttcagaggaatgcttgcagcttccatttgcttaaataacctgacactgggaggccctgtcacctcactgatgggggtgtttggtttgttgccttggcaactgcttagagggctttctgcctgggcccagttttatctactgagctaagatctttttaatgcccagctacagggaagagggtcaattcaggggtaaatctca

SEQ ID NO: 68065 - DNA, 1079 bp, Homo sapiens
tcctgtagcaaagtgagcaaggtgaaggggagagaccggaggcgcatgagggaggagggaaaagatggttggcatcaaggaggtggataaagggctgccctcccggggcagggcccctggagggccggaggggtggtgaacgccgtcgtggtgatggtgagggccttagcgaccaccacccgagtgaggccccctcaccttcaggcccagagccgaggggaggagcctcccccagggccggcgggggcgggcaggtgagccgggcaggtgcgcaggcgagcgcggcgggctgggcgggccgaggccacaccctgaaactacctgcgtgggccgggccggagtgtgagagcggagctgcagccggagaaagaggaagagggagagagagcgcgccagggcgagggcaccgccgccggtcgggcgcgctgggcctgcccggaatcccgccgcctgcgccccgcgccccgcgccctgcgggccatgggagccggccgccggcagggacgacgcctgtgagacccgcgagcggcctcggggaccatggggagcgatcgggcccgcaagggcggagggggcccgaaggacttcggcgcgggactcaagtacaactcccggcacgaggtgagcgcgggccggggacccggggcgctgggaagctcctgcccgcccgaccctgcagcgcggcgctgggctcggccggctcccctggcgtgtccgtcggtggccgagctctgggcgcacaggtggaatttcctgttcagcgggtgccgggccgcgggcgggcggggctggccggacctttggtaccggaccggctgcgccccgccagggggaggcgggaagcccctgggccttcctgcgccctcggtcctttctttccctgagttgaaaaaaggggctccgtctcggcccctccatgactctcgcgctgttagtgaacatctggaagaaaccaggggcttggagtggggttatttgggaggaagtgaaatttcaggagggtttggagtctcagccatccttggcctctgcagaaagtttctttcgtctctctccttccccgtcaaaaggcgctttgg

SEQ ID NO: 68066 - DNA, 1007 bp, Homo sapiens
ctgtttggaatttgttatttcagggcagtccggtgcccccaccccaagtttgttctccctgacttccctttctaggactctcctgcccacacggggaaagcagggtcttcctggtcgtgtggtccagcctcctctctgagccatctcaccacctgacaagcagccaggctggggctcaccttccactcacccccaggatcccacattcagcggacttgtcttgtcacctgcaagccctggctttagtttcccccatccctgctcatttcctcctcctctgcgaagctcatttgctctctgcgcccttgggctgttccttccccctctgccattttcattctcttggcttgctctttgtcttttctcctgccgagctttattgaactaactcagtacctagtcccatgggtgaagggaaggctctcagagaccagtaagatgtggttgtttcctttaaagaacatccagtcttgagagcgaaactaagagacgaatgccaaagttagctgtgaggcggagtgtccagaggaaattggccaaagctcatttccatgtcttgcagattcctcccatccctggcctcaccagaaatcccagtccctgggatcaccctgtagtgtgtgtttgcagctaggatgtccatccccggccgggaggtgtggctgctgcccctgggtttattatctgggtcagcagagcctggcccacagggtgctgttgtttctgggttccttgtccccagttgcatccatccgtgcacccttgtttggtggtatttgtatctggctgtccccttcccaaggctggtggtgtggcccctgccccacccctgctgttcccatcaagtgttctgcgtggccttcagagtcctgatgcacgttactgcatctggggatggtgtgagccctgcctgcaagcaagcagggaaacagatgccacttcttatggccattaatgagagccagggagcctgcctccctgagggtcttgattcctgttgagtattt

SEQ ID NO: 68067 - DNA, 1108 bp, Homo sapiens
atgccattataaaattgtgttcctgagatgatggtgaaggttgcatatccccagcaaactgctagaacatgttattcaccagagagctgtgagcacataagaaggaagtggtgatcacccggtgccagtgctggtgtgctacaaacatcatagaccagcttgtctggtttccccttttgatgaggttccttagctggtggaccaggagcacagctggagttgtgatttcaacatgctttacatagacacagctttatgtattatacatatgattaaaaattatggcggaagttttaaaatgaaaaccaattcacccacctctgccaacaaatcacttttcacgcctctttcccctccttgctgtctatggttcaatgtgtctagttggttgttgtgcacacaccacttgtatcctggacaaggtgttttattggcctcctgtctgctgggtgtggagccctgggtgttggaggatcgaagttctggtaggcttgtgtctgattgaaaggctgtgcctaagggggggtctgttcttgaatccacgtcactttgggtggtgacctcaggctgctcgtcaccccttcctgggttctgtgccatttcttatttagtaacagctcagatgaggacttggggcatttgcctaccagctccacagatgacaccagctgggagggaaaggctgataccttgtatgacttgattatgagtcagagcatctggacagactgtctgataggctgcgctgagcagaatgcatccgtctgggtcaggagtcagtgctttgctcactgaaccacctccctcaaccatggagcagaaaccacgagacccagagttctgagttgacagtgagcccaggagagatcaggcatggaagtgtgactgcccaaagtcgaagtgtgctttcttccccctatgtttttatttggttataccttttaaagttattattaaaagtctaatatatacatatttaaagaaaacttagccaactcagataagtagtaagaatttaaaaatgaggccgggtgcggtggttcatgcctgtaatcccagcactttgagaggccagggccgatggatcacttgaggtcaggagttcaag

SEQ ID NO: 68068 - DNA, 1076 bp, Homo sapiens
ttattagatatcatacctcatgctagatttgtggagcaagacagacccccttccctcccctatcacaggagtctgggagggaggtgttggagagggatctcccagaattactccaaggagatgcctgagctgaatttcgaagggcaggagtgactattttttttttttctgagatagggtcttgctctgtcgcctaggctggagtgcagtggcgcgatctcggctcactgcaacctctgcctcccgggtttgagcaattctcctgcctcagccttccaagcagctggaattacaggtgtgcgccactgcgccaggctaatttttgtatttttagtagagatggcggtttcaccatatgggccaggctggtcttgaatcctggcctcgagtggtctacctgccttgaactcccaaagtgctgggattgcaggcatgagccaccgtgcccagcctatttttttcatttaacattctatcttagatagcttttccatgtcattatctactttttgaaaaacgatttttgattgccttataagctttcatcgagggaacatatcattctttccatcttcttattttaatcgttttattgtttgggtgtgttacttgaatgcatcattggacaattaatagaaaaagagcaaacagaatgaggaaggtaattggcaagcagaccctgtggaggccacgctagtcagacctcttgtgggttatgctggtgaattctggaaacggtgtcttcaagggaagatgactaagggtgagatggaaccagatggccagggtttagaaaacattttgtttgaatgatcagaggagttgagcatgtttagccagaggaggtgcagactgagagagcacacgagcaccgatgtagagcttccactggagcgtctcctgagtggggaaactaggctggttctgttgcagtgctaattagtgcagaggtgattgcagtgctgatcacacttggtggaaggaagagcttcctaatactcgtactaaggaaaatgctatttcttccaaaaggatggtctcgcgaggatgagaggtgggtgacatgccctgcagaa

SEQ ID NO: 68069 - DNA, 1374 bp, Homo sapiens
ctccatgccatgaaatatgactcagcactgaaaaggaacaagctgatggatgcaacaacttgaaagacctccagggaattttgtgcagttaaaaaaaaagccaacagtcccatacataccatattatttatttatataatataatgggttttttttttttttttttttttgagacagagtcctgctctgtcccaggctggagtacagcggtgtgatctgggctcactgcaacctccgcctccctggttcaagcgattctcctgcctcagcctcccgagtagctgggactacaggtgtgtgccaccacacccagctaatttttgtatttttagtagagacagggtttcgccatgttggccagactggtcttgaaatcctgacctcaggtgatccacccgccttggccttccaaagtgctgggattacaggcatgagccaccacgcctggcctatataacataatttttgaaatgacaccatgttagtagtagaggacagattagcgattgtggagctgaaggggtgggggacaggagggaggtggctgtggttacagaaggccatgggcatcctcgtgttggagctgttcagaatgttgactgtgatgccagagacaggggactacgctagcgatgacatagatggaacttaatacttaacgtgagtagcggtgaaacgggaagtctgaataagatccgcggatgatactgctgttgtggtattatgatacagttttatgaggtgtgactattgggagaaactgggcaaggatctcagtatgatttcctacaactgtatgggaatctacaagtatctccataaaaatgtcagtaatgaaaggcacactagctcgtgaaatcagaatgtggatttaataaaaagtcaagaaaacgaatgaaaagaagttactaggtgctggctgcacctcttgtttctcttgtcgggttttgggggatctgcctgtttgtgctgctgcaggcagatgcttctgctctgagtccggtgacttggggcaggaggaaggtggggcagctgggccgggaagtaggtctttggcacataaggagagggctggtgcaaactaaatgggatcgaagaggcagagatggaattttccggctagaattggcaaaagaggttatgtcctggtgtgtgtgttttgggggcgacacactgaactgaggaccaggagagatccggcaaagtcgaactttaaatggggcctgaggacagtgggtggccaggccaggtctgaccccagagagcctgggggactgtcagcagagccctgaggtgtggactgagtattttttccccttcttggttgagggcacttggcaactggcagattattccagcctgccctggggaggc

SEQ ID NO: 68070 - DNA, 1049 bp, Homo sapiens
catcccaggtggttgctcaaaatagaccagctgagactctaagccagcttctcctcctggtgacaggaaggggtgagcctcctggaaatggtgggtggagtttctccaactttcaggttcccaagaatgacctggagcacttgaataaaaacttccacatccgaggccctgctcctgatgcatgacatcagcacctccagggagaggggcttgggaatctggatgtggaacaaacactgcatttgtttcagttgattgttattgttctttttcatgaccagacaagtccaggaaatgctgggggttgcgatcaatgggaaccataggcttttgcaggtttcgtgaaaattggcttctagagagatcgattacccctggttggggagtgggtgggaggattccagtgtggcctttcttttcctttctcatttgcccatcggtcatccccagataagcactcaagtgtcctcttttatgaggccccgtgctgggccctggactgccatggtggcaggtggggtgaagtcccgccctcaggagcctgctgaccgcctgctctgtgcacagctgctggagcttccccggggctgctgatttaactggggagggcctgtctatgtggggtccctcctagccggagacaggtcccttttatgaacagcagcctgatgaagaggccttcctgcaacatgcctctggtatcattctcagctcagcattgcccaggggacaaacacagagtttgttcttggcagtcattccctgctgtcatctcaggtgggcttgagccgtgctgggtttccgggaaatctggccaggatccagcacaacctttagccagtccggcagggagcggccacgaggttgtgctggctcggtctttcccttgcaaaggaaggcatcttcgacctgccacagaatgctttcttccccggggaaacccttgcaggtgctcgggctctactttcctttctcgcttgaacaattacagggatagtttatggttctcatgaccctggtgggggtgatgacatcatgggattgaaatc

SEQ ID NO: 68071 - DNA, 1049 bp, Homo sapiens
tgtctgagtggcctggagccgagctgtgtttctgggtcctttggccaggatctaactacagtgggccagcaggaagaggctgtgatatttacatggcctctatctgtgtttatggtaagcagacacacctggcttcatagcaccgttttatgtgtgcacctgcaaagatgtttacttttaagaaagagagacaggagaagtgaaagcaggcgcaggcataggatctctcctgtcggctgtggcccagtagagaggtgttatgcctacagttgtctaagtgtctaagtggatgggagttccctgagacctccccctcccacctcccccacccaggagttaaaagagctttgctgcttcactgactttattaactttgtgaccttggacaggccactccctctctttcatcctcagtgttcttatcaataaaacgatgggattatgcaacagtatctctgttacacctgaaaatggagccaagagctaaggttataaaaggaagcagcccagttactgattagacagcacttttaggctgggtggagccacagaactcacactgcagggaggacagaggacccaccattgagctagcgccactgctgacagcctcgctccgtggcagagtctggggtgacccctgagtcaatgccctcagccaccttaccccttctcatgggagtctctgtcttctgtttccctgaatccttgctcccagaattctggaacctaaccacactgggaggcagtaaaccaggaccagattctggatctgccaccaagtactgggtgaccttgcaaaatcagcattcttccctgccttctttatataacacgggtgatagcaccagccagtcttgaatgagtcacaggactgtcatgaagatccagtaagaaaatggttgtgaaattaccctgtgaattggatatacatctaaacatgataaattattatttcattacatttctttttttctttgtttctttctttcctttttttttttgagatgaggttttgctgtctctgtctcgcccaggcaggagggcag

SEQ ID NO: 68072 - DNA, 1023 bp, Homo sapiens
tgaaagcaggctggctgtgagcgctggcacacactgtgtccttctgggttgcagtcccagcatgaggtacctgcggctggagacgcccctcatctgagcttccccggccatctgtccctcaggcccaccttcaccgtgactttgatcatctgtgcttgcctctgtggcctgttagcaccgttaggattcacagtgtaattctgagacacatgaggaagtgccattggctgtatgagcagtggtttttccacatatgcaatgtgtttttatttcaaccctgcgtcatagaataaccttgggaagacatttaactatgcttaggaatccaactttaaggtaaaattcaagggcctggctcaccaccaaaagtacacttggatgaaccaacgcctttgatctaaacacttacctgtgaccgaagtgtccctgtgccgaggcggtgacaatggtctccttacagctttgtcatctgcaaagtggtcagatgcctccggatttcagaaacattgaaatatggaaaatgtttagggtgaaggaagtgcgcgatgccgcactacatttggataggacacatcacatgcatcggggaccagctgagcgtcacaggcggggcctggccctcaggggcaccaggcagcccagcacacagggcagggcagggcagggcctgcgaccagctggcctctctgcagggcacctggggcttcctgggcttcgatcctcagtggtggggagggaccctgccagcccaggttggggtctgtggccagccctcttcccacactagctgcgggtgcaggaacccctttgtcacagcttggtgggcctgggtaacccctgccctgggccacagcacctgccctgctcctgtgtgtttgtggctgggaggttggcccgagggagggagccgggagccagcggagggaggtgggtgggtgctgggggcctcaggcctgcctgtgcccgcagcatgcccggggcagttcacgtgccgcacggggcggtgtatccggaaggagctgc

SEQ ID NO: 68073 - DNA, 1004 bp, Homo sapiens
ggcccagaccttcaggtgttccaatgggaagtgcctctcgaaaagccagcagtgcaatgggaaggacgactgtggggacgggtccgacgaggcctcctgccccaagggtgaggcccgccccacccatcttcctgttgggggcctcgcccctggaggaggctgccctgagcacacgcacatgcaggacgccccgagtttaatgaacacaaaccacctgtgtgttaagtgtgatgagaaagggctctggttgggggagaattttccagaaggtggagaacctgtagcagggcagggaggccagtgggcgtgggtggggcaggcctgggtgagggggtaatgtgcaggggccatgaggcgccattggtggtttctggcttctggtcggatgctgcagaggaattgagcccctcccttgtcctcctccttgaacagtgaacgtcgtcacttgtaccaaacacacctaccgctgcctcaatgggctctgcttgagcaagggcaaccctgagtgtgacgggaaggaggactgtagcgacggctcagatgagaaggactgcggtgagcagggcatccgagtacggttgtgcaggttgttcactgtgtgaagtgcccaccagagggtgcacctggaggtgcaatcccgccagcacctcacttagcagctctgtgcttgggtgagagggtgtgtctcctggaggaaaggatagccttgccagttggcatgaaggcaccaccccacgggctggctctggtcttggagaaaggcccgtacggccagcatctcagcgcctctgtagcatggcggggtcgtggctgcagtgcgttgctggcccctgctgtgtagacacagctgtggagcagtagcctggagaagagcggcccagctcacccaagcccaaggcagggtgtcacccctgcctgcccatactttaatctgcagcctctgtgtttcagaagcgttggctggccacaggttagatttgagcacagctccagcgttctgtgac

SEQ ID NO: 68074 - DNA, 1075 bp, Homo sapiens
atgacacccaaatcaaagtgaagctgaccagccagcctccggaggccctcgctgcatttgtgagggagggggaggtgggaagatgagggtttgaatttgggagcggggagaaggaggggcatggtggaagggagtctgtgaagctcaaagatagttttgggggtccctcacgccctggccacgccagcagtgctgtgcacgccaaaagctggcttccccacacagggtctcctggcacacactgcatgtccccttgtggtttgatgtccccaccttgacttgctgtcctctggttctctgctccctctgcagactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtgggtctctgggtgggcagcagggagcctccttgctggccctttgcatctgggagtaatgccaggataggttggcaccgaggcagggcactggaggggtggccacatgtgttagtccattcttgagttgctctaaagaaatacctgagactgggtcatttataaagaaaagagtttatttggcccatggttctgcaggctgtataggaagcgtggtgccagcctctgcttctggtgagggcctcagggagcttccatccatggcagaaggtgaagggggagaaggcacatcacatggcgagaacaggagcaagagagagcaggaggaggtcctagactcttaagcagccagcctcgtgtgaactcagaactcacccatcaccatgggaagggcaccaaaacattcatgagggaaccgtgaccaaaacacctcctaccacgccccacctccaacactggggatcccatttcaacatgagatttggaggggacaagcatccaaaccaaatgagcagatatcccaggacggggctcaataacagtaataataaaaactcactgtattcggtgcccact

SEQ ID NO: 68075 - DNA, 2158 bp, Homo sapiens
ccgcgaggccgtgtgcacagacccgagtgaccgcgcagtctcatagcggctctccctaccaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggtaagcttcgggctgacctagggctccgcagagggcctggggcctttctccaaggccgtgtttcctctgcgtgtccggtctcggggcggggggctgctccagtctccctctgcctggcagaatgaggctgtccagggcggaatggaggcctttagtaaaaggggcatgggatttgcagcctgggctcaggattgaaggttggctttgcccctaactagctgagtgaccttgagcgagttgcttaagctctgatcctgtttgtgcatgcgcgtaatgaagatagcaacaccttaagcccagtggtgcttaaggcacgtgagggggtgggtatgaagggaagcaggccgttagttggcaaatgctagattgaaagaatccactgtacagcatatgctgaacatttgtcgtctttggagaggaaagaaaacgaacaggacttacagctccaatgccctcacagaaccccgcgggcatttgcggcgccttccctccgcctctctgcttcttgttccctcacccctgcttgccacggcgtctgttccctctcaactcgcctggcagatctcagcatgcccctgcttcctctaggtggctgctattgccagagcccactgagtagacgcggattacccgtttgtcagccccgggcatctgggctgttccagagttttctagtccaatgacccgtggggagcgtctcgaatgacgctgccctcgaagcagcccggctctcagccccgtcctgccctctccccaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccaggtggcccccggggcaggagggcggcaggtgggccccgggagaggcgggactggggactcacggcagggcttgtctccgcccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgcatatctgcctcccctgtctctaaggagcagcgggaacggagcttcggggcctcctcagtgaaggtggtggggctgccggatctgggctgtggggcccttgggccacgctcttgaggaagcccaggctcggaggaccctggaaaacagacgggtctgagactgaaattgttttaccagctcccagggtggacttcagtgtgtgtatttgtgtaaatgagtaaaacattttatttctttttaggtaagtttcttttcctactggagttgcgccctccttcctcctttttcctactcgatttgcaagaaattggatgtacattcccctcagcacagaccctggagtcaggctgggtggggcccacagtgccgttgccttctctagg

SEQ ID NO: 68076 - DNA, 1089 bp, Homo sapiens
ctcatccattaagttcatattaagtatcccttcttaaggaagctctcccagagcctttcctgctaggttgagactttgtattatgttcacataacatcctgcgcttctattactaatgtaactgactaaacagctggactaaaccccattacatcaagttccactaggacagtgaccgtatctgtttcttgtaccagggggtccccaggcccaaggttgtttgaatgaatgaagtctctgcccttaaggaacttatggaagtaagcagaagtaaagaagaattacagaaatacaactgatagaaataactgattgccctgagagaaacaccaaaaagtatactttggaaatttgaagaagtgggagacctggctggaggggtgagggaaggtagcatggcagaggcaccacttgagctgggtcttccttgggaagagatgtaggatttgtacagacaagtgacggagaaggagatgactccgggaagcaatacgcagcctcagaggttgagggaacagaaggagtgtagcttgctgagccttgcaggatccctgaagggaaagagtggaagaaaaccttgtaaactagactagcaccaggtcagagaaggcctgaagaactgcagctatatttggtaggaaatcgagaatcgtctcacattttcgagcacagaaacatcagagccctctctagaaatattaaaagcagattaaagggatgcatacggacttaactgagacccctgagttacaacagaacttcgggtaagaacccagaagaaggggatgggagtagggctggagaggaagggatgtgtgttcgtgacatcggggctgacggagacgtggtaggtggggagagtggggagaggcggacctgatcttcagtccaggtgtcctctgtgcaccgtagagaatagctgctgcattctaagctgtagcaacaccaagtgtgtggccttaaacgcttaggcaacctcccttttctgttgttggtttctttgagagggaactgtctgagagaaaatggagcaagaattaggccaagttcaagagttgggcttcagaattaggctaaaggagagattcc

SEQ ID NO: 68077 - DNA, 9991 bp, Homo sapiens
aataaagcctctaagataagacttatttcacatacttagtttcaattaccaaaagatgcttataagtaggaaatttaggaaatacagaaaagtatgaagaagaaatttaaaatattttctatttcatcacttaaggaaagtagccactgtttttagtatattttactgtccatgttgcctgtggggaccaataattgaacacgttttgaggattatcacataaccaatctcaaggcattcatttccaaattctttattagtattttcatataccaaatgtaatagcaggatacacataaattactttctacatttcccaactttatagtagattatgtatcaggtcatttatgcataaggacttagtttcttaactaacctatgtcaagtttagtaatacaaagctaggtttatatatctcttactcaatgtataatcaagaaaagtttagcattaaagttactcagatgatctttgtttaagtgagcatgctacatttgttttgtatatagaaactcctctacatagaacaagaaaggctgttaaggtgtccagagttataatgaaagtgataattaacctgatgtattggtggtggggaagattgatacattttggttttaatggatgttttggttcatatttaggaaagtttataagttgaaagttcctgagttttaatcttcactgaacaattagtgaaatgaagagtcccaattttgttgtataaatcagagctttttactgttgcttatctattactggtttgaaaattaattccatatttcatcctttgcctcttatctagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatttttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatattaatactaactgggaaaaaaaaactagtgtgaagtttacagttagaagaaacagacccaaagttgccagaaggtaataaataaatgtagttttcactgtaagtaagttattgacgtaagatgctttatttgtaatatatttagattttgaaagttattgagagatgaatgtataaaagctaaattttcttttctgaagcagtgaaacaaaattggggtaacaaggaagctctgttgtggcaaacatgtctatgaggaatattaaaactaagcatactcccacaggctttaaactcaaactatgaacatttaaattaagttgttccttattttgcctatacccatttttatctttcattgtcgtttttgcttgacagtatggtgacagagtatttttatttggaaagtcctcagcaagatgaattagccaaaagcaataatggttcagattaaacaataaagtggaattgattcaatcccaggctcaactaagaacagtcgctctctggatgtttcattttagacgatagataagttgagatgttgtaatatttatggggggttaagcctgtgtcagttatgggatgaagacttgtagtaccagtaccatcagtggtcatacttttttttaactttttactaaactaatacagttagacatttccactctatcgtgattatatttttatgatgggaaaataaaaacacttccatgtttttataaatagtctctgcaaagatttcagatgttattggtatctcggtttggcagtatctgaaaaattgagattgtctttgaaatgtttgtgctacttttacttaagtaaacccccactgtgcaagacccaggccggcttcagctaataccaaggtttctgtgtgcataatagtttacagagaacttaagagtaaggactgcggattaaaaacaaaactttttttaactttaaaatttttagtttttgttcaaagtacctggtttataaagtcaaattcttttattagttcctttctcgtttaaattgactgatgttgctgatgaagcttaaagtcccaggcacggttgtggcgatatactgataaaattggtgcctagtggtgggaggagctccagtgtcaggacttttattaaaaggcccttgttttcccaaatgccaatctagccacatttagatttcattattcaataaaacagatgaaaaatcatcccataaatgaatgttgaggttaccaaagtacatcacctgctgaggaaggataaatcttcctgctttaagggagccctgtcatctctcctcttaatgcacgtttcccttggtattagtggaagctgtgttcaagatgggaagcctttcctgcagttcttagaaacacctgctttctaaggagagccttttctaggattagcttatgtgtgttttctctaggcgattttttatttcagttaccaatttaattttcaagttgacagatgctgtgtaaagtctctcataatgagagtagtccattaaattgttgaaagttgcactgcttttcatctttcaggtacctgaaatgagtgacatcaggtatttggaaggagtaagatcataaactgtattcattttcttccttgtacaaagtgatgacttctaatgcttatatctcaaggtattttttaaaaaagcaacggtccctaatagagtaaaatttggttttggtccaagttcccaataatgtatttaatgtttctgttgtttactggtgcctcccgttgcatcaggtagagattgcctgcctctttgtagggcagccttgtggcaccttatgtccaacttggaggatagtatatggcttctttgtgcctctactatcttttcaaaagccattttataaaaatcctaggtagcctattttaatatttaaatatatatatttgtgaaagaacttttagaacagaccttttctttttactttaaaattcctgtatttccatttttaagagtaaatttaatctccaggatttagaagtgtctttccagagaagcataatgagaaagtcagactgaggtaataagaccagaattaagtgatagaagaaactgttgtttggttaaaggacacagatttgaaggaaaaaaattttgatgtaacaattttttaaataaaattttgtttttctgtaatgtcatatttgctgctacagtagctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagttatagcattgtgattctttctgggcactggcattttgtgaaactctcaagggaaggtgatgcaggggagaaaatgtgaattaaattacatagatgggtgtttttatgtcttctacccctttcctagaattagtacaactcttaactgtgccagtccccagttcaccagctttgtatccagtcgtcatctcattcaagtatggctttacttggtgacactggccatagctaagttaacttggcatgtttgacttttgacaataacaaaaatggttttggattttgttttatttccaaaaaatgtatacaatatcagaacttcacattttatatactagtatctggctattagtattttacaggaaccatagttcttggtgactacatatatatatatatttttgtgaccttttttgtaaactaagtgccgtttcaacgttacaatcatttttagggttattgtaatcaatgtgaatatcatgttttttcaaatctgttctgagcctatagtgtttgctttgtgaacatgtgtattgtatatattctgtatagttatattgtactgaaattagcttgtttgatataaggaaaatatgtattgagtacctttttgctagcctgattgtttaatctttttaaaaaaggtttaaactttttttaaaaaaaaaatctttaaactggcctttattacatggtcacacataaagttgcagttaggaaagggatgggcagggaaaaactagttttgagtgtctttagatagaaacatgagactaaggtttgattttgttttcgttttctcattaaaatatcttatgctttatggaataaaacttcctgctgttgttatttattgtttgctgggcggcagtgttgcctgcggtcatgtgagtgagaaaaggcatcagagtaattcattacttaaataattatctacttagagtgcacagagtagagagggttatattagacagcacatgtcaatttttggtgaagtagagcttaagtgcaaagatctcacaaacaccataccccaacttggaaggagagtataaaggcagctagttagaggacatcatccaatcctagagctattgaatcaggttcttgtgtaaagctgggtactaatgggtgggttgcatctttcaaagttgctctgattctttataaagtcacattttattgactagagaccaattggtgccatttcaatgatatcttacaaccaaggagtaaaaagtgggtacctagcaggggaaaacagctcattacataggtatgaatctatgagatcctgaggaaggaaaagttttctaactttagattcactgatgtggattttgacaataccggtctttagaatgacagtaacaggcaaataaaattattttattgacctcaagctacctggatcattttagaattaagttcagagaggaagagggtaaattttaagaagcacactctttcattccagtgtgtcgagcatttttaacaatttaccaaatcattcaaagtcagaaaatgttgggttcttcagtagccttgaccacagatgatgtatataagtgcagaatgaagaattcaaaacagatatatccttgccagccatggtggcccacacctgtaatcccagcactttggaaggctgagggaggaggatcacttgagcccaggagttcaagaccagcctggacaacatagggagacgtctctacccaaaaaaaaaaaaaaaaaaaaaaaaagctgggcctggtgacacgcacctgtagtcccagctactcaagaggctgaggtgggagaattgcttgaacctggaaggtcaagacctgcagtgagctgagattgcaccaccgcactccagcctgggtgacagagtgagaacctgtcagttggctttgcatacttgcatataaattacgtaccagaaagattcctttcagagaatgatactaaaagtaatgaccaaagatgtgtatctcaactgatagagcaaaaaaaaagtttgggctttttctcttttgaacaggaattttggttctaagaactaaactgagaaagttaaaatctacaaacataccaaaggtttaaaggggcagaacttgcatgtaacaacatcaaacccccaaatttaatgtaattcttttttggggagttaacttctatacagatagaaaaactaacacagggcatattcaatctagaaagtcagtcctcttgagcaaatagatttataactagggtttgaacacctttatggacaaagggaaagctgttttgttgttttcttaaattccaattcatttacttgaatttttctgcaaaattaaaatttttacacctatctgttttgtagatgagaaagtggagctagctttagcatcgttttgcaaggcttcctcacttcatcccatgccct

SEQ ID NO: 68078 - DNA, 1843 bp, Homo sapiens
gcattcaaaaatcagcttcagtagacgttacctagtttgcctcccctactgcctttttttcttttcctttttaagcacttgtgacttttcacatattctgcacattttctgagatactcaattagaatatgtttttgctggtaattcttgccttttcagatgatctgttgctacagaaatatagttcagaaatttgtagggtttatgacttttcagtttatttttgtttttagatattttgttttgctttatttacaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcaggtgaggtgcacaacgaaaacccaaccaggaaaactgctttctaaactctcttttcctgcttttagggcagccttctgtgtttttacatcaggttgccagctagtcagtcacatttgttacggattcccactgttcatactctaatctcctgatctgataaaattttgctgagtcttctacgtatataaaattataaacattttatagttggtattaaaaatattttcctgcagaagtagactacttgtcctcttgagatattttttaaataatacaaggtttaagtaattctgtaatggaccttaaatagatcttactggaaattttaccatgtcagatgatgcttagtgatactggattactccagactctagatgttaataaaattctttaccacttctctctatttaaaaatattctatataaaggaatagccattggccagtaagaaaaatttcaaaggcaactatagtgggtgtgatggtttagatcatgaagtcattgctattttcattcagtttagagctctattcttgtaatattaatttataatagaattacctttctgatttatagggcatcccaggaaatcagcttctagatctagctctgccactaactgctgttgattaaacctgtcactttacacatgaaaaagcttgaaacttagagaaagataaaatgtaagctttaaacgatggtttctaaggccttctctagatataaaactgttgttttaaattgtttataagaattgtacttctgtaggaatccttagtttctcataaaatgaaatttttacaaatctttcttttttttttttttgagatggagtctcactgtcacccaggctggaatgcagtggcacgatttcggcttactgcaacctcagcctcctgagtagctgggattacaggtgcccaccactacacccagctaatatttgtatttttagtagagatggggtttcaccatgttggccagtctgatctcgaacccctgacctcaagtgatccgcctgcttcagcctcccaaagtgctgtgggattacaggcgtgagccaccatgcccagcccaaatctttacattttaaatcacccttatttttaaaaccttttttttttttaattgaatagatagggtcttgcagtgttgcccaggctgaagtgcagtggctgttcatagacacaatcatagtgcactgcagcctcgaactcctgaggtcaagcagttctcctgctggggctacaagtgtgggcaccacccctgacttaaaaccttatt

SEQ ID NO: 68079 - DNA, 1746 bp, Homo sapiens
attggttcacagacttcactgattggacagtttggaaggcagataaggagaatatatttctatacagtccctaccttgaagtttctctgtcactaccatctttcagctttttaatttagtacagtggccacatgaaaatgatctaaatcacattttaaaccactaaaatatcaattaatgctttattttatgtattttttaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggtataatgccttctgtgtttttcttggtgctataaagtcaattcaaacatttttaagttcctgttagataaaaagttttgtgctcggtcatataggaaatataaagaagagtaaaacatggtaactggatttgcttgagatgctattagcactatcgtttattttttacaagttgcacattggggaagataaaaataattgaatggtatctgctgggacaaaggcagatacacatacacaaaaaagcagttaaatccagtttgtgttttattcttcattaaaatatgtattgaaaacttaccatgtgccaagcaaacatttatgatacataaagaaaaacacatagtccctgcaatgacaattaggttaatcatctaattggggaagcagatatgaaagtaaatgattacagtgaactatcaaaagtgctcatctggaggtgtgaacaaagtagtatggttgcaacaaag

SEQ ID NO: 68080 - DNA, 1039 bp, Homo sapiens
tacatccatgcaatgaaatagtattcagcaataaaaagaacaaaaatccttacgctcaacagcatggatgaatctcagaataattatgtccatgaaagaagccagaaaaaaagagtacatactatataatcccatttatataaaattctagaaaatggagctactaaagtgtaaagcacattgataattcctggcaaggacaggaaggtgagactgcaaagaaacttacagaaattgtggcagtattccttatcttgattgtggtggtgatatatatgttataactcatcaaattgtccactatgcagtttattgtacatgaattatatcaggaaagcattcataaagtgatttttaaagaacctatgctggaagtacagatgtgattgattccataaatatattggaataatccttggagagattagagtgtataccctggtaaacctaaattgatatgctatcaaacacaggatcagtgagtcccaacagaactaccaccagagttcagtgtagagaaagacagcttggtttaatgataaaatgaggataggatttaattaaagtcagaggctctgaatttgaatccctgttaggccatattttctctaatctttatttttctcatctttagtttcattaagattttaagatccaaagaatatatttgaaagtacatctgaaagtgacataaaaatggaaggctggccgggcgcggtggctcacacctgtaatcccagcactttgggaggccgaggtgggcggatcccaaggtcaggagctcgagaccagcctggccaacatagtgaaaccctgtctctactaaaaatacaaaaattagctgggtatggtggcacgcgcctataatcccagctactcaggaagctgaggcacgagaattgcttgaatccgggaggcagaggttcaagcaattcaagagccaagattgcaccactgcactccagcctgggcaacagaatgagactccgtctcaaaaaaaaaaacaacaaaggctttcctgacatttagcttagaaggg

SEQ ID NO: 68081 - DNA, 1733 bp, Homo sapiens
aataacagagtgaacatctagttccattagggagtggagtgggaagatggagaatgcttgcacttggacccattcaccctcattctgtctttaatctcagtaaaatacatacactacccaaggttcttagaacatataaggtgatgaagaagaatactataaacagttgcatgggtatgtgtagccatgtagcagctagaacctgttgtgtaggctgaatgaactaatacagtgttgataataatgctaacatttgttatgccctttctgtatgccagctgtgctaaacattttatacattatcttatttaaatctcacattaacactttgacattgctactagtatcttattttgcagtaaggaaactggtatctaaaagcattaaatgacttgcctagagtatcacaataagtggccgacccaggtttcaaattcaaggctgtttagagttagcacttagctgctttgctccacctcacaactaaatgtaacaagtcataaaaattgaataaattttcagtcaccatgaatacggaactacatgactgatgctgtaacaacctcagagattgcaacggggatatgttctgagaaatgcgtcgttaggcgattgtgtcattgtatgaacatcataaagtgtacttagacaaaacttgatggtatggcctactctacatctaggttatatggtatagcctgttgctcctaggccacgtatctgtacagcatgttactgtactgaatgctgtaggcttttgtaatgcagtggaaagtatatgtatatctaagcatatctaaacctagaaaaggtgcagtaaaaatatggtattacagggttgcgcacggtggctcatgcctgtaatcccagtactttgggaggcggaggcgggtggctcacctaaggtcaggagctcgagaccagcctgaccaatatagtgaaaccctgtctctactaaaaatacaaaaattagccaagtgtggtggcatgcacctgtagtcacagctacttgggaggctgagacaggagaattgcttgaacctggaaggttacaccagtaccatgctgttttggtaactatagccttgtagtatagtttgaagtcaggtaatgtgattcctccagcagtgagcccagattgcaccactgccctccagcctgagcgacagaatgagactcttgtctcaaaaataatatggtattataatatgggacggttgtggtatttgtggtctatcattgagggacacatgccacgcatgattgtatatcattttcctttctcataggtgcgggagtttctgaccccttgcttcagaaactgcatttagatactactttaaaaggcattttaaaagtagagtaaaaatcaagatggattgatggatggataggtatgtgataaaacaataacagtagacttttttttttttttttgagacagagtcttgctgtgttgcccaggctggagtgcagtggcacgatctcagctcactgcaagcttcatcccctgggttcacgccattctcctgcctcagcctcccaagcagctgggactacaggtgcctgccaccatgcctggctaatttttttgtatttttagtagagacggggtttcaccgtgttagccaggatggtcttggtctccttaccttgtgatctgcccaccttggcctcccaaagtgctgggattacaagcgttagccaccacacccgggctacagtagaatgtt

SEQ ID NO: 68082 - DNA, 1049 bp, Homo sapiens
agattacacatgtaagcctgtagccgtaggcctagataccatatttttaaataaaaattccataaaaatagaactgtagcttttacttaaatcatgtctttaaagaggcaggtagttggtagaggttttatgactccatctacttttttaactttttttttttttttttgagatgcagtcgccctctgttgcccaggctggaatgcagtggctcgatctcagctcactgcaatccacctctgccccctgggttcaagcgattctcctgcctcagcctccctagtagctgggattacaggcatgtaccaccacgcccagctaatttttgtattagtagagatggggtttcaccatgttgtccaggctggtctcgagctcctgacctcaagtgattcacctgcctcggcctcctgaagtgtaatcctggcctcctaaagtgctggaattacagacgtgagccactgcgcccaggtgactccatctacaacaaaactggcataaatatgctatgtacagataaaaaggcatttggatatgtgatcagtggagataacacattttgtttgggttggaccaaatttgatataaattcataattatgtgatctcaaatgaagttttaagagggagcagtgttcatctaaagtaagcagagcacaattaggcagtttatcagcctcctgtcaaccaagtgctgaaaagcaaaactgtgcctgtagtgtgttttcctgtgttcatcctcactgtcataggtcacactagctgaggctggcgttgcaggtggtaaaggaattaccaaggcaattgtaggtaaagaagggcagatttattagagaaagtatgaaagtaggttggttgcaagggtgcaacgggcagatcagcaagagagaagctgactgccaggagacaatggcttgctgggcatgttacaggatgatgcttctgctgtgtgctgcagagagggctatgtgcagtactgataaggccaaggttgcagtgagctaacttgcatttttctgtcagctgagagtctggtgataagttgagtgc

SEQ ID NO: 68083 - DNA, 1623 bp, Homo sapiens
ggcatttttgcatttgtaattatttaattctcagaacaacctaatgatgcagatattattacttgaattttatagaagtgacaaacttagtgatacgaagaattacaacttgccttagggcacacaactagtaagatagtttagatttcaacccaaatataattccagtatagatgtactttcgtgtactttctaccgtacttctcaatagaagtacaattttattaactttgttatgaaaaattttagtcgtatagaggttcgttctatacaattgtgatcggttattcatgcaatgaataaaaatgctaatcaatgcaatgaataaccaactcagtgattagcatttttgccatattgtttcctgtctttctctgtatgtgtgtaattatttgaaagtaagctgcaaacactgtaatcctcaaatatttcggcatgtgtttcctaaaaatagggacattctcctactaaccccagtatcattattaatgcctatcaaaattaacaactccatcttcaaaattcctcagttgttccaaagtgtctttgagggttctgcccccagttgtagtcagtcaagattcatgcattgattgcatttggtgattaagtctttagtcattttgtaaaatgaagagtatccatcccctcttctttttgcaggggaaattaaataggatgaatattccctcccttctttttttctgacacgtaattgaccaaaccagttgtcttgtaaaatatacccacattctggatttgtgccctcctaatgtcatttcgtttattcctctttctccctgaatttcctattaactggaagttaggtgtaaaggaaggcttaattagcttaaagtaaaacttcctttggcaagaatatttaataggtgatgctgtgtacctcctgttgcataatataggaggcacacaatgtcagattcccacactattaatgatgctaaatgtaaccatttgattaaagtgctgactactgatctgttgtaaaggtgtggtttgccagtttgtgattaatatgtaatcttggggtaaaacttggacactaagcaaatacccagtttctgacaatcttttgcttagtggtttttagcacccatgatgacttttgcttaaatcagttattggaggttctctgtaaggaagagatttccttcattaagtgcaggtaaactattgttcttccccaaaatgcaaattaaatgttaaatttaatctctttacttttcaatattcatagtaaagagctggagaaatagccacccccaatgatgttttttggggcaggggtgaatgataccacttcagactctcatgggttttaatttattccttgttttataaccagttacagtcgtctttctttttaatgaccaaattgtcccagatttggtcagtaggaaccatttcaagctgactattgtgtgtcttgacacccctgctccccattaatcttggagtgctttctgacacgagttactccagggtttatcttatactttctttgctcacctctggaaagagctgtttatccagggagtcttggttctttttaatgagaaatcgtatatagaaaccaagttctggatgtttggcatattcgttgct

SEQ ID NO: 68084 - DNA, 1215 bp, Homo sapiens
atttgaaattctttgacttgtagaaatgttatcctaatctctgatttcatcttcttatgtcattctgtctgtctccaaattttccctctttataaggacaccaatgatattggattaggggtcaccccactttattattacctcatcttaactaattgtatctgcaatggctttatttccaaataaggtcacattctggggtactgagggttaggatttcaacatacgaattttgaagggacataaatcaactcacagcattgtttaatgatacagctttataataatttttaaatgtattttctcttttaaatcctttagcagagctctttacttcttcataaagctttaagttacatctaacactctttaattttgacccaaaaggacttcccttttcatttcttgtgggggcaagtctaaatggtaataaattctgttggcttttgtttatctgaaaatgtcttaactgcttcctcattttgaaggaacattttgccagatatataattcttggttgacagttctttgtctttcaccattttaaatgtcatcccacatccttcctatctccagtgtttctgatgaaaaattcagtgatactctttttttttctttttgtgttagtaaaaatctcacaattgtggcattttcactgaagattccttactgagttgcatctctcttgctgttttcaagactctttctttgtcttttgatggattgattataatgtgtcttggtgtggatctttttgagcttatcatacttgaagttttttggcttcttggagttgttgatgtgtgtcttttatgaaatttggggtgttttggccaagatttcttcaatacctttcttcccctttttctctctcttctctttctgagatctccataatacatatattaggctgcttcatggtgagccatagttccctcagactctattcattttccttcattcttttttctttctgttcttcagactttataattctaattgtccttgtctcaagtttgctaattctttcttctacttgttcaaattagctgttgaatctctggtgaatatttatttcaatttttagttttcaactacagaatttcttttttttttttttgagatggagtcttgctctgttacccaggctggagagcagtggtgcaatctcggctcactgcaacctctgcctcctgggttcaagcaattctcctg

SEQ ID NO: 68085 - DNA, 2134 bp, Homo sapiens
caaaatcccacctactacttcaccaagactagctttccacactctgaaatggatttctgtttgtggtctgttaggccactgtgtggtttcccctatgggattcctttttgtggttggaggtcaaattctttcttgcctgctgcttccaggaatgtgtgctgtgtgtctcagtgtgctgcacaggagggtcttatttcacctcccttgaatggaatggcagttatccagcaggtctgggtgcatgtataaatagagggatgcgtaagcctgcgtttaatatctagcacataaaccggccaccactgcgtgctacacagtcatgttttcattaaaggctgctgacagcaccgcagaccatgctgtggggcccagcaaaccacctaatcccactgcttgatcccaggcatagatggggcagatttcactgccaggaacaatttctttccagccaccgcagctctgagtttctgctgcttttcctgcttcagctgctcattgctgatgactctgggtcagacaggccagagtgcacatggaaggctgaagtggacagctaatccccaagttgtagtctttttttttttttgccagaagatttagattcactcccctgtgaatacttttgactacagagctgatgtcagaagagctggttgatctttttttctttttctttgttctcggccatgaaccaagaagggccattaaaagttcagcatttcagccaggcgcggtggctcacgcctgtactcccagcattttgggaggccaaggcaggcggattgcttgagcccaggactttgagaccagcctgtgcaacatggcaaaactccacctctacaaaaaatacaaaaattacctgggcatggtggcatttgcctgcagtcccagctacactggaggctgaggcggtaggatcacttgagcctgggaagttgaagctgccatgagctatgatcggaccactgcactccagccagggcaacagagcaagactctctctcgattaaaaacaaataaacaaacaaaaaacaaccagttgttcagcatttctgtatctttgcccaactttctacaatgtgccatgtgagagcatcacttcctagtctatacaggatacagtatgaattcctgcttctgccattcagattcctcacaatgtagtcccaaactacctttctttttctttcttttttttttttttttgagatagggtcttgctctgttgctcaggctggagtgcagtggtgcaatcatggcttactgcagcctccacctccccaggctcaggtgatcctcccatctcagccttccaagtacctgggactacaggtgcacgccatcacacccagctaattttgtatttttttgtagcaatggggtttcaccatgttgcccagggtggtctcaaactcctaggctcaaggcatccacccaccttggcctcccaaagttttggggttacagatgagagccaccatgcccagcctccaaactgtctttttgatcttataaccactgcacccttactttaacttctatgtaagtggattggtctactttccattttccaatgcgccttgtaccatttgtcattattgtagtggtctctttgcctagattggctcccattctctctgcctagtgaaagcttttctgtctactggggctgagtttgattctagggcctccataacgactctcatccacaggtgtctttctatagcacgcattatttctactattttgtcaacaagtaattgtatcataatccatactttattgttgtatatactgactacaattgaaagattttagattggaattctagattctagtctcccctagattggaaaccccgtgaggtcaggggtcatgcatgtgctatgtgcttggtaactcgtacagtgtcaagtgttctgttctacacatgagaggggttggaaagtgcttgctgattgaattaatcataatccacccttgaaaaagcagagttggcagtatttattagtgaatcaagtgacccttcaaggacattctctggctaagcactggaacactggaatatgaagtagtaattaaagttattctcaggtccagaagggaacccagagaatgttactctcctgacatc

SEQ ID NO: 68086 - DNA, 1050 bp, Homo sapiens
tgaaacatatagtcagtggctgcaaaccttttttttaaaacaacaaatttgacttttataaacatctaaatatcattttagctatatctgattaataaaatggagactcagatacaataatatcattttagcaaaagcaataaaccaggcacagtggctcatgcctgtaatcccagcactttgggaggctgaggcgggcagataacttgaggtcaggagtttgagaccagcctgaccaacgtggtgaaaccccatctctactaaaaatacaaaattagccagatgtggtggtgtatgcctgtaatcccagctactctgaaggctgagaagggagaatcgcttggacccgggaggctgagtttgcagtgagccgagatggcgccactgcactccagcctgggcgacaaagtgacactctgtcttaaaaaaagcaagaaacacacacacacacacacacacacacacagaaaacccatgatttttgcatgtggcttataaaagggctttgacggtaatttggaaagatgcctttcagaaatgtattgaattttaggagcattgctgtaataatagtggctttcactgactgaacatttgttgtgagtccttaagcactcgatatttaaaatcttgtgtaatcctaaaagtaaccctgtgaagaggttttttgatgagctacattttagaggcctggaagctaatggttaggatggttatccaagatgttaactcagatttctcacactccaaggtccgtgcaccacggtggtgcccaccttgaaggacaaacactgactggttgtgttcaacttagtattcttaaggccacttagggctgttcattgtacaaccccaggaggtgtcactcatctcctgctcctagcatatttggatagtgtttatgacaaatttctagcagaccacactaaagtgtcttgaggaaggggaggtctttaattcacagttgctcaaaagttgaaagttggtctcagtgcgccatggtcacctgtagaaggcagggccctgaaacggggagggattcaaaacctt

SEQ ID NO: 68087 - DNA, 1061 bp, Homo sapiens
ctcccaaagtgctggggttacaggcatgagccacctcactcggccttttctgtttttttaagacagggtatcgcactgttacctaggctggagtgcagtgccaccatcatggctcactgcagcctcaatctcctggggctcaagcaatcctcctacctcagcctcctgagtagctggaaccatgggtgcttaccatcacacctggctaggttttaaaaaaatgtttttattttgtagagatgggatctccctatgttgcccatgctggagactttgtattacttaggatctgacacaatatctcacttaccttttttctgtctttggagtgaactatattttcccctaatcttaggtgttaatttagtttcatggaacaggcaatgtacaatattaagaattgattgtatgggagatgctatggtaggtccctggcagaaagaatgaggatgcggaatgaggagagaaggatcagtggtgggcatggagtgacatggtcggggtgggaactcaagagagatgcaaacgtgagtaagatgtgggcttgaccacaatgtataaacgtagaggagacccaactatgaaggctgtccgtaagtgttatggtggtgggggcggaaggcataaacaaaatcctctgggtacacaggagatagagaaatacattctgcctgggagagctggagaaagcttcatgcagagggtgacatctgagctgactcttgaaggatgggtaggccccacacacacagagaagaaaggaacagtagcaggaaagccatgaggtgacagtggtctacgggctaacatgagagtgagctacacgtgttgggggtgggtaggaactgtggcaggaaaagcaaagaaccttgaatgtcctcttaaagactgtagattttctacgggcaacgggagtcactgaaggtttttgagcagaggagtggtgtcttttgatcttttgattttccagggctggctcctttggcgtgtgcggttacctggtagcgtcggttatatgatgtggtgcgagactgtgctttcacttttcctttccaggggag

SEQ ID NO: 68088 - DNA, 1024 bp, Homo sapiens
gtatctcgtgagagtattccgattttccactctgaagacaaagtggtctaggatccaagagcatgtattagtcggaattggagtgttctctccctcgaaatgtgctaggtaaccactgtcccggttttggattgaactcttttccttatgagctctagtcggccaagcacgctccattattataacatcatctgagacatgtcacaatgaataaggccaccacttgcttggctttgggtatgtgtccctgaggaaactgcaggagcacaccccaaattccttaactacatttgggaggtatcttgggcttttaattgggggttgtaaggacatatctgggcagtgggtgaggcttcctgatgttctcaaattctggagaaaaggagacaccatacaatgtgaccaaaatctacctctgacccgtctgctatcaaaatgtatcaaacacagcaacaaagccaaagaatcacctgcagactggggggcggaagggcttggggactggagagaaagcggagttcgtgaggtcagggtctgtcattgtgaactgtataggtttccaagaagtagcatgagtcttcttcatgatagaaaggtaaatgcgcacaactagaagtcttggggaagccactccagcccactgcagtgggaaacttagtgatttctgtttgtcctggcttcctccattcagatgtttctcatcagctacgttcagattgattccatttgcaaagctctcctggcagtctcggcggagcaggcttggtggcaaaatctctggcattttctgatcctgtccaggctctgctcttcttgtgtagtttcttggcgctttggctcccaagcagaaactggctaaacagaggctgctgctgaacaaagccaaatgtaaaacagaacattggaacgccaagcggagtggttttgctaaatgtgggggctgggaatgggcagaggacagtgagggatcaggagagggagggacctccttagaatcgggctgaattacgccctggtgaaagtc

SEQ ID NO: 68089 - DNA, 1036 bp, Homo sapiens
agctgtgaaatgcgggagtgaaaagacacagcacctgcgaacaccgatggggagctgtcagcagagagggaggggctgggtctttgggaagggaggggatggtggaggggctgagcgccttgagagggtggagggctgcagtattgagaagggattagttttgacagtgggaaaatacctctcatgtaacagaaacagaaggagaaaggatagattttaaaaaggatggatatacaatggttttcaatttatgatggttcagcttacaatcaattgtttgactgttcgatgggtttatcccaatgtaacccgattgtaagtggaggagcgtctgggcttaggacgattcaacttacacatttttgactttacaatggatttattgggatattaaacgcattttagtcttacgatattaccatgggtttattggggatgtaactctgtgtaaattgaggcgcatccgtagctaccagcaagatttcaggattcgtggtaagaaacgaacagggtttttaaaattacgatttcattttcttgtgttttttttttttttcctcaccctgtcctgcttcctgagatctgacacatttgtaggctaggctttcggtaatgtaactccagatggagaagagggagacattttttcacatcctaatgcaccagggataggctagcaggaggccacagttagtactgtgcaaagcctactctcttaggtatgctgtccttggtcctgtccctgtgagagattttcccccttcccctcacccacctttgggatctgaagaaccatctccatctaacagtgaaactagaaagaaccgagggactgacagaccatgtcagggccacacccaggactccaaacagtggtggaaactgaggggccaacaaggaggatgaggtagagaagctgggccatgagggagcctgggtgtgtatttatttatttacttttgagaaggggtctggctctgtcacccaggctgaagtgcagtggtaggatcacagctcactgcagcctcgacctccc

SEQ ID NO: 68090 - DNA, 1045 bp, Homo sapiens
tcccccgcagctacccttttcctattttctggtccagcaagaggaactcacagcatcttttcttacttccggagaaattcattccacatgtgtctgattcattcgcgtttacagaaacttgaaatttccagtgtccaaaaaccctttcaactattttttttcttccctttcttagaaacaggaagttgtgtttggctgcggacaaactctctcagtgcccctgggacttacaagatgtttggaatgaggaacggtgaggtctggggaaggcttctttcctctctcctttcctggggcgattcgcatctgccagggctgggctgggcagctctgggggctggaaggccagccggaaccttcctgtctctttctactgagccccaggcctgagggaaagtatgttctaaagagacaggtggctttcttgctctctgcttgtcattacggttcagaatgcacttgtgcactggtgtcatgtctcttcccagtacttgagcagtggctgtgatgagtcccttgatctatttcagggggtgtgggctggccggcactcagttttaagcaagtcctgctctttccaaagtggaaggtcagaaaaactccccacctgaagaagaacgagccagggaagtgtggtaccagctgtttaggaccacacctattggttacgtctggccaggtcattctgcagtgttgacctggaaagcacacaggtgcttaggaggggctggccaggggcagggaaagtgtgggagtcacagcccacccactccgttcgcgggaccctccagtttttactgttgctcgttgtgttctcctgtgttgtttagaatgttgtcatatgtacggtcaatacaaccacagtatttgtcgcattagtgatcaccaacattgagccaatgaagacgctggcttagatgggtgacttcttctttcccacattccacatgcagctctcccaatgcgagctcagcggaggcccccagaaaaacgtggggaggagagttttccccataagacagactgtccttcagccccggccacc

SEQ ID NO: 68091 - DNA, 1017 bp, Homo sapiens
agtttgctagtcctttgcaaacagactgacgctgagtgtcctgtctgagtcaataagtgcacttttaccttttaacctatgccctctacttgaacccgagcaaggtccagtccactggacagttgatgatagggtctgccgccccataccctctcctcttcccccttaggaatttgtgcagtactggaggggttgcggcaatgggaggcctgggtgggccgtgctgccttgatatggccaagggacccagtcaccacagtggagacccttgtctgcacctcagtaccgcatgtccaggagcacaagactggcccctgcccccctgaatcacagggggcacagctggctttcgcagggcttggcatcctcgggtttcagagccttgttgcaggtggcagaggcctggccggaggggtccctgcactctacagttcgcctctgccagccggccccgcaggtgctagagcactcagaccagtcccccagcacccactgtgcgtggagcagcggctggatgatgttggtggttgctctctctttgctgctctgcatgctaaagtccacgtcattaggaacaaagaaggtgtatttgacttttggggggaagacctcgccagggactgtcaggagctgcactgtcagaggctctggcaagggccggaagctctgcaggcgctccagggtggcgatggagccgctgtacttcaggatggtccccttcaccaagatgtcctgctctatggcagagatggccaggttgccgttgagcaggtactgcccatcagccgtcttcagcgccaggtagttcccatcgttctgcacacccgggtggctccgctgcttcacgtcaatattagtggcaccagctgggatggtgacaatgtcattgtagccataactgtgatagaaacagaaggacacccttagaccagtggctgcccagcccaggtcacgatgatgccttggagactgaagtgggcaccccaggtggcagacacgaaaaaaacaaagcaagta

SEQ ID NO: 68092 - DNA, 1083 bp, Homo sapiens
tattcaggacaatctgtgatttaaaacgatggcatcccactctcaccaccacaagcccaggcctgctggcttcatggggacctgtgcctgcctcctctccatcctgccacgtgctgctgccagaccaacccatctgaagttagatgtgggttgctttccacccccaaatcctaaaattaaagctgttcttcctgccaaggttccctgcccaaactgtgcatctgaatgcctggggagactttgccaaggcagatgccatactccacgcctgagactctgagtcagtgcagctgagggggtctgggctgtgtctgcaggagcttccaggtgacttaatgggacaggtggcacagataactcccagatactgtgtcagccttcaaggacctctgtggtctggccttgacatagtggtgtgctttgcttgattccacctaagtgaatgagggcccttctcacacctttccaccaccctggcaggtcccctcacacctcacccatctcagtcctccagactctgctcagtcctaactcctttcaaagcttccgctcacccagcctttcctttctccgagcgcctcaccaacctagggtctgtgactcatccattgaaatgtaatggctgtgttaaagggatttgggtctctaattggactacaagctccttagggacagagaccatgccttttacattttcatacatttttatagttctagacacacaaaaaatactaaaaaatactcgacagtaatggcagactttggtgcatctgacatcatggcatcacttttcgtccacacctaccttgcaccctatattcattctcatcctccccctttcccagcaacgtctcaccctgtatgccaggcaaactctcatacaattccagggcaaagtttctagagcctcaaaccattgtggatccttcttgtcttgtgaaaccgcaaagcctacagattctcctgagacatcaacccaatgccagtgtcttttcccgtggttgaatctctcctaaggctctgcctgatttttcttgcctgccaatccttcctggagctgcacactgggcagttggatgggat

SEQ ID NO: 68093 - DNA, 1027 bp, Homo sapiens
ctggtcgggtgaaggtcccctcccaagtgttttttttttttttttttttttttttgagacagagtcttgctctgtcacccaggctggaatgcagtggcgtgatcacgggtcactgtagattaccctcccaggctcaagtgatcctcctacctcagcctcctcctaccagcctggccaacatggcgaaaccccatctctactacaaatacaaaaattagctgagcatggtggcaggtgcctgtaataccagctactagggaggctgaggcaggagaatcgcttgaacctgggaggcagagctgggattacaggtgtgcaccatcatgcctggctaattttgtttatgttttgtagagacagggtctcaccatgtttcccaggttggtcttgaactcctagacttaagcgatctgcctgccttggcctcccaaagtgctgggattacaggcatgagccactgcgcccaggcccctcccaagttttgacagtggttgttttctaggtttcagagctcttgggaaggaaaactttctgggagagtgggtctttgaagacgaaagaatatgggaagagaagggcatttgaagtcctccatggggctcctagaagtggaggtagtgcttccagcaagcacaggtggcagacctggctgggtgtgcagggcacacatcactgcctctggtgcacccgggttcaggctggtcaccctcggaataactgttcactcattaggaggtgtgactatcatctgaccgtgggaagccaagtttgactgctcaggtggtaaacctctgagtgctttggattaaattttgctgattttctgtactctgaccgcttttcctcccatgccccctggctcctggctccctgcgctgtgctgctgcccaccttcgccccttgccagcatgtacacagatgcacatgtggccttgcatatacgtgcacatgcatgcagacacatgcttctttgcctgtggaaggtggtagtaatagtcgttatttcagtgggatgttgtgaggatta

SEQ ID NO: 68094 - DNA, 1050 bp, Homo sapiens
ctattgctcaactgatgtgtgttcagaggatccaaactcatttcactgtcattctaaggaaaacatcatggacaatgtaaattttattctctttctaccctgtttaaaaaaactaaaaaaaaaacctaaaaaaaaaaaaaagtcctccaaaacactgcacaattcaccccaaagccaaaccgagttttaggattgcttaataatgtcttatctttatctcttcttaaaagaaacttcagaatggttcacggtgaaactttctcaaatacagcccctgatcgaggttaagatcagtttggtctggcatcaagtctgaattatagaacactaaggaagaaaaacattcacgtctatggtgacattttttatccgcagggctgggggtggccatgccttagggatgcctgtgaatgcactaacaacaaataaagggaatcttttctgttttttccttttattcccggcaagctgtgagataagagcactctctgaacttttgccggggccagcgtggtgctgggaattttcgtgcctgttacgccacttctgtcatccatctgacatcaggcccgagtattagtattatcaaacccatttttgcaagtgaagcaccggaaagctaaggagggtttgcccgttgctcaagcccactagggtgctgtggtgtgggcagagtccgttgaaaacatgtctggccaggcgcggtagctcacgcctgtaatcccagcactttgggaggctgagaagggcggatcacttgaggtcgggagtttgagaccagcctggccaacatggtgaaacctcgtctctattaaaaatacaaaataaggccgggcgcggtggctcaagcctgtaatcccagcactttgggaggccgaggcgggcggatcacgaggtcaggagatcgagaccttcctggctaacacggtgaaaccccatctctactaaaaatacaaaaaattagccgggcgtggtggcgggcgcctgtaatcccagctactcgggaggctgaggcaggagaatggcgtgaacccaggaggcggagcttgc

SEQ ID NO: 68095 - DNA, 1052 bp, Homo sapiens
agatggaaatgaacacttggaaagttaatatctttgatttttaatacttcttcctagagcgtagtccgatgtaacagttcatctggcgagattctgagttaccaattttttatgggttttgcgttagaataattttataataatcaaaagtaaatgagaacaaggccaatagcataaaatttcactccttcacactcctaagtgtttttcgaggcactgcggaaaaggaagcatctatcgtggttggtccagcatcccttcagtagcttagatctgcagaaatactgttggaacatcgtttctttattcttcccatcctttgtgtgttaggccaaaccctgaggactgtctgccttggaatagagaggaaatccaagcatatgtgcaaagttgagctgcactttcagccccaggtcttcaatgggccttctccacaggcacctgtgaaatgccagcagggtcgttgcatgtagagggatcccactcagtgcacccctgggaatggctcagccgcactgtgggtgtaagcattaatcacacaacagccattctacatattccttttttattctccagagagtgccaggaaaagtcctgcccagtcaaaagtcttctcttgcagctgggtgttgagggtgattgcccctctctctccttgtaagattatgtttgacagcagtgaaaaccaacagtttaacagcagtaatctcttggcaggacagattgatatgagccttgtcccaaaacaaagtaatcctttcagggaagtgtatttcaagttgagctcacgttcccaagatgctgagattcttatgtagctgacaccggagctgaggctgagccccagccagggatatccaacgattgccagtaacaccacggaactgagtgaagattcaggggctgagtgtgttcctgagtgcttcaaaccgggggacctggaaaccagaggactcctggggaaaggctgtcaactccagcctgctcttcctaaatggccttgttagtagtgacttcagccctggcggtgaggcatgtgggtcagaataaca

SEQ ID NO: 68096 - DNA, 1332 bp, Homo sapiens
agagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctgagcctaggagcatgtataaattttatttttattattattatacattaagttctagggaacatgtgcacaacatgcaggtttgttgcatatgtatacatgtgccgtgttggtgtgctgcacccgttaactcgtcatttacattaggtatatctcctgatgctatcccttccccctcccccgacctcacaacaggccccagtgtgtgatgttcaccttcctgtgtccaagtgttctcattgttcaattcccacctatgagtgagagcatgtataaattttaaaatcaatacaagctactccaatttccattttggaaatttccagtttacaaggtgattttcttattgttgtaaagaaacacataatgtgagatctaccctcttaagtgtacagtacattatttatttattttgagacggtacattattaactagaagcagcacagtgctttgtagcagactgctacaagtttttcatcttgcataaccaaaagtttatacccattgaacagccactcctcgtttcccctcccaccagcctctggcaatcactgttctactttctgcttctgtgagtttgactactttgaacgcctcatataagtggaatcatgcagtgtttgtcctttgactggcttatttcacttagcataatgtcctccaggttcatccacgttacagcatgtgacagaattttctttttaaggctgaaaacattccattgtatggctatgccacattttctttgttcattcattgagggacatttaggttggctccgcgcct

SEQ ID NO: 68097 - DNA, 1076 bp, Homo sapiens
aagttagtatgattgattaggaatatatgatatgcaagaataatggctgatgataacagtgaagagtttaaagggagtctgctcattcagactcctgtgagtcattccaagaacaaaacatttgtcactcatttgataggaaacaattttacaaaacataaacagatgatgacatgagcaaatttgcaattgagaaaaatcatttaaatagtgctgtggaggattaattaattgaaggggccaaagttagaaacaggaagacaaattagggaggagtttcattgatagaaaaggtgatgaggcattcagctgagatcattgctatagagatggtaaaggggtaatagattcatgagatattgaggaggtaggatcacctatatttagtgactatttaaatgattatgtggtgttggattagggttgagaaaaagacaaatcaagaatgactcacacagttttccaccttgcagattgagaagcataactaaaaagatggggtaatatctttctgaacagcatattggggttgtggttaaaatcctgttgcttactaaagtaatagattagtatctactctgatttatataaaaatcaatgatgcacccagagaagcctgtactgtatctctaataattttgagattctttttagtagaaaacttaaggcccagattatattttcaactttttttctatctgtaagtttctttagaagaaaaatgaaaacagagaatgaatagctaaccttgtagctggtaccaaggcaaggtttttaaattttctgtgccatgacgtatgattattcacatggtgaacttctgaccacagacagaatacaactcaaaaatagtagaaagaatgtgtttgtcagcagaccatcaacccagtgaagagtaagacattgacaaaaaaattcagataaagttaaaactggatattgagaaaaacagctgacacagaaaggaaagcagagatagatgagagtactggaattcacaggagcgtaacagaatgagataaaaactgttttacatgctgtaagaacagattaacttaaaattcacgcctgaaggt

SEQ ID NO: 68098 - DNA, 1036 bp, Homo sapiens
tcccatcctcctttcctgtggtgggagttctatgtgcagagcagaacagggagatctccctgtgaggtaaagcccccatgaacaatagggactctggtcgtcaagacaaccactaaattactgccttcttccctcttttgtgtcttgcctttcttcctggtgcttcagcactaagggttttgctccctctccctgccctttcccctccacggactcaattttcttctgaatgggtggccattttaattaccttcccccttccccaccccacctctctgcccttgcccttgctgctgagaaaggcaggctcaggataactacctggggactgagaatgagccaggcttgctgttcacacggggacaaggaaagaagagacagagacatttggatcctatagtctctgcagtgaaagttttattggttggtacatggaggtctggttttaggaaggattcggaaatagagttttcatattatccaaaaccccctgaggcctcgtcccaattttcttaactgctcagtaccaaatgctttactggtttcagtatttacttccctgagcctgccaggaagagtaagctttacaagtgagaaaactgaggcatgaaatgcaaagcttactccagatcctgccatcattagttcgctgaacctggttgaatttttacagaaggtctgaagtagtctttttctcttttacatgtgcaaacacacaagcacttttagaaatactttttatttttcttatttcatcttgatgataactttgtgaaaaaggcaaggcaagaatttgcccattttataatgaaggaagccagagctcagagagtttgttcaacttttatgtggttaagccaggttcaaacctgtctgtcgcttttcagtgtcatttttaaagtctgtcagtcctgattttctcagaactggattatagtatgtcggtagcaacatagtatggggccaaaaaaaggttgacttgaaagacttcagaggcacactagatttgtgcatagaaaactttcagattggccgg

SEQ ID NO: 68099 - DNA, 1008 bp, Homo sapiens
atatcagctcccaatccttgcaatacaaacagaaaagaaaatatgtattatatagggttaagagggaagtatgattcagttctagtagatctgtccaaatcggaagtcattcatgttcaaggagagcttgggcaaggtgatccagagagtatccgtttgtcctacactaacaaagtcattgttgatattacttataatattaatcacagcagtggcaccagatatctcagatccattctgtaacatcacatacttggaggcaaatcagacgtgacattggaaccccaggacaggtttaaacagcacgtgcttccttccacaaaatacatttgttcaggaaaccttagtttagcatgggtataagctcatttgtggcccttacagtctttgaaacaggaaagaacgtagtaattgttatggcattttaccagaggtgtggtgttcttcctagaaccacatgttatctcaaaatcagactgaagcctcctgaatcctaaccccacagctctgtgtaatggaggtttttcaggaaagtgaatgccaactctttccccacttctgccacggtgtttccataatgctttgtgggggcgagtggaatgcaaggttggaaagagaggaggccttgccagttacacttagtcactagttgtgattttctttggaacagaaagtattcagcatcctggggaaatacagaagaaatagaaactaagtaggcaaaataagtgcgtgtgtgtgtgtgtgtgtgtgtgtgtgtgtgtgtatgtgtatatatatatatatgtatatatacacacatatatatatttagcagatatatatataattagaagatatatatcttttaaaaacatagaaacatttattaggttacaatatcaggaacattaataaaaattgtaaagaaatgctgagcctgtcactgaaccttctagatatgagttaaacctcttttgatttgagtgtagagggattgcaaaaataccagatgattggcatgaaggt

SEQ ID NO: 68100 - DNA, 1089 bp, Homo sapiens
gtggtttggaattcctaccagttctgggttggcaggttggcttctcaaccatggtgggtttcggataatggatgacaagataagaaagaaagctagttcctggaaaaaaaaatggatgaccaaaaatgggtgcagaaatgataatcccagggcaggcctgttttacttgcaacttcggtaaaaaataaaatctttcctaaaggagtcatagcatcagttgggttttatacccaaggtacttatgcaggggagaggcagggaaacctagagtgctgcatttgctcccctactgtcagcattccatatgtgatatgccactgactatttcttaggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggtgagtggcgaggtctctgctcccatggagaagggagccagggtggcatccacttggtacttggggtagttggagtttgtaactttgatttctgttccattcagctgagcatgccatgtgttgaactccagtgttggaggtgctgtgttggggcacagagatgagtagtacatagttgccacagcggaatcaagcagcagaacagggcacaaacacaggaagttctaatccagcaggatgagatcatgctgataatattgataactcattaaacttatttttggcatgctttggcatatcagactcttgcatttcttagaaactttcttcccttagtgtctcagtttcctggtttccttcatgcctttttcgtggcttcttagtccactctgttggctccatgatccacctgccagagcttgatttttggctcgctgtccttattctacacactcttccagggtgactccagctgtagtgttggcttcagctctaacatgtgtgtggtgatgccttaaacattgaatattgtatatcttcacttggatataccacagggcaactgaaatgtaacgt

SEQ ID NO: 68101 - DNA, 1019 bp, Homo sapiens
aggcaagaaggctagcaagtgagaagccctcagttacccagggacctttccccagttctcaaattgatccccaatcctcagccaacactcaccctattctcaagccctagaggaaaggaggtgggtcagacataccagtttttaggcaaagctagaccccaggctcctcagttttccacccggaggagcctgcggtgctgcagaggcagcactgctgaatgtttggttttgccatgggaacctggggcccaactgaccagggatgtttgactaggaagaatattctcttttgactaggatattctctttcctcttttcctggaaaattgagatgtttctttcctactaagaattaaggcttataactgatctctgtttgccatcatttctggaaatcttggctcagaagttgcatatattagcaataaagaggaaagggttagaatggaaacctgcagggcctattttagtaactggttgactactgctactctttcctgcactagggccctagctgttccctggcagcattcaaagccaacatgtggcaagcaagggcaccacatgtacccttactggaaatttcatctatatctgggtccttatgaaaaaagagagagcatgtgtgtatgtgtgtgtgtctctgtctctgtgcttatgtttcatgggccagcaataacagactcacagtacctaaccttttcttaactgggcccatatattgagggatgaccatgatacctctgcttatgagtctctgtcccttgaaacattgatgttatcacttgcagttccttttctggttttatttggaacacaaggggaaaaaatggatgtccaaaaaggatacaccatgaatagcaataatgaaaacttgctctatgccacctgtctgtttaatcttcagcaaatttttaatgagtgcctattatgtgttagctaatctatcctgtgggaatataaccataatacacactgatgccagttttacttagcagaaaccatttcacaagtgcact

SEQ ID NO: 68102 - DNA, 2867 bp, Homo sapiens
gtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaaggtaacaggattaaagctgtgggtgctcacccgggctaggagtgggtttggaaagcagtcatgaagcaaatgttcttgggggagagatgctgttagtttgaagtggttctttcaataggcatctatctctgtgaatggtctgaagctaatatgtaaggcagagtagcgtttatcctgtactcacacaagcaatcctggaacctcagggctgctagaatgctgagggttatattttcagtggttcccaaacttggctgcacctcaaaatcacttgagctgcctttcagatatacagattctgacagactctgttggattctgtatgagaatttctaaggagggggtccctggattctgtattttatttattttcaaatagaactctccagataacatagagtcagcctgtcctaaggccatcttggggaattgcctctctaatccaaccaaccctcttcatgttatctcttgtcaagttgttcccaagtctgcttacacacctccaagagtcaaaaacttgctatcttctgagatagacataggtaaataacctaccttcctaaaacaaagtacaaaatgtaccagtattttgaaaaagaaatcagcagggaagaagttgagaaagaaaattcttggacaagatcctacccattggattttacttgccttccacacttgaatttctctcatttgagtccacaagctaccaccagggacagcctgcttgctacactcctccgaactcccaatccaactaagagggaaaagaccttccttgatctgctcaacacagctgcatcatgacatagcattttag

SEQ ID NO: 68103 - DNA, 1076 bp, Homo sapiens
ttttttttttttttttttttaacagggtctcgctctgtcacccaggctggagtgcagagatgcagtctcagctcactgcagcctcaacctccctgggctcaggttaccttcccacctcagcctcccaaatagctgggaccacaggtacatgccaccatgcccagctgatttttgtatttttttgagagacagggtttcaccatgttgccgaggaggtctcagactcctgggatcaagtgatctgcctgccttggcctgccaaagtgctgggattacagatagatgtaagccaccacacccagccagagttccaagccttgaagagaaaccaggtggtggagaaatcgtgtatggatttgggtaaaggagaaaggaagctgtggaaaggggaagaggctgagccagagttgtgggtaggagacgtacaaggaatggaggcaatgcagagacacggggcaagattcaggtgcctcgattccaccttttgtaattcaggggtcagggatcttgtcttacttttgttgttgctttggtatgctgcacagtgcctggcacataataggagctgaatgtatccttggagaatagatgcatgtgttttgctgtgttgcttcagtagtgcctactgtacatctcctatgagccaggagctgttctaggtgctaagttcctctcttgcagagtgatgtttagtgaaggagatgagggttgcaacttgtatggattagaaaaaaaaggcatcttctcctagcatgcaacttgcacagaccaagtaggagtaggcattcctcgctgacgatgttgttcactagagtccctggctgagtaaacagagtgccagctgcattattttgttaccttcttcagcccttgagcagcgcacaagctgcacaactgtacttagcaggaaccagctgtcggaaaacaaataagtaaacaaacaaacaacgcatcacatggtggaaagtattggggcaggaagtaaactgtaggttaggggacagagtaacctggtgtgcagggaggggtaggggcttgcacgatggtcaaggtggtgaactgtggggagagccatg

SEQ ID NO: 68104 - DNA, 1034 bp, Homo sapiens
ggagggaaattattccctgtctgtattgtgtatcaaaaacgtctactcttttatttctgcagaaacagaagttctgcgttttcactcaggagtagagtcagcagtttatgtgtgttttcttaataccctcttagcagttaattattccttttaataaatgcaatgaaaaagaactgttattggagtcatactttagttgaattagtaatttattctagctcttaatgtttgttaatattctgtgtattgcttcttgttctattagacagatatgacagggaggtaaaacgtgagctcacacaggagttgtgtgggtggaagtctctgggcgatgcatgggccactgacaggtattggtgggtgggggtacatgttgtagagagaggcctggagatgcagcgatgccttctcattactgcaaaagtgactgaagtcgtatggacaatttcttggtcagaggtgaatgaaatagcaaagtctttcatataccacataaaaattttcatctgaaagtgacttctggaatcattaagcctcttcccatttctctagttacagactgatctaagcacaggtgtattctacacttaatgcctcggtaatctggttctgggtctaactctagcgataaattataattttttacttctagtagaaatttacatagttttccatttagaaagctggccccatgttagaattataataaagggcaggaggtatggattaatgttattttgtagggcatgttcagcaaagtgtctcaaagggcgggtaaaaaatgagattctttctttaggttgcacgtagcaagtcctctgaacttgagtgcctttttggtgagattactgagccaagcctgaaaataatgtcgtttgctatgtctggatcctaataggcatgctcttaattaatttaactattacccatcatttgttcattccttcagtcatttctctaacacgtatcgggtgcttactacgcactggacaggattgtaagtggtcagggtacacaggtcacccagaaaaggt

SEQ ID NO: 68105 - DNA, 1086 bp, Homo sapiens
aactagtttagtttagtttctctgctcttctaggctttttccaataaaagattcttcatagggttattataagtattgaatgacttagtgcaccctaaacagctagacataactatgaaggattatcatcacccaaatccttgagcaaagggagaactggtagtattcgaagtatccagccatcctgggcatgcaaggtacctctaggttataactgagatcgtatttgaagtggttctgtgctcaagtggtttgagaagctccgagcaacattctgaggctgtaatcccataagacctttgctgtgttccagaaaagtccacccctgacaaatcaaaggaaatgtatgtgttgggggaagggagaaagacaagatattctagccttgccatgaggacctccctctgatggctgctgtcgtctctcagtcccttgacgtacctgtctggtcttcccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaaggtaggtgggcggggcttggcggggagatctggctggccagcctggaaagccttcaggtaaaggtttgttctctgatcctcaacagagatgagttatccttattctacgcatctggggtccagggcacatttctggttgtcattttgcagttagaagctaaattttccagtcattttcattgagtggaactaggaattgtttttttcatttttgttccaataatatattttctcaggaaattatcttgtaattattgctcttcttggcttttttctcccctaagttttagttatttttgtttgtttgttttttgttttgttttgttttgttttttagatttcatccaattccaagactgtgttatgtttaaaaccagacttttaatgcacttt

SEQ ID NO: 68106 - DNA, 3602 bp, Homo sapiens
ctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaccactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatgaaggggggatgctctctcccctgttttctgcctccttcccttctccgtcagggaagggaggtgtattggaaacagctacactctcaatcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccactcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagttcattttctaatttttttgtgtacctagggagtgcttcctgatgttgtctcacccctggccctaggtctccctaatcaacccactttaaactcacgactcaacatgattctgaaatggtttgcggctgggagatgaagaggttgcctttcgttcattgaacacacatgtactgagggtatactgtgtgtgagtcactgtttagttcacttggggtgcacaagtgaataggccagacaaggctcctgctcctggagggctttcattctagtgatagggacagagaatgagtcattattgcactaagaaaatgacatcgaatggcataaggcaaaaaaaaggagcagggtaaggggcagctgacgtacagaaggaaggagggggctgc

SEQ ID NO: 68107 - DNA, 2893 bp, Homo sapiens
gggaatctcggagggcagggggttgggctggggaggtgacttgcattttcggccttagaaatgctgcgggcatgcacgtgtggggttttcatataagccatgggaggggcgagtgcccagccctcctcacgctggtggtagaacccagggctttggcctccttttggcatagtggtctatgaagctgtatttctggtggagggatgagcctcctcacggtcatcttgcagttcttgaaagggtagttgtcagccactctatcaatgaggttttatatggcctcccatgaacaacgagaggtgtgccatggccgacggtgtcctggcagggctggagaagggattgtctcatgtgtccttctgcaggcaccaggttgtccccctggtctctaacccccagccagctgtctagtccagtgtttcttttctggattcaggaagtaagtggggtgtgtgtgtgtgtgtgtggggtgtgtgtgtgtatgtggtgtgtgtggtatatgtgtgtggtgtgcatgtctgtgtgtggtgtgcatgtctggtgtgtgtgtgtgttgtgtgtggtgtgtgtatctgtgtgtggtgtgtctgggtggtgtgtgtggtgtggtgtgtgtattgtgtgtggtatgtgttgtgcgtattgtgtggtgtgttgtgtgtggtgtgtctattgtgtggttgtgtatgtgtgtggggtgtgtgtggtatggtgtgtgtgtatctgtggtgtgcgtgtatgtgtgatgtgtctggtgtgtgtgtgtgtgatgcagtgtgtgtggtgtgttgagtgtggtttggtgtgtgtatgttgcgtgtggtgtatgcttgtggtgtgtctggtgtgtttggtgtgtgtgtgtttggtgtgtgtggtgtgtctggtgtgtttggtgtggtacatggactgtgtgtggtgtgtgtgtgtgctatgtgttttgtgtattgtatgtggtgtgttattgtgtgtggtatgtgtgtattgtgtgtgggtgtggtgtgtggtatggtgtgtgtatgtctggtgtgtgtgtgtgtgtgatgtgtctggtgtgcatgtgtgtgatgcggtgtgcatgtgtgtgatgtgtgtgtgtgttgtgtggtttggtgtgtgttgtgtgtggtgtgttgtgtgtgtgttgtgtgtgtgtgtggtgcgtgtgtggtgcgtgtgtggtgcgtgtgtggtgtgtgtgtgtttgtgtgtgtggtgtggtgtgtctgttgtgtgtggtgtgtgtgagagagatttgtacagacatgctgatttgcctgcgtagtgtcaggcccaggagaccctcctttgtttggctcttttgctagacaacttctgtttgggtaggagggtcaaattagtaatgcaccatctttaatgtattttttatggagactgtacataaaattatataaatctacagaattggttctattttaaggagagaggggaatgtatgtgggaggcaaggatcagatgcaatcgtggagactgggagcttcgggcgagtggcactcgggtgtggggagcgggagggcaagagatgagtgccgggcaagatgggcaggggcccgtgccctctgcacacatatataaatataaagaacacctagataaagtctatatatctctatatctatatgaagtcatagtttgctttatttttgtacctgtgcttagagatgttttgagcagtgctaccttcccaggcagtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggagggagagatgaactgtgggccggcctgggagagggggtcttagtggaaccttccttctggcctccagccggggacttacaaaactgaacaatgtattggcagaactggacccacaatgggagattctggggagcaggagttcacttgtatctgagcaggaagcagtgtgccctgaagaatacctctctgagcaaattccagacctcacacatatgcaagggctctgccttgcagcctcagcaagcgtctcctggtgctagctccttcctgacttgcccggagctcggagtgatgtatttgaagctggtgctgggccagatggtgcaggcagtgaggagagactcaggactgcaacctttcggctccttattcctgctcatcactcagaaaagggcagtactaacccctttcctaaccaagacatggcactccctaagagctcttgtctatagagtttggtccttagaggaaagcagataccttcagcgtgagaagggct

SEQ ID NO: 68108 - DNA, 5583 bp, Homo sapiens
ccaccccactctaggtgtccccggggcgaggttgctgggctcaggcagggagggccactgtgtgggggtgtgtcctcctccgtctgccaagggcggcccagacctttgtcctgcatgccccctcttttgccagagcgggtgtctccctccagatcctggccgcctgtcttcaggacggagggtgggcacaccttccacctgtgggtcgaggtcaggaagtggattggagactgggcaacacctgtctcctcccctccgccccctgcttcactaggttgatttttctcatctcttccaatgtctttggaagtgaagaggaaagcaatggcttttactgctctctgcttctgtttcagtttttcaagtcctggaagaaggctggacttaatgtccatcttccacaccccacatatatatagatatagatacagatgcatatgtctgtagtgtgtgggtttctctatgtgtgtatatatatatatatatatgtacattgaggcaaagtgctgttgctctctgtggtcagtggaggcaggaggaggagggcagtggccagctggggtttgcgagcagggctggctgcacgttggccaggtgcctgacatctgtcttgggggattctttctcccaaaacaagatccgtgtctctcagctgaattctccgtgtgtctcctaccttctcccacccagagcagaaatggggccttgctgtgattaccggctgccttctatgggggttcagtaatgagttactgcagaactaaattcaagcctttgtttcttggttcctgggtgaagaaggggtggccaggctcctagacctgcatctttcttccttccagcgtggctcacgctgcaggagtagaggctaactcagccgcggggctaaagcaagcctctggtgcacatgtccagcgcatccgtcggcgcccttccgcccagccaggccgtgagctctgtggccaaagtctccccactgcggagccacctgtgctagcgccaagctgccggctctatttataccgtccccggctcagcactctgtgcagtgctgttccacagcggctgattggatcctcctttgcttttgtgggagctaattctccagattgattaattaccacttgtgcggagccgcctgtggctttcccgcactcaccacgtgctgcctgccgactcttctctgccccggggccttcgtcctccggtggacctgagctgcagggggatgagctcaggtgaagctagggcgcctctggctgctggggcctgggacgctctggatcctgccctctttgcccagttctattctgtggctgaggcgtaggaatgaaggcgggaggggtggtgagtagggtctgggcactgactcttcctctgccaaagtctggtcctggttcaaactcgtagcatccagaagcttcctgagatcatcttcccactaagatgtctctctgccggtaagatatggtgctgcccaagggcagggcagaaggccccgagggcggggtggaggggagatctgcccctcccccactcttgtgtaggagccccccttctggcttggcttagaatgaaggttccttgaagtatttccttcttggtgctgctgtcttggtgggtttgggggcacccacctctcccgagttccctgcttggacgtgagccacggcagcattggatggcttctgctggtctcatgcagctgccatgggcttggcccagtgacctcgcaggatgaggccttggatggctgctgtctcttcttggcgtttccatcttaggggatggacttcttctgtgccacaccggccctggtccttcctttcacccagggagctgaggaccagctccacccttgaggtttaccgtgcaagtaacaccaccgcagttcctttctgaacacatctgaaggggtcatggtgagagaggcacgcaggggcttctgagactgggccgtgcacccttggggtggaacctgggccttccagttgatgtgcttctctggggcgttggaatccacttgaccactgggcaccagctctgcgagatggaagagcacacaactctttgtgttcttttttccaggtagcacaccctctgcccccgcgtcgtgatgtgctgctcacttgggcgtctctcctgggggatgacgggagccggcttacctgaggtgttggggtgggaggtgggggcttaccgcaagctgacgtgcagcctttatgcactggcagtgtgagatttctaccccagaggagctcacggggctcagccaggccctgggatgcactgggatgtgggcatcaggctgtcagccttcaggatgaatttggcctacttttctgagcaccctcctgggaattccagccctcaggttagaaaagaagaggagatgatgaggtagaaggctttgcttctttcggatgtcatgagaggctgagatgctcaggccatggctgtgccttccagggcacccccgtgctaacccaggtgctgactcctcctccgcttcctctggcagtgcccatgacctcagcacgtagacccaacgcggggagccgtgcttttcgctggtcaccgagtggctgctgtgctgtggcttccctggctagggcaaggacgtcaggtctgcccatctctcagtggcctgccactcattcagctcccctgagggcttcctcctgtgacagtgtcctcggaggccagcagccctcctgcagcccgtggacggcgatgggattggtggaacgcagttccctccgtggatagagggtgaagatgtcacaggcacaagtttaggtgctgggtgtgggcatgtgtgacagcgtggttgtgagcatgtgggtgatgggggtgtaaccacctctagggaccagtgtccttcatagtctgcctttgaacaatggcagtgactactgatcagcttcttaggacttcggcactcactctgtaggagatcacgccttccaaacttccccttttacggtctggcggccttgcagtagacacgactcagatgtaaacctgcttctgtgtctcagatgtctgtctgcctcttcagcatcatggctgagaactgtggctgttgtagtgtcaggtgacccacagaccaggaagaggggaaaacggttcttagcggggcctggacaactgcatttgcgtggggagagaagatgtacgacgaggcagagaggcgaagcctgtcttgatttgctggtgggctgccgtgggctccctggtgctgagcggggtcctgtgctggattgttggggtggctctgggcccagcatctgggagtggccctgcctgctgccagtctgcctctaagcagcttccctggagagactgggggtaggacaggccttttgagatcctactttcttagcaggaaggacgcctttttcccagcaggctggcggggtctgtgccctcctttgaggtgcttagtcccacaaccatgcgcttgggggaagactgaagccgggtggattgagccgagtatttcttgttatttttccatgctctctgtctttatttttgatttgtgatctaaaatatttggggttgaactgatttaatttattcctctgccctttttgtgctgaggaaactggggtaaggttcaaatgtgaaattttctgattttatttggggtgggggacaaggttgacgaaacagtagcttctagggagaaacagatttcacggagcctccagcatctttggcactgcccacgatctgaatctccagggctgaagactgcgtggctggaatctgtttcttcctattttgttagcaaaagccttttccaggcttgggggtggggtgggggaagaattgtacataaagtacattttattaatctgtagagaaacctaggaaaagaaaagctaatggttaatcttgggcttgctttgcttgcatgtaaaggagctttgggggcactgcagggatggctggggagctgcaggaaggggcagagggtggagctgagcgggtcatggaaggctctgttgagtccagcctctgtggtactctaggagctgtgcacattcccaccggggcttctaacccagccctgcctgggtatcttcttcatataaagtggatctagtaggcagtgtgtagagccccatgtggctgtgtgtgttgctttagggagagggccaaagaggtgccttattggccagctctagattgactagggtaatggatggggcactggtgtttcaggagggggagttggagaactggagggtggaggggaggcctgtgtgctttgccaggtgttggtgaggctggaaggggcacagagggtgaggtcaggcatgggttaggatggtgagaccaccccaggggacaccaagcctcagcatctctttgagtcatgtgataacttagttacttgtaagggtgcagggtacacactgggggatcatcccaagatgacgaagaatgattgcctggtgggcatctggctggggagtggtagccatgcagggcatgtgggagggggatctgggcatcagggacggattgtggggtggggtcctgcatgtgaacgcagactggatcttgggagaggtcttgcttcttagctagatcttccttgcttcttctagaattagcctctaacactaagtgcccaaaccaaacatggacatcttctttatattgtatttcaacttcatttgttttgggggctcctcaggcccaaagctgagaaacttgtcttgagatgcccatcctatcaccagctcttcatcagtggagaaggaagtgccattctcattttcctaagctgcagcggtgggttgcctctccgtccacaatctgaaaatgttcatgggccttggtgatggtgatggtgatagagagggggagctggagcctgacgtgccttcatccccctttcctcttgaggtagagaggcttccttccggccatgaagttgcacagtggcttcgtgaggccttctctttactttctcttcttttgataggctaaagtcactagtctgtggtggaggtgggagggcaaaagagtttcacctgaaactcttggcttgaccagccattcttctctctttaatgtctccagctctgcttctttttagattaagaggcagaatgaaaaatctcttctttagaagaagtcagtaaaccaaggatcaaagcccagattggactttcgcactcttaccagcttgctgtttggctaggggtaccaatcaccacccttccctctgactgcgagtgaatccacactggttcagagccttatttctgggttcctgtctgtactctcaaaaccttctttcaggagcaagtataataaccccaccagatgttctgtgtgttgggttgccgagaaggtggaagtttttttcaacctcattttaagctgttagaaaaacactcagtagattgaatttggtccaaagacaccaccatcccctgagggatcccatgtaggataaggataaatgaagcatccatacaggggtcattaatggctgctcacatcttagagaaggaagagtctgggtatcttggttgccatatactctggtggaacagtggc

SEQ ID NO: 68109 - DNA, 1060 bp, Homo sapiens
ttagcacccccttttctggagatggaggatgattcactgggatgggagctgcttgccccctgctctaatatgcccttttactttccattcaaaggtcttgattgtggtgatttctaggaactccagacgttcagcctacttctgtctctgacactaaatgcatcccagcttgcgttacatgggaaggtgcttactattaaaatctctctgtctgcctttgctagggtcttctgattgctctgcaggttggtttccatccgaggtgggccatgctcctggagctttctactgggttttcttctttccaggagcaatagaaaggcgggtgtcatggagccatcgtgggcaccttgggctctgtaggactgaactctgtccttctgtgggtcagctacttggctttcttccagcccctcttccaaagcctcacacatccgggagctgaattgtggctctctggttgtcctttccagaacacttccacctgcacccgggaacgctgctgcgcctgagaggctggaggctctgaaataccaacggataaagaagcccaaaaagtcatccaagggctcttcgaagtcaaagaaacgatccggtaaatgatgggcagtggcccgccccgctcctcccaccttgccttgccgttgtcaggagggttattgggctgccgttgtcaggagggttattgggctcagggccccaaccttgggctttctctagaattgaatccacaagcttctcttgtcctttgtttcttttttttaacactatttttcaagcaatacacaaacataattttcatatacaaaacgagaaagataagggaaatctatctgattgcccttccaatttgtttccactcacctggagaactgtcgttttcagcatgtgtgcctttggaaacttttctgtgcctacagcttcagaaaatgtatcctattattttagtgtgttttcaaacaacacaaatagtacagatctatttttccactctgcatttcaccttgcacataactctatctccttccttacttcccctctatcatttcaggccttctag

SEQ ID NO: 68110 - DNA, 1377 bp, Homo sapiens
tacctggtcatgatttgggttttgtatggattttttgaaaagagagaaaaagagtgtgggctgggtgccgtggcccagagggcagatctcttgagtccaggagttcaaggccagcctgggcaacatagtgaagccccatctctgcaaaaaaatacaaaaaaatagctgggcatggtggcacatgcctatagtcccagctccttggggggctgaggtgggaagatcatctgagctggggaggtcgaggcagcagtgagccgagattgcgccacttcactccagcctgggtgacagagaccctgtctcaaaaaaaaaaaaaaaaaaaaaagagagagagagaagtaagttccaggcaattgttggtagttctgtactgcaaaaaacacctctgtgccaaggctttgaggccctcatcttggagtaatcccctgacttcctgggagaaggggagccccagggttcgtagcattcctgcatgctttagaacagtgtaggctggttgggaagagaactgtgaccttaaattcttggagagcccaggactggcttctggggtaatggcatcatctatggatcaagcttagatttacctgacagctgaattccagggataggatggagttgcttcactgaagcttcccacctgagacattggcaccaagagctccatgaccaaagggccccaggtggggctggcgttggcaacaaacatggtcaccttcctaaaacagggaggcaattcgattgcacagggctttacgtgctgttggtaaagtctgttaggtcacattctatgtgtcttttctgtaccatgtgccaaaaatagactcattttgcctgccctgcttcctccctcctgttctgccagacaccagcttttgttttttcctcccacattgggtgagggtcttggtgtgtccagagccttcttttgtcctgtggctatgcttcggtgctgagcccagagctaaacaggtggacagcaggtgtcccggaagggctggagcttggctgtttctcaagggaaaatcggctgcttctggtcactggatcattactgtctgggaatttttgctttgacgatacaacttaagcaggctcctctccagccctggtctgtctcaccggggctgttccaccaaagcacagaatgtcagtgctcgcctcaagtacgttgcaaggcagatctatttctcaggtgtggcggggatgccatgcttttcttctttgtagctgctatacctttgtggattgggaagacgctggaagggcagtggagaggtgagcctaatgttaagagtcttggctctttcccacgatgactggatgattcgacaggttgctcacctctctaaacttcagtgtctccatctgaaa

SEQ ID NO: 68111 - DNA, 1077 bp, Homo sapiens
gacagtggggtcctctgcagggtcaggtccctgcagtcctatggggctttgtagcgaaatgtcatcactcccctgtgctccttgccttctgcagcctgaccttggtagtcacaggactgaaatgtgacctagcccttgggtccacattgctttcaaggtccctgttgtagccttgtcgtcctccctgggtcatgctgtagggaaagggtcttaggaggacctccccgaggggagggggcaggcttcccctgggcagacaggcattgagctggcaggaagtgaaacccccagggaccagcactgtgtccctccccctgcccccgcagtcagcctctccttgagtgtccttccaggtggaagctaaaggaacttgggcattcagggagcctctgagtccctcacagagactcagggccacccgaagctcgctccctctcacagtagcctgacaaggtgctgccgctcgccacggaccctctgccctgtgcctgggcacacacaggcatcgggcacctgcatgggagacggcgagcctcccgtccaggtgcttctggctttccaggcgagaaggagacaggtgccttccccccctagagatgtcaagggaggttcactttcctaaccagggctataaatctcattcattcctaagagtggcctccataaagaggactgccctgacatttctttaccatctgtagctataaaattgtcagcagcccagaggccctggaattgtgggtgaggctgtctggcatagggtgagtgtgagggctgtcaggcagcgtttatgagctcacctgctctggggccctcctgcgcccagagacccactggtcttccaccttccccagctccctccctgtcccagctgtgactcctccacagcccccggaggtgtgggagccctagactagctctcaccccagctcctggaaattcctagactctgctctcatgtgttattcctcaccccttcactcaactccattgaccctctcctttcccagtgtccccactgtgccagatccaagagaagcccgctctcctttcactgctgtggcaaacccagaaacc

SEQ ID NO: 68112 - DNA, 1022 bp, Homo sapiens
tgccagtgagacttgatttgaaagtgggggtaagaagcaggggtggtggggagaggctgctggggcccaagctagcatgaaggcaggggccaaagatgcccactgtgagcagctccttccctgtgcggtggtgctccggctctgtcagcctctgcagatgcgcgtgctgcgtggttgctggcttggcctcagcagcctctccccttctctttccttccagaccctccactctccatcacccactgcaggaagagcctggagtctccgtaagtgtctcagatcctgggagaattgtgctgttcatggcagggggcgcataggtagaccgctcgccttacccagccccatgttagtgtttctaagccatttcttcttgattgacctgtgtgttaattgtacttgcccagccccatctcagtgtttctaagccatttcttcttgattgacctgtgtgttaattgtaagttgtccacgctggtagagggagtggcagtgcagatgatccaaattagccagtaatcagtttctcttcagccttggaatgtatttctttagtgttttcccaccctagcagatttgcctccttaatatgtgttgcttaagttgatattaaagtgagcttgcttgtcttgaaaagaggggaatgaagctggaggtgtgcttagagcacagcagagagggggcaggccagcacaaaagtgaagaggcgggtgttcactggaaagacggatgatggggggggccgggcgcggcggctcacacctgtaatcctggcactttgggaggctgaggcaggaggattgcttgaggccaggagttcaagaccagtctgggcaacatagcaagaccccgtctttaaaaaaaaaaggaggattcacgtccagacggtggagagttggccaaagcatttcacaccacgatacacagccagttttcttgagcgtgaggatcctgggtgctgggtggttgccgagagagggaaaggaagtcctggccagcacactgccccacctcatcccctc

SEQ ID NO: 68113 - DNA, 1051 bp, Homo sapiens
ccaacgctttcggtgacctcacgttcgtagcttgaagtcagccattgtaagagtgtttacaccacagcaattggccagtgctaccatcgcttagcattagacacttagcagtcctcctgtgctttgggtgccctgccctttgcaaggctgtgtgcaggatgagtgtgtgaggggacagtggtcatctcaggtccctcggctgactgggtattgtccctggggctgcaggacacgtggtatgagttccgggttctggccgtcatgcaggatctgatcagcgagcccagcaacatcgccggcgtctccagcacaggtattttgggttgagggtgctcttgcaactatagggacataagccccagagctgcatgggggtcattttgtgaaatggctactccacgaggagaagctggattggaaactaaggcagtgcctggttgcagctgcgtgagtcatagcctttcttaagcccaccagacccatatttccatgatgcatgctatttcgtgaagctcagaagctgagtttctgacacttgtataagacagccacagaaagaaattcaactaatcttctcattatagtagtcaaaaaggacttgattgaagtgctatttgctgtacattttcagtttcctcttgtcggggaggggctgtgaatcggaggaaacaacaggtcaaccatgtttatcaaatgcttgtgatagacttctttataattatgtgggttttatttggaaaattgttgtttggtgttttcctcccttccttcctctctctagatttttaaggctaaataaagccaattccctagcattttctccatttatctttctttctcttggccctggtcccatttctacacatcttctctccagctatagttcctgagacatagcaggttcctccgccagtgaaggggtgtccttggtatgggaaaaggctcttgcttataagcaagtgatggcatcatttccttgggcaccgctcacccagagtcccctgggaccaggtgacagtgacctcgtctgaggagctcatgcagcaggact

SEQ ID NO: 68114 - DNA, 1258 bp, Homo sapiens
cttagggagagctggagggctggaatgagggagacggggactgtgcagcatctcagatgagggcagagctgagacctgcaggccaggcctggcgtgcggaggctgggcaggaggaagtttctggggttctgtgtctgggcgttcccgtttccgattgcccgaagcgcgtgtcccaggaccttcgcctgggccctctcagcctgtccttctgggtcctgacggctataatcacagtcacagccaatgcttttggagcctttaccaccagttttaggttctgttccaagtggtctgcacagctcgtccttcacaactcgggaggtgcgagctggggtttctctagtgtaggttcctcgaagcagaggttgccgtggcccgaatgctttctccggcgtcacatcgctaagaagtagtgggtccgggaatcgaagccaggatggggctcctaactgctgtgctgtgctgcccacatgccagcattggggtgggacggagttgtcttctgaggccagagaaccttacgggaggggctctgtggctgtgcctgccgccttaggagagagtgtttctgtgctcaccagagaagcacaggatttgggccaggacgaggagggctctggtttctgttggacccattcctgatgctatgtgatctcctagttggactagaccgcacagtgggacaggcttcctgctccaaccccactaacaagcagggtcaggggagtcggcgcctgagagcatccccgtcgcccccatcccttcacttgcagtattgtgctccgctgccatgcgcttcagcctctcaggttccccacagccagacggtgggcacccagccacgtggctgagttcttttcagtctgagaggtctccacttgatctccaggcaccagcccccatgccccgggcagtgtccgggtccaggtctccatgacaactgccaacgtgtcctgggaaccaggctatgatggaggctacgagcagacattctcagtttggtacggacctctgtgagtcaccccggcatgctttgctctctgcttctcccctccccggtcttcctgcaggctaccccgggtggggggaggtaggaggaggctgcagttcctggcctgccagccctgcacagactgaggtgggttgagacagtgatgaggtccttgtgggtgacgggaggggtctgaagggactctgggcatggctgtgtccctgtggcctgaggggtctgggcctctctgtgccctctccctgctca

SEQ ID NO: 68115 - DNA, 1648 bp, Homo sapiens
tctgtctgtctgtctgctctcccacctggcttccctgtgtctgtctgtccctgtgtctgtctgtctgtccctgtgtctgtctgtctgtccctgtgtctgtctgtctgctctctcacctgcgcttcctctatgcagacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaaggtgctagagagatgcatgttgagggttggagtgagggctccccccagtactgtgatgccacctctgggctctggatttctgccaggactcctggccccttccaaaagccctgggcaaacagagagctgcttctgtaggggtctgcgggtgccgcccgccccgggctggagctcctgtactatcctgcgtgctgcctggcccagctgggacccagcctgggatggagcgcggagtctctgaccagcgttccctgccctatcgtctgtgtctggcagaacctcggttggaccctgatggaggatggctccattcgaattgaggaggccacagaggaggctcttggcacttatacctgtgtgccttacaacactctggggaccatgggccagtctgcccctgcgaggcttgtcctgaaggtgaggtcccagggctgtgacggcctccatgagctgggcacctggatccccggcctcacgagggtgcctgtgctttcctccccaggaccccccctatttcacggtgctaccaggctgggagtacaggcaggaggccggccgggagctacttatcccctgtgctgccgcaggggacccctttcctgtcatcacttggagaaaggtacctgggccctggagccctgggtctgcagggaggtgtgagggcccagggagccctggggctgcggggaggtttgagggcccagcgagccccggggctgaggggaggtgtgagggcccagcgagcagttctattctggacctgccctgaccaggctagatgccgagcagtgagctgaccctgaagagcggcaggcactcgggaggagggcagcgtgggcgggccggggtctcaggcgcgtcctccccatctgcttcgggcttctctcctaacccccatttctgttcccaccctcttccctgccccttgttcaccaaggtagggaagcccagcagaagcaagcacagtgccctgcccagtgggagcctgcagttccgtgccctgagtaaggaggaccacggggagtgggaatgtgtcgccaccaacgtggtcacgagcatcactgccagcacccacctcaccgtcatcggtacgtggccggcaaggctgggccgggcggcggggacagagcaggctggctgggggcggggtgctggacgctgggagcgtcccctggtggccgctgcactctgcgggctcccttcctaagtcagtgcagccctgaactccgcgtccagcaccggcagcctttgcccccgtgggctctgtcggggaagggcagcgtggctcctgtcctcagggaggtctttctggggacaggcctgatgtccacagcagcccacctgagggaaagaggcggctgtgtggctggc

SEQ ID NO: 68116 - DNA, 1286 bp, Homo sapiens
cccaggaggcctgggtgctgctgccgtccctgatcaggcgaggtggggtttgttccctgctctccccagggccccctttcatcgtctcccctcctgagaacatcaccgtcaacatctcccaggatgctctgctcacctgccgggcagaggcgtatccgggcaacctcacctacacctggtactggcaggacgagaacgtctactttcagaagtgagcaccctgctctgacttttcaatgaggttgccaccccagcccccacgggcagggcccctgagcagaaattgcacgggcaggctgcccgtggctcttggagctgggggaggtgggcagtctggtccgtgtgtctcacatgccaaggccagggtctgcatggaggggccctggggatgccaggggcatgggctctccatgccacatctggggcagtgacggtgactgtgtgtctgcggcaagatccccttctgctcgcccaaccccctgtccccatgccgctttgcagcgacctgaagctgagggtgcgcatcctaatcgatgggaccctgatcatcttccgggtgaagccggaggactcggggaagtacacctgtgtgcccagcaacagcctggggcgctccccctccgcctcggcgtacctgaccgtgcagtgtgagtaggggtgcaggggagcctgggtggtggggctcccagaaggttttggtgttagccagactgtaggctggagggtagcaaagaccaagcatcatttgggggcatgtaggtggaggagcgaataagagaagaaggagggatggctggagaggaggccgaggccctggacagttggggtggagcagctcctacttcgctggccaggcgtcgctgttcagccagtacatctcatcagctccgtgcaggctgcactcaggaagacacctttgagcagttccttctgaacggtggtcctcgggctgaaggctggcctgcacctctgtgcccagaatcagttgctctctggtgctcttttctcaggtgtcttatggagcatagcccaggcccatgcagggttaggtttctcccagccttactccctgcctttccacaccgcgtctgtgtcgggggcgatgtgctccagctcctgcgcctgctccctctggcgtccgcggcctctccccttgggtggctggagatccagatgaatgagctgctcctcacccagacgttcgagggcttttgtgcaagcaccaccattcagcttgctgatctttaatactgagccgccagttgctttcccgccccctggcaagc

SEQ ID NO: 68117 - DNA, 1051 bp, Homo sapiens
ggaggacagaggtgcctacacctgccgagcgtacagcattcagggggaggctgtccacacgactcacctgcttgtccaaggtaggagccatttcctcagcctctttaaccctgggctcccgcggggatgtccagcccggctgagctacggagggcgttttcccagggctcagctggggctagtggaggtgcaggcggccatgaggacctgtgcggggctcctgtgtgctgcctgctgccctggtcagagctcctgcaccggctgcctgggagagggccaggcccacaggccgtggccaggcaccacatggcgtggcagagaggcccctgctgtgtgggtttctggtttctccttctgttcagatagcatctctcccatgtctccgcctccctgggagaggagacctccctggggtcatctatccattagtgacggcatcaataaataaagatagaaactcaatccaagccccagacatttaaataacacagtgggcatttggcagagctggggtctgtatggtcagcacagggagatgccagactgccctgcctggagccccagagtccccagagaggggccaggaactgtgcaggatggggcagcgtcccggtcggggggtctctaccctgtgctgaactcggcccccggcttagcctccccagccctgcctcctggaggaactcgggggttgtgggggttggtggcggctgcatgctcctcctgcctctgagtgccgagcagcagcctgggccagaggtccctcagcagcctggatggaagctgttccctctcaggggagacttggccgcagctgccccctttgtctgtgcagccagcaccaggactgctggactttcaccctctgcttactcctcggcccctgcacccccagctgccctcttgatttctggctggggagcagcccacggccctgactccttgagactggactattcctcgctctagatttgaaaagagttgcctttctccctgctgcatgtctggctcgggctctgctgggagaaggcaggcaggaagggggtgtgcg

SEQ ID NO: 68118 - DNA, 1524 bp, Homo sapiens
ctcctgcattcattcagtggccaccctccgtgcgcccctgctgcgcttgcactgagctgcaggctttggagatgagagatgaaagtggtctagctgtggccttgctcttaagaagtgttttggtatcggcctgcaggtctgtgtatgtgtgaacaccactcatttgtttgtttcattctttcgttcattcaacaaatgtttgctgagcccttggctactacatccaggaactatgctaaaagctgggcatgtggtgacctacgcaaaagggggctgctcttaaggagccaccatcctaataaaggggacaggtaagaaacaggtaaacacacagagagagacagacttgtaagtgatatgtgctttgaagaaaatgaaacagcaccagggaatagagaatgctggaagtgccatctgagatgggatgggctgcccaggtaaggcagcattttagcaaagacttgcataacccaaaggagtgagctccaggtatgtagtcctaagcaggtagagccacacatgcaaagggcctgaggtcagaagttcttggtgcatttgaggaagacaaaggcagccagtgtggttggagtgcgctgggagggagaggaggctggtgccacaggcaggacaagatcctatagcgctctgactagttctcagggcagggctgtgtggggaggagggaccctcccaaagcttcccgtgaatgcctcagtggctcctgaagagctgatagagatggcggtggtactggcaactggtgcattttacaagctcctttttacatgtttattcctcacatcatttctggagggtaggggagttaggtatttaggtaagacccagagaggctgagtaacttgtcaagcctaccagaagtggcaggctagtgcttgaacttgggttctgagcttcaggtaccttgagatgagctcagcttgacctgcgccagcctagtgccgtgggcctccgggctggagttcagaactgggggcctccttgccatttcagaagactctggaactgatagtccaaggggttaagattgaccggattgcttctacaagcagctcaggcaaatgggactgagtctgtgaaaagccgattacccaaacaggatggagttttaatcaaatctccaatgcaggggggaagatgacctgacatgatcagaggaaaatgaagaagggagtggccttcgggtgggctgtccaccttcatccatggaagccagagagggaggaagctggatgattttctcagcagaatctgggaaaatgaggttccgcgtagccttggcctgcatctgtgttaagtcttggtagggctccgacggcaagtgtcctggaaacgcgggggcctggctgagctgggtttcaagaagtaggagctcctgtgtgtcatggatcatcataaagggaaagactgaaggatggtagcaaagcctgaggagctgggagcaggcagtgtttgtaagggccaccctagagtagatgctcagttaacatcggtgacctgggaata

SEQ ID NO: 68119 - DNA, 1051 bp, Homo sapiens
aggaaggaatccaagcaccagcattacgttgctttcaaactagaatgtttaatgtcaggcattttctgacggggatcacctttggaaaatgaaaggccagtgaacaattagaattacaaattgtctcattttccttcggtgttttctttgaagaccagttgggtggaaacagacccaattatttctttatcacatataaaataccccaaaagcctgagccaagccttcctttaggttggtgaattacatggaggagagggcagcctatttctaacctgcactattaattacagggctcttgtaaaaaagaattaagcctggaaatgcagctggcaagctgacatctagttccgtaaataattgacagtcaagccattattttcctgaaaactagaaattgttcaacgtactttcctgattagcacctaaataataaagtaattatgtaattagtaagtaatttgtcacttcaggatgtaaatttaatttattatcttttcttttaagcttggcaccagaggtaatagaggcagtatctgtgttcactgtatttcaaggggcaggccgggcaggcaggggctgtgtcggagataagcacgctctcagtgagaagaggcctgcaagttaggatcccaggacccctttacaggacttcgaataactttttgccattatttttagtatattcttagacactggataagaattgattttttcgaggacatgcgaggtgtatgtttttgcatgtgatgacgcgtgtgaggacgtgcaaggtgtatgtttctgtatgtgatgacgcgtgcgaggacatgcgaggtgtgtttttgcatgtgatgacacgtgcgaggacgtgcgaggtgtatgtttttgcgtgtgatgacgcgtgcgaggacgtgcaaggtgtatgtttatgtgatgacgcgtgcgaggacatgcgaggtgtgtgtttttgcatgtgatgacgcgtgcgaggacatgcgaggtgtgtgtttttgcatgtgatgacgcgtgcgaggatgtgcaaggtgtatgtttctgtatgcgatgacgc

SEQ ID NO: 68120 - DNA, 1097 bp, Homo sapiens
aggctggtgtgggtccagcctgcctagcccagccctgcctgtgggaggtggctggctcctgtcaatcagtcccaagagactgattgaagcatatttgaaatcttggggggattgttctgaccacctggtaagcttttgagtcaccgccttttggtgccagctgttgcgtgagcagggaacaggagcccaagcaaagtgtaattaggaaggcaaatctgccgctaaaacctcgccttgatgaacaccaggctgagggtccccgcattgcttcccttctcgactgtgctctattctgaatgggagggtgaaaccatcttggggcactgcctccgttcttttgcatcatcctgattggcagtgttcatttcaggaatctgagacaccaggcattcagtggacgtgcgtatgactggaaagtagaatctcacttcaattttatgttctggagcgtatctgtgttagtttgcacgagtgggagttggttctttgggaattcctaattgctttgagtgggataagcatggagcgagacctttaaaagatgaggttcgtttcataaacccactgtgtactagctgtgtggctctgggcaaggttacttacctgtcggacttccggttcctcagttacaaaaagcagggactatgatttgcagggctgctgtgaggactaggtgaaatgctggatcttgcacagtgtctggagtgttaattacatgtgggtaattatgtgtgagatgctggccatcctccttctcgagaggaaaaaaaacaaagtcagatgaaaatctagtagcagggatatcaggccggaaggtgtagaggactttggtagttttgtgagtctaccagcagttatccattcgaaacatagttttggacatccactctgtggcaggctctgggaatacagcaggaggcatgaccctgtcctaggtcttaaggagacttcaagagactgtcacatccagagattactgccatatggctttgggagcacaaaggagggagaacttctctgaagaaatggcctctcttcagagacctggctagggaggggagttcgtcacgtgcaggtgggaagtggagtagggtcct

SEQ ID NO: 68121 - DNA, 1033 bp, Homo sapiens
ctgctgctggaggtgggtgccagctgttattctggagccctgccatagggaatggtatgaagattatgatgagtcccctgtctttagctggggcagggggcggggagctgctgtccttacctgatggcctgtggggcttttgtctgctctattcccccaggccgggccagtcttcatgataaggcatctctgcggctggaacaagttcgctctgaggaccagggctggtatgagtgcaaagtgctcatgctggaccagcagtatgacaccttccacaatggcagctgggtccacctcaccatcaacggtgagtgacggcttccagggtgggtccacctcaccatcaacggtgcctgagggctgtttccggggtgggcctgccccaggggaagcccttctcccaactgcatctcaccccctgcccccctccttgttgctgtggtcccatgagacatcagctcactcctgcagtgtccccgctgctgtcttctcgaagcctgtgcaggcagtgcaggtgcccaggagcggcagctccctgcatgtgtggtgctgtcagagtccttagagggacatgggaagctgctacttcaaaccaggagggctgaggctttaaggtggcaaaatgggtcaccgctgggattatttcccagccttgggaagaccctgctaccccaattctggtggagttcctggggtcccagagttagtctttctttttagatcgatgttttggttctctttaactgtattcgtttgattagtatgtaccaagggtgtagtgtgtatccagctctgcagctgatgatggataaacactggcaagcagacctgcacccagtccctgcctgtgcggggtttaccacatagtaaaatgcaggcatcctgggaagcgtcacagttttaatgggcgtcagttattacagctcaggttaaatgccttgtgctggataagatgcttttcaaggatctgggtaagggcaaggaagccccaagagcttgctgagctctgggagttggcctaggctgggggcct

SEQ ID NO: 68122 - DNA, 2046 bp, Homo sapiens
tgtagtggcaggcgtcctggagcagaaagaatgttccctgtgcacgagcggccacaactgggcagtgccgtgggcctccagagggggccgggcccctcacctccatgtcctggactccttgtaattcttggggcaggatgccagcagggggtggggctggatgacgcctgcggctctttgagactggggagggaagagctggcgtgtagggctgaagagaatggcttccctctcttttcctctcccttcctttcccccaagttgtggatgcctgggggccccaggacagagggaggtatgagcagcgagggggagagggatggagggtgtgcctgggaccctcctgggagggtacggtggcccatggagggcagctggtggggggcggggtgaccctgtgacacggacatggggctgctggggcaggatctctttgtcacctcctttctgtgtccaacctggccgtccccatcaggcgcccacggcctgcgagaggagcccgagtttgtgacggcaagagctggggagagcgtggtcctgcgatgcgacgtgatccacccagtgacgggacagcccccaccctatgtcgtagagtggttcaagttcggggtccccatccctatcttcatcaagtttggctactacccgccgcacgtggaccctgagtatgcaggtaaggtctgggcacccggtctcccgcaccttccccagctggagtcagctcctcggtggttcccctctggcccctgccttgtcctgaccactctttatctctgtttcccagtctctgcctggttcctcccatcctttgtcctctgttggttctaatcaagcggtgggaggagagggctgtggaggtggggcagggtaaagccttctgaacagcaccgcctgggctgtggagagggctgggagccaaaggggaagctggagaggcctgggtgggagagtgggatggagaggacagcagactgagtcaggcagccctgggccagcacggctctccctgcttggccgcacccacccctttcctcttggctctgaagtcggggcgccttcccgtcctgagtgtatggatgaatctttggcctcccaccgtttgcaggtgcctggtgtctgcctccttgtcatgctgtcctctccttctcctggccccgtctgtgtcctgtttggcagttactcctgccagcaaaggcctcgtgactcactgccgctgcctgccccccagcccgcgggagaggagggcgtgggtgtgtgtgtgcgtgcgtgtgcgtgtcattgagcgagcgttgttggggttgaaaggaagggaggaagcaggcagggcactgccttcactttcatctttgctggtggcttctgaggtctgccctgcctttctcagaatgcttccgtctctgtccctctttcgctcctgtgcccatgtctcatgctctctttttggccagggttggctttgagagtctagtttttaggcagattgccagcatcaggacgaggaggagagcagaggtgtggtgatattggctgcggtgaggggtgagctaagagcgggtgaggtgggccgacctcgagggctgctccaccctgctggcgtcatggaagaggcttctgcacctctggcctcctcattgccacatgtgagacacagatggcatcctactggggcaggggattagagctgaggaagggtgcctccaggatgtttgctctgatggccaacccattccttgttctcaggcttctgggccctgctgccctcatctcctggggtcactgggctttggtaggatacatagtctctctggcactgacagcaggactgggaggggaccctagcatcctggaccccagcctgccttccctctgccctagagagggaagctgggtgagccagtagtcctggaaatgctgctgggatagggatattgctcagcctgaatggaggtgctcccgggtgcgctggagaccccccacccatcctcttctgttggcactttttcattctctctttcatctcttcacagctctgtatccatcatgcct

SEQ ID NO: 68123 - DNA, 1012 bp, Homo sapiens
ctgacttccttcctgccagtggctcctggggaaaggactcttggaaatacaatctagccgagagcaaattaaggttgctaatagcatcccggcctcacagctgctgggggagcccagccgagaaggctcagggccggagcggcccccgcagaaggaaggagcctgctgagcttgcacctccccagtgcctctctctccttaaggagcggctggggctccctgacccgtggcttccgaacctgagaggtttggtggcgcgtgggggccgggagggctgtgagggcatgaaggggagatcactgaagggtggaaatgctctgaggtgctgtcgggttgggtgtgggggctttcccgcaggcagaaggctgtccagaacaacccgtacccgtctgccttcctgcagggagaacaggacaccgtcggcgttttggaccaggtctctcccccgccgcctcgtcctttctgggtgttcgctgtgctttgggtcccgccttcctcctgccttcctctgggcgtgtgcctcccactttgtgagagccccgggtctgccggcttcctggaatctcctggagcctcctggcttgtcagggaggaggggttgggggactattgggggctgtgccttttttggactcagcagggattatttttaggctggcagatggaggtggcggtggctgtcgctggtattattagacaacaggcctgtggtttggaagtctggtgcccagaggaggaggaggaggaggaggaggaggctgcaataaggacttgtactaatgagcaacggatgctggtgctcactccgttccccgcttccccagccaccagccagacccagctaggggtctcagagtctcaggcagaaggccaggctcctcagagctggtcagagcccacccggccgccttctgagacaggcccaccctatggtcctaggcttcagggtctgggctggcaaaacctgtccccagtgtggggttggagttgccgacctctggctcaggcccta

SEQ ID NO: 68124 - DNA, 1619 bp, Homo sapiens
atagcctccgaacctaagtcagggtgggcaatggacttctttgcaagtttcagcccagaataaaggaatgtgagtttatactgcagcaacacgcagaatcgcaagatagaaggaagggcttcccaaaattgaaggctgcctggcatgaaggttatgccctctttcagggtgcagaggggtccttctgtctggaatggctggacatgtacccctgtctggaagcagagggtgaccttgctggtcttggggtctttcttagcctcaattgctctgtgtgtggtagttaaggacctaggtctagagccatatgactgggattcagattctggctgtgtcacctgccgaccctgtgaccttggacaaattctcaacctctctaaatgtcacttgcttcaatagaaaatgtgccaatagcatgtacttttagggtttttaggtggacatgagtgttataaggaaacaaaacaactacctgttatatagtacgtgctcagtaaacattaacattattttctcagtgtccctgggattccaagatcctcctcaatttctttcccttgggccattcagggcactaggagctgagaatgtgttgcggggaagttcagaaggctgcctgtgtcaggaagtaagacccctttctgggctgaccttgtctgggcagaacctcttgtccctggcatcccagggacacgtgtgcaggatgtgcgggcctcaaagctgctcggaagtcctttgcaaggtctccaaagctggagtgttgttggtggccagaggtttatggaaggacacagcccgggaagtgagggcttgcaacacacagcctctggagagagcgggtgggcgcccgctcgtgtgagcagcaccagccagtgtccacatgctgctgagtctccctgtgagagctcagctgttccctgactggcagaggtgacttctggggcagtccctcagcaggagggactttgagatgccacccttaggatttggccatagcaggggctgctctggcagagggggaaagggatgatgttgtgttgggacccgactccatcagccctcgggtgcgggacagaggttggaatgggctcctccttttgactttgagtgtgtgtgcctgggaggtgattaaggtcagtggacaggttggggaagtgtggagaagagaggggctggagtggtacccagaacctggaagacagtgattggtgtgcactcagtatctcagacggctgctgagccagcccgggggagttcctactctgtgggaggaccctgggccgtgcttagctgattgtggaccttggataggggaggaaagtcccagactttactcccacggctgcctcctctgtctgccacagattctgtcgttacattatccctgactacagtgtccccaaatacagtgaggttctgactcagatcctgctggtagttgggccattgccctctactttctacctggccttgacctatgcttccttttggtaatgaagatgggagggtggaggtttggactcagaggttgctatcaagaccccgtggtgagcctatcggctgagaaggacttcactcaggaagtggtcagtggctggatggatgtgtgtgtgtatcct

SEQ ID NO: 68125 - DNA, 1022 bp, Homo sapiens
cccacacatcttggcagctggaggtcggatccccctagcaggggcgcccggtgagaggaggattgatgaggccagcttcgaggtgtgtccgcttttggctggaccccgccggcccccgcgcctctcagccgcacctgggccccggccaggcaaaagttccccgggagcgcgccgcagccgcgcgggccccacgccgccctccccaggctgcgaggcagagctggctgggggcggcggcgggggaggggaggggcggggaagggggggtccccacgctgtgaatccgagcggaggggggattttctctttccgctttcctgggtctgagctgggggagacgcaaggggggagccaccgagttgggtgatgcgtgcgtgagcgcgcgggcttttgctttggagatgggcagagcgacctacaagcctctgggtggcacccccggctctcggcccttgtatggaagtgggagcggagcctggagggtgccaggactgtgagctcagggctgtcagcgcgcagacacgacccggctgcgggcaagttcaccaagccggaggagatggcggcgggagagaacccgctgtgggtgggagtcagcaggcaggactcgccgacagagaaccctctcccagcggcatggggcgccgggtgggctggaggcgcctctcacggggtcccctcgtcactcgtctgtgcaggggggcgtgcttcaggaaactttccggaatggaatgaatatgtcgcctctgcttctgaggggggtggtggtgtctgaaaacagaacgagcagagggcgaagcgaagggtgattttgttaactgacatgttggtccggacggttttaaaactcttcatttgtcaggtgggaacactgaggcaagggtgatggcggaagcttacggaacggggggtggatgtgaggtgcatcgggctgcgcttgacagtctgcctgtagcctcatcctctcccccatttccttgccgtcttccaatgcccgcatcctcctcccctcccgtttttgg

SEQ ID NO: 68126 - DNA, 1069 bp, Homo sapiens
acttccctcagacctgtccggggtaattgagacccgccagggtcccgttagaagctaccatttccctcaccagaaacttgccacgcagtgtgagccgagagagaagcgggcagagacgctataccaccttctccccggcaatgcgcatgattctgcggctctgtgctcgccacacttcaacgcaccttgaaatgggctcgcctccttcgcgccgcgacgggcggaaggctgagccaatcggacccccggcttgcgggcggcgcccaataggcgggcggcgggggcggttccggaggcccggcccggctaggcttcaccgtggacctggctgcgctccgcccgggcgagtagtgcaggtgccgctgcgccggggccggggaggcgcgcgccgagccgagcggagcctaggagggatggagagctggccacccgggctgcaggagcaccggcgcggggcgtaggcggcgcgaggcgggcgcgaggcgggcgctcgggcgcgaggcgcgtgcgggcgcgggagcactttgcgataggatgaggctccgggctggcgcggtagtactatgatttggtatgtggccactttcatagcaagtgtgatcggcacccgagggcttgcggctgaaggtgagttgaagtgcggcgtccctcccctgcccctcccggcgccctcggcccctcgcgcccggcccctcggtttcccggctccttggccccccggttccccagctccccggcgcgccttcccgcgggtgaggcttgggctccgacgcgggccaggcggcccgggagcattgccggggagggcctgggggccgtgggctggaggggcgggcgggaaggggccagagcccacgggctgccgggcactcggggaaaggacgcagtggaacctgggtcgacttcgcccaccacgggccccacggtgcacaccggcgcgcctagcccgtcgcctcctgcccggcggccgcctcccagagctgcgggaaactctggctgcgggagtttgcggtctccgggcaggctgcagcacgctagagccccgcgccgcgaggagcgcctgcaggga

SEQ ID NO: 68127 - DNA, 1136 bp, Homo sapiens
gagaaaaagatggagaaatgcttatgatatcatttaagtgacacaagctgcaggtatactagtatatactgtatgattacgattacacaaaacatctatgcttaggggaaaaaacaggatgagaatgaaccagactgttgataggggctgtttatgagtggaagtgttacagcaaattgttttctgcttttctttgtttttgttttcctggttgattcttgtattcctttgtctgttttccaaatgttctttgatgaggatattttttgtgtaatgaaaaaagttgcatcttggtttggcttccagtagatacaatagtggaattttaaatttggcactagtaatgggaaaatataatttgtttgtttaatgtgatagcatgtggattgtgcctttttctagcttcttaatatcagccacattggatgaaggagtggctgactggaagttcagttgcttgataatgtattgtttgtgactcatttgagagattagttgccactgacttttgggtgggggagtcagctgtggtgtcctcagcaaatggttagctggaaaactgagagctgccgagattaccggcctccccccttctttttgaacacactgacaaaacgatctgagtaatggcctttgttcacctgttcaaagcgagccaaaatttattgagcacctactctgtggcagcccctggaagatctctgttttcttcctcttgagtgataaaaatacagggtgaaattgacttctgttgaaactagactctgaaagatgtttcccgaagcactctgtcagctgatgtgccccatcacttcttcctgcccaacatggacttccctgttggatgtctttctctaaggaaaatatttaatgtctttagaatgaagtgcagctgcctggaagcttagagacaatgcaacaaatccaaagacagctgctttttttttttttttttttggcaggggtggggcatgtttttcctttaaagcatctctgtcagggtactgaaacttaatcagccaatccatatttatttggtagtctccattttcatggcagtaaagcattccatgggcaaagcaggagaacttaagataatgtcttccctttaccagagggaacatatagtttagtca

SEQ ID NO: 68128 - DNA, 1118 bp, Homo sapiens
atgagtgagttataatgattaataacacctgccaattactgaaaactatgtgataagcattgtgcttattgctctatctggggtcttagtgagcttgggcttctatgacagaataccacaaacagggtggcataaataagacatttgtttcacgggctctggagcctcacctgggtaattttttgaacatttttttgtagaaacaaggtcttactatgttccccagtctgatcttgaactcctgagtttaagggatcctactgccttagcctcccaaagtgctgagattatgggcatacaccaccatgccctccctgaatttcttttcagttattctacttgttatatgttgtggtttgtatacctgtgagtttctttctttcttgagaattctcagttcttatccattcaaatatcacctagcttgtacctgcttaactttttctttctgtgactgcaattaaacatgtttagtcattctgtccttcaatactgttaacctcctttgtcattttttcatgttcttgtctctctgtgctattctgggttctttattcatttttgttttacagctaactttttctgcttccagctgtatctaacttattattgataaccaatcaatacacagtttttccaccaattatattattcatttctaaaattttcttggttctttttataatcaagttgttttttgcttgcttaatttttttactccttttcttttcttttctttcttttttttttttttttttttgagatggagttttgctgttgttgcccaggctggagtacaatggtgcaatctcggctcaccgcaactgccacctcccggggtcaagcaattctcctgcctcagcctctggagtagctgggattacaggcggccgccaccacgcctggctaatttttgtatttttagtagagatggggtttctccatgttgatcaggctggtctcgaattcccgacctcaggtgatccgcctgcctcggcctcccaaagtgctggatcacaggtgtgagccaccgcacctggcttactccttttcaaatttttaaaacattgtgtgcacagctgttttgtattccatatgtgatatttcaaatatctgaa

SEQ ID NO: 68129 - DNA, 1040 bp, Homo sapiens
tataattatccccatcgtatggatgagaaaacagaaagattggtgaacatccaagccagaaacacttgataagcagtagagatagacttcaaactcagatgttctagagtttcagctcttaaccactatattatactgcttccttactagacaaacacttagttttaaagtaaatattttttgagtaaaaaagtgaatgaagtaaagttaactaaagttaatttcctgaaatcacagtgatgtttatgtcttctttcaataaaccattctcggtataagtggtcagccaggatacatgttgctgtgcctggtgctccttgtaactcaggaagatattgccccattctaaacagccagcatggggtaacagtgtaagcactgtgaacatttcttctctgttcttacccatcttcaaacagaaacaaccaggagcagtttaacagtgatacttgagttatgaacttcatacatattgcttaattgtaatggcaaattaatgtgttaacatttatagaatggtactgtcattgaagtttgaatttaaatgtgggttttaacccagttctataataattgctgtgctctgggaaacactgaatcttttcaaggaggacagctatttaactataagtagagtcatttgaaatgcagaagaccagaatatttattcaaagagtggtagcaaagaagtgagatgagaactgaggtggagtgttctttccatcctagtggagagaacacagagctgtgagtcagggtatctggaatctaagcatgtctccaggcttaagtttctattgtgagtttagctaaggcattcctgttgataatactattgctctaataccaaaaagtgtccactagaaaatagagtaacctttgtgcctttgtaatgatagtgttcttttggtataatactctactaccacaagtattgccttttatcatcttaaaaacaaatctgatcatatttctccccttatttattctttttcctccagtttttatcgagtgctagctatgtgccaggaatttataag

SEQ ID NO: 68130 - DNA, 1051 bp, Homo sapiens
ggctcttgcactatttttacctctaaatattacattctcagtagtgccctgcttctaaggctctgaatacaggcttaaagtcatcttatcttgctggaatttgctgtgcagagccataagcctcccattttgttagcgtcagctaggccagtaggaacagaccgggaccttgtctcacactgatgatacctcaaatgttggccggctatgtgaactgcctatttcctattgctggagttttgatttttaactaaatacaaatctgtagattctctcttctcccatcccagaaaacaaaacaaaataatgctttctgaaattgtttctgggacttaaaagtaaaaaaataatggtatatccaaaattctccatttcaaaacacaacaacagattccattaatatagactcaagatcaaaacagcacacgtgctaagctaaggtagacagtgttgactccaagtgttttgatcaataccatgacaaaccttttccctttgacacactctgaattttgtttgggaggagggtgtgtgtgtgtgtgtgtgtgtgtgtgtgtgcgcacacatgcacgcagtgtccatcagtatcagtgcctgcccaagttaggaaaattacattcctggttctgtattgaggagaaggatgtataaagcaacatgaaacattagccctcattttcttttaaattaaagactaatgttaattgttctcaaaactggatttttttccttaaaattaaaggaatctttttcttttggatttaatgaagtattgctagctgaagccagtttgacatagagagatgtcagaatgatttgaaaggtgtgcagcctgatttaaaaccaaaccctgaacccttttaaagaacaacaaaacatgttttacatgctcaaaaaaaaaaaggagggagctggcagatgggaatgataaggcaggagaggaaatgaggaaatactgactcgcttctgctcacaatggccttcctagctcacacggctcctcagattcttctctggaactactgtgttctgtttccccttccctttccta

SEQ ID NO: 68131 - DNA, 1048 bp, Homo sapiens
gatgctagcgaggtcaatggctacaagtacaaagtaaaaaccagaagctgggagttttgcctcttactccctacttcttgctttattgtataatcttataagaagaaatacaatattaaaatctatccagaactaaaaaagaaagcaacaaataaagtgggaagaggatctgtacgaaaaggaaaacatgaatcagaccttgaagcctaaaaggagatcccattgtttgagtaaaaccctatcttggatgagtctgcaagggaagcgacctaaaaaaagcctctgacatgatgtgcagctggcaccgtcatcttcaacacagccatctcttccttccagggaagatgtggaactaagttgagagagagaagagggggcgggagctgcttttggctgcccgtgcagcggcggtggcggcggcacgatcggccgggctgtagccgttgtccgtccgggagcggctggagcagcagtggcggcggccgtgcacctcgggaggcgacaccacagggcagcggcggctgcaggagcagcagcaagacagactcgtggagacgcgccgccgccaccgggcgggtgtcgcgcgctgaggctggggggtgtcgtcgccgctgccgcagaggtaactgaggagaggggcgcctcctcgctcctgccaccgccggacttcaatgcccggtccccgctcgccagcgtttttcgttggaatatacgttgcacatttacggcgattctgagtgtgagggcagacttctgccgggctcagcacagcgttttcgctgacaagcttagaggttctatgtgccataattaacactgccttgaacactcctggacacaccgaccggcctcagaaatagctggcttttttttttaattgcaagcatatttcttttaatgactccagtaaaattaggcatcaaggaaacaagtggaaagcgacctacacttttaacttgcctcactagtgcctaaatgtagtaaaggctgcttatgtagttggatttttttggagtccgaaggtatccatctgcagaaattgaggccc

SEQ ID NO: 68132 - DNA, 1034 bp, Homo sapiens
ttttttagttctggatagattttaatattgtatttcttcttataagattatacaataaagcaagaagtagggagtaagaggcaaaactcccagcttctggtttttactttgtacttgtagccattgacctcgctagcatccgatcccctgtctgggacatgagtgtagtcatctttccatcgatggatgctgggaagctgaatcggtgttgagaacgtgctgtgagacgcagcacagaatgtgagccccgacaatactcaggagaatgtacagctcgttcaagtcccagcagcactgtgtgctcatcctgtagctccttcctgctttgctaattatcaaaatgttggtaggagaaagcacagtgtctgctttgttttttctctacattagacatcagtcctacaagctggttgacaggcctcttcagaaaaagcaccccgatgggttcattttcctcttcagcagaatagtcaactgatctacaggaagcagcgtaccttcacacttgctctatgtcaaaatcatgctctttgtgaaactaaaggtctcactttcctctgtccttctctctctgcacactgctgattggctggctcctcatatgtgaaaattcgtgttctgtatagctggtaggttttcctgcgacatcccttccctgtcccacccttgtcttcccaggaaaagcatagattttccttgtggacaactgtccataaaggtagaatgctagtaatacttgagcctagaaattacttaaccagatgacagtaaaacttagaaattgatcccaaggtcctctggctctctaccctgcatttgctttgctgaggctctctaaacaaatgaggaaaaggctgttgttcagaggtggtgactcatatgcagatggatggccacagtgcgctccatccctgccatctctctttgtcatcctctgtcttgcccatgctgcagtgccttgcagatttgtttatatgcatgactttgtcatctgttgctgagagctgaggaaaacctcctgactggtaagtgcc

SEQ ID NO: 68133 - DNA, 1071 bp, Homo sapiens
agcttctgaatgagtgtctagctctgtccgagtgcatcagctctcgctgccttgacaggagtttctagcagaggtatgtgcacgtgcgctctgtgcgctctcagccacaccgcgggtctcagatcacaaacgatgacttgtgtctgaagtcgccctgcaaagccaacacacagttagagccatcaaggggcctggtggcaagcagggaaaaacacggagtaagtctaacatgggctaaatacagatggaataatcattcttaaaaagtaccatcactagcgcttgcaaagcacaaatcccattagtgtgtgtgtgtgtgtgtgtgtgtgtgtgtgtgtgtgtgttactgtgaaggggctgaggagctcaggagctgcacaatcactcagaaatcttcccaggagacccgtgtggtttccaagggggaatgttgttttccctgctgggtacacctaggtttccaggtttactaaatgattacctcctcgtcagtgcggatgtagttaactccatctggtttccctgggttcttgtaactatgaggagaagagagcagtttagcaacagggttgttatattattgccagcttgaacttcccttttttcacataaggcaggctcacctttctccatcctgtttattgttgatgaagtagccacgtctgtatgcacagcagatgcccaacgtgatcagggccagtacagcaaggacaaccagaacccccccaataattccgccaatgttcaggtcatctgaagaaaaggaggtttggtggaagccatgatacacactatctgttatttaaaaaggccctggccctgctgtgcctccttccttcaccccaaacccacttgccccctgccccctcaggcctaccccagctagaagagagaacacttacaatccttctagcctagaacatataggacaccataactcctaacttcacacgtgaaaagtactgagacttctacagttgaaatgcagtcgcactgaaaagtgtattaaagtgggcttggcactgtaggcttaaaaatcctctggctgaatgcctgagattacttatggag

SEQ ID NO: 68134 - DNA, 1530 bp, Homo sapiens
gctagtgatggtactttttaagaatgattattccatctgtatttagcccatgttagacttactccgtgtttttccctgcttgccaccaggccccttgatggctctaactgtgtgttggctttgcagggcgacttcagacacaagtcatcgtttgtgatctgagacccgcggtgtggctgagagcgcacagagcgcacgtgcacatacctctgctagaaactcctgtcaaggcagcgagagctgatgcactcggacagagctagacactcattcagaagcttttcgttttggccaaagttgaccactactcttcttactctaacaagccacatgaatagaagaattttcctcaagatggacccggtaaatataaccacaaggaagcgaaactgggtgcgttcactgagttgggttcctaatctgtttctggcctgattcccgcatgagtattagggtgatcttaaagagtttgctcacgtaaacgcccgtgctgggccctgtgaagccagcatgttcaccactggtcgttcagcagccacgacagcaccatgtgagatggcgaggtggctggacagcaccagcagcgcatcccggcgggaacccagaaaaggcttcttacacagcagccttacttcatcggcccacagacaccaccgcagtttcttcttaaaggctctgctgatcggtgttgcagtgtccattgtggagaagctttttggatcagcattttgtaaaaacaaccaaaatcaggaaggtaaattggttgctggaagagggatcttgcctgaggaaccctgcttgtccaacagggtgtcaggatttaaggaaaaccttcgtcttaggctaagtctgaaatggtactgaaatatgcttttctatgggtcttgtttattttataaaattttacatctaaatttttgctaaggatgtattttgattattgaaaagaaaatttctatttaaactgtaaatatattgtcatacaatgttaaataacctatttttttaaaaaagttcaacttaaggtagaagttccaagctactagtgttaaattggaaaatatcaataattaagagtattttacccaaggaatcctctcatggaagtttactgtgatgttccttttctcacacaagttttagcctttttcacaagggaactcatactgtctacacatcagaccatagttgcttaggaaacctttaaaaattccagttaagcaatgttgaaatcagtttgcatctcttcaaaagaaacctctcaggttagctttgaactgcctcttcctgagatgactaggacagtctgtacccagaggccacccagaagccctcagatgtacatacacagatgccagtcagctcctggggttgcgccaggcgcccccgctctagctcactgttgcctcgctgtctgccaggaggccctgccatccttgggccctggcagtggctgtgtcccagtgagctttactcacgtggcccttgcttcatccagcacagctctcaggtgggcactgcagggacact

SEQ ID NO: 68135 - DNA, 1013 bp, Homo sapiens
acatggaagacaccagtgtccctgcagtgcccacctgagagctgtgctggatgaagcaagggccacgtgagtaaagctcactgggacacagccactgccagggcccaaggatggcagggcctcctggcagacagcgaggcaacagtgagctagagcgggggcgcctggcgcaaccccaggagctgactggcatctgtgtatgtacatctgagggcttctgggtggcctctgggtacagactgtcctagtcatctcaggaagaggcagttcaaagctaacctgagaggtttcttttgaagagatgcaaactgatttcaacattgcttaactggaatttttaaaggtttcctaagcaactatggtctgatgtgtagacagtatgagttcccttgtgaaaaaggctaaaacttgtgtgagaaaaggaacatcacagtaaacttccatgagaggattccttgggtaaaatactcttaattattgatattttccaatttaacactagtagcttggaacttctaccttaagttgaacttttttaaaaaaataggttatttaacattgtatgacaatatatttacagtttaaatagaaattttcttttcaataatcaaaatacatccttagcaaaaatttagatgtaaaattttataaaataaacaagacccatagaaaagcatatttcagtaccatttcagacttagcctaagacgaaggttttccttaaatcctgacaccctgttggacaagcagggttcctcaggcaagatccctcttccagcaaccaatttaccttcctgattttggttgtttttacaaaatgctgatccaaaaagcttctccacaatggacactgcaacaccgatcagcagagcctttaagaagaaactgcggtggtgtctgtgggccgatgaagtaaggctgctgtgtaagaagccttttctgggttcccgccgggatgcgctgctggtgctgtccagccacctcgccatctcacatggtgctgtcgtggctgc

SEQ ID NO: 68136 - DNA, 1401 bp, Homo sapiens
aggtagaagggacaggacttggctgctgattccatgtggaggagctgctcacggtgccatatttccagcgcgcatgctccagtcactggctggaaaccagcaggcacgcgtggaggtgcagaggcaaggagttgaagtgtcctcagggaatctgggtgagccacagtaggaggtgtagtaagtgggacagggcggtcaccgggacaggggcaatgatggaagacggcgggagggaagccagaggcgtgaacagtgaggcccaggggccagccgagtgcctgagggctgcgggtcagagaagggggtcagagagacggaaaggagcatccccaggaggggccctcaacactgccaggccctgggacagggtccagtggaggtctgagggccgccgctgggacactgatgtggacaccctgcctacgtcccacggacaactagaacagagacctccgatagaccacgcggctttcactcagtggtgtctcctctttatgcagagagcatcagtgatgtcacgtttggagcaggggtcagttacatcgggacaccacggactccgtcgtcagccaaaggcaagttcttggtgtccttctgggctgatagatgcactgcctttgaggttctgggaaagctgaatgtgtttgtttgactcccttttagagaaaattgaaggccggagtcaaggaaatgacatcttatgtttatcactgcctgataaaccgtaagtttagcagtgttccttttgaggtggatgtttctgtcagggtttttctgagttccagaatgactgcacatgtcctttccctaggcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataa

SEQ ID NO: 68137 - DNA, 1023 bp, Homo sapiens
tcagtggctttatagcattgtggctgtggaaataactgatttattactatcctgttctttgaaatgttgattttcaatttttccatacaaatactatcacagtaaacatccttgtacatatagccttgtatgtatgtaatccttgggattaattcccagcagtcaaaggccatggatatttaaaaactttggatagtgtcaaactgtcctctatcacttatgccaagttagactcttttatttttttgaatcctaatgagaatggacattttttctcatgtttatcatttatttgtatttcttcctgaattgcctctttataagaaaattgtaaacactagtgattttgactttacgtcttgcagatatgttttctcatgtggttgttttgctcttcgttattgtttgggggtatttctggatagcagcaccttttctgttctagtgtcttcatacagtttggagcaagagtcgaatggcgagattgagcacgtgaccaagcgggccatcagcacccccgagagtgagtaactgatcggaacacgtgggcttctcctcagtctctcctgcattcgtgatgtgtttgctagagtcgcagtaaaactccttccggtgcaggatagttctgatggtcagaaccatgagtgcattgctgaggtggagtatttcacagtgaccacggtcgcttgatccatgagcactgaccgagtatgttgttccagtgtcgttacattcagtcagtcaaacaccacagtggcccgcggagcagacaatgccgttgaggcacaggtaggttgggtgactgacccagtggtgccttctggaggcggccctccgtgtctctgggctgtccgggtgcactgggcgctgctgggtgggcctgctcccagggcgggcagacgtcagcaccagcaggtaccatgcacgctctgcaactgccaagaccagagacccggggacccctgctcggagcctgtgtctcattcccctccatgttttttcctactgtttgtgcttttcctt

SEQ ID NO: 68138 - DNA, 1135 bp, Homo sapiens
aatcaggtactatatatataaattcatagtattttgtagatgtgtacacagagagagagacagagctggctgtcttcatgcttagccatttttagaccattgtcccttcaccagcaggaatacgaagtgtccctctgggtagccagaacgagctgacttctgttccaaggggagggtgttgaattgaggactgaaggtggagcaagagccaaggtccctcagggtcttctgtggagatttggggcttttgtcaaaagctactcaacatgtttctaattctttttccccatttagaatatatgagtagtatttgtccccaccctatcttacaaagccttcagagtgttttgaggtaatgcttacaaagtctcccagagaaaagcagaggtcctctacatccagtatcataatgaaaagcaaaaataaacttacatagtgtggtagggtggctctactcaaagaactagatcaaggagaggcctgtctttcagaagttcatacatctaaaacatgtctttgtttgtgttaccaggttcagaagaggaatttcatagaaaatattattccaattatcatctccctgaagactgtgctggagaaaaataagatcccagctttgcgggaactcatgcactatctcagggtaagggtggagcctgtgcttttgtggttgttgtcctaccagttcattacttaggatcttctgccagttatgacagtgcaggcaatccgtgaatgattagaaccccaaattctgcaaacccaacattaccttggtaactgctgtggagctaggggttggctgtgggttccaccaaagccgctctttcccttggatgtgcagccagggccgtgaagagccggcccactgtgccaagcacgtcttcccttaatggagttcaagtccatctggaaaactttcccagctggggtcaagaacacagtcatcttcgttcatgctgcttgggggtaaggtgaaagtgagtcttcgggtttgatttcagggtgcttaccttttgcactgactcagattcacaaggtcaggaaataactgccctgcaggagctgccttcggagctgccatcaccaggctgaattctttgtcaagcaaggggaccatgaggagctcagtcgg

SEQ ID NO: 68139 - DNA, 1165 bp, Homo sapiens
tttgtgtcacaagtgagcatgccactcccctaagcttatgtcacaagtgagtgtgcccctccccctaagctcatctcacaagtgagtgtgcagctccccctaagctcatgtcacaagtgagtatgtagctccctcaagctcatgtcacacgtgagtgttcagctcccctaaggtcatttcatgagtgtgaagttcccctaagttcatttcacgagtgtgcagctcccccaagctcatgtcacaagtgagtgtgaagctccctaaactcatgtcgcaagtgagtgtacagctcccctaagcttattttacaagtgagtgtgcagctcccccaagctcatgtcacaagtgattatgcggctccctcaagctcatgtcacaagtgagtgtgcagctcccctaagctcatgtcacaagtgagtgtgcagctcccctaagctcatttcacaagtgagtgtcccactcttctcaccatctactggcttccgtgttctccctggaatcctggtgccatgctctggtgctgacttctttcttactgatggctttaactcttgccagatggtgacaattctcaaacctgtttcccactccagcatttctcatgagcctgagctcaggtccccctgctgccaggacgtgctccgggtgtctctgacttactctgtcaaaactccctcagtcatctcttctttctgctcttcatctcctctttctcccacagtttatggtgctcttgcagactggagtctggtgtgtcaggctgaggcttttgttggcaggaagtgtagaatttggatctgaatgactggggcagagcttggctgccacaggcctctgcaggcctgtgttttcctcctagcctggattgccaatgtgtatttcccacctggcctctggaggcttttgactccaaggatatagactctgatcatatcttgccacaagatcctgcctgttttctcttaccaatctatctctctagttctgaccttatttaagcttatcccatttccatggtttccttaccaccctttctgtttctggtttctttctgtcacaggccatgtaccaccttgctgccagagcagtctttctttctttttctttttttttttttttttttttgagacagaatctcactgcgtcgcccaggctggagtgcagt

SEQ ID NO: 68140 - DNA, 1037 bp, Homo sapiens
aaagtcaaacaaagagagacgaatgaaaatctacaaatttcttctagagcacttcacagatgaacagcgattcaacatcacttccaaaatctgccttagtattttgggtaagcccagtgtgtgtgggagaaaatgtgtgtgtttgcaaatgaaatgctgtgttgataatggcccagcaggcctctagtaagggagaccctggcactgcaggaagacccctgtcatcttgtccttctctggcatcagctgtgccccagacaaaacacccttgcagaccccctgacagcctcagatggccccccagttgtgggaattacacctcctctctgggccagagcatttctcagaagctcacgtttttctctctctctgtctctcagcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagtgagtgtgttgctcccctaagatcatcttctcacaagtgagtgtgctgctcccctaagctcatctcacgagtgtgcacctcccccaagctcatctcacaagtgagtgtgcacctcccccaagctcatctcacgagtgtgctgctcccccaagctcatctcacaagtgagtgtgctgctcccctaagctcatctcacgagtgtgcacctcccccaagctcatctcacaagtgagtgtgctgctctccctaagctcatctcacgagtgtgcgcctcccccaagctcacctcactagtgagtgtgcccctcccccaagctcatctcacaagtgagtgtgctgctcccccaagctcatctcactagtgtgcccctcccccaagctcatctcactagtgagtgtgcccctcccccaagctcatctcactagtgagtgtgcagctcccccgagctcatctca

SEQ ID NO: 68141 - DNA, 1021 bp, Homo sapiens
gcctgtttacatctggcattgaaaatcttcattttggtagggtcctggtggcatctgtgtcccatgtgcagcattgcacagatatgttgagggcatgggtggaaggagagtgcccagggcttgctggtgattccaaagcgcattgagtcagttgctttgcagagggaacttgtcctcctgatccaaactgtgaagctcttgtcattaatccttattcttgaaaaaagttccagttactaaaattggtttttgttcataattgtgggcaacaaacttgaagttgggaggtgaaggccagatatcccttttctggtgactgttgtcattgcatcagtcttataagaccactggcctctgattgcagaagcagctttggggttcagttggtcgattactttccccacttgaactgcagctggatgacaacaccttgtgtcaattttgaaaggaaacctggtggaaaaaatatacttaccttggattagaaaggaagctgtggagcaaggacagaccaaatagctgaatttctgtcttctttggatccgagggaactgtttattgggatagattttgaatccctacgcttatgtacagctctcctctgctcagcagagttcttggtgtattcagagactgttggtacatagcaaatgggtctccctctttgtttctctcacctttgcagcttcggggagttttgcctggctcacctgttactgaagaggaaccctgtcatgttcttccaacacttcattgaatgtatttttcactttaataactatgagaagcatgagaagtacaacaagttcccccagtcagagaggtcagtgaagcagctaagtctggtctccttgtatctgggtaagagctgggggaatcaggggaggttaggctctttgcatgtagtgattggacgcagaccctgccccaggtctttactgtggcttggcaggatggcgtaagaaaatacagtcgtgagaatcgcttcctaagggcagcgcctgtgatgagcactgggatc

SEQ ID NO: 68142 - DNA, 2065 bp, Homo sapiens
tacacactgagagcccatgtttggcctataatggggagaacacctttcacttaggttgtatgtctgtcctggtatgttctgtatgctcatcttttcatgtattacgaaccgtattataaatagagggtggcaccatccctctaatgccatgtgctttgagtcatttttctcctgtggtagaagggtgatgttgttctgcacatacacttctcggcactacattccgacggtttggaagtgtgtgcctgtgcactcagccagtgtgccggggacagaccgcgtggtgggtggggtgtggctgggaacagtgaggcttgcccatgatgacgcactctgaaacatgccggcttctctctgcacaggaggaatttgtgaaatggaagggctccctgttcttccgatttgtcagcactctgatcgattcacacccagacattgccaggtaaatcttttcctcacgtcagacgactcaacagtttacctcatttctgatgtatgctggatttctttttttttcagattggtttagagttaagtaggatttagtgagctttcggtaggtgccaggaaaattagcagatttttaagatgctaagcaatataacaaacctttgttttgcacacaagtttaaaagaaaatggttagattcatcattgaataatctcagcattgactgcacttgctgacagtgtttgctgttcctgaaggagcttgaagaatattatatgcttgctgtattacactgtatagagtagcagccactagaaactcactgttaatttctaggcaaaaaaaaaaaaaagttaattttgataaagagctgagactttaattgcagaaattttaaggaggaaactaggaattaagatgaaattgcacaatgtggaatcaagtgtacagatgacaagactccttggaaatgggcatttcttcagacttctgtggcgtgggggagtgactttggcaattattaatttctatccttgcatctttttttttaaagatttttttcaaggggttgagaaatggtctgatagaatttgctaccctagagtttgttgtaacagtaattctttttcaagcaagtctgcagttggaaagtagaatgctgaatgccatagcaaaagccccacagtggggaagaggtctttacagagctcattaactataaatggctgctaacagtgggtccctctggatctaaatatagccaccaataatttaccctgagttccgtggaagtttctgctcagttttctttaggtgtgattttccaaggaggggaacatttcacataacaaaccagtaaaactaacattctacttactgctttctagaaccagaggcaaaaagctaaggctgtcacctttttttagatagcttcacacaccctcttaccttcacaacgtgtccactatactgactctcaggactttttacgcagtacgtggcccaggagaaggtgtaatcagacaggctgggaatgctttcagatgatgcacctgggaggtaaaatcggttacttaacctgcatttcctcatttttccccgctgttgttagcccctatatgtgtatgtgaaaaagagcaatgatcaatgagtaaactgtatgtgggatttgtacatatgggtgttcagatcatcaatcaaatgaagagcatagatatactttaccgtgtagtaagattaccagggcctcttctagcattttaacacttcccccttaatctatcccttttatgtccgcatcctgggtttgttgaaaccatggttcaaatgtagaccatgattttcagctttgaaaagctgatgactacatttgctaactgtaatttaagttagtctgttctctggaaattttccttttctttttatttgacgtgtaataattatacatatttatgggacagagagtgatgttttgatacatgtatagagcatgcaatgatcaaatcgggataattagcagaaccatcacctcaaacatttatcatttctttgtgtcaggaactttcaaaatcctctccctagctttttgaaaatagacagtaaattgttgttatt

SEQ ID NO: 68143 - DNA, 1524 bp, Homo sapiens
gtagctgggattacaggcacatgctatcaggcccagctaatttttgtatttttagtagagacagggtttcaccatgttggccaggctggtctcaaactcctgatctcaagtgatcgcctgcttcagcctcccaaagtgctgggattacaggcgtggtaagactgaggaaagagtgatcaggaggaattaacgttacagactatgaaaccacaagccttccaggctcagtggtacacaacttactaccggcagagctgggactagaactaaggcctctgactttttcctaattttcttttcaccagcactggttggaaaaagaatcatgtgtacagcgcgcagtcagggcctaggaagtcatctgccgcttgctgctggcccagggccattaggacggtggttacattgtcatgagagcctatgaggaaggcaagaactgtcttcaggttagacactgagagctggaagcgggtggggcttactactgcattagcaaagaccgccacggttttaatctgccgacacaacctcacttggtggttgacagaggagcaaggccctgagattgtctggaatgttaggatattttcaatccatgtgacccgcttgtttcccctaaacacgcttctccttttcttttctctgtaagtgaatatcatttattttactgagagcaacagattacccaaagatatagctcagcagcagtatatatgaaaggactgtggtctttgggcatttttgttatctgttttgtgactgtcattaaaaaattgatgagatcttgtatcagtagaaatagtgtctagaacaagaggagcagtgatcctgtgtgctggctgatagttcagtatcagtgacaaatttacagagaagtgttgatgaaattgaatataactagaggagagcagttaaataagggtatcacaaagcaagttatgtaaggaactgcagaagggcctggagtctttagcatggagaagggaagggttggggacggtaggctgcctagctaaattcaaatttatgaaggactttcagataaaagaattggatttatttggtattcccagacaacctatctggaccaatgaatggaaattataaattttggtgaactgcagagaaaacttactgaggtctgcccaaaatggtgggcttgccccagagcatgtcccctgttattggaggtattcaggagaagctggacaaggacttggaacaggctgccatgtggagagaatgccaggattgggtggccttgtcagctttcccagattctgtgataccgaaacttactagtcctagtacccaggttctggcctcattgggatcaagcataagaattgcagaaactctttgggccaatgttgtggtccaggttgtgcaatctattaaaattttaaatgtaatagttcttttagaagtaataaagccaatagtttccagatacgttagggcaagtcagactaaaagcattgctcatagtggtggcttgccaggcactggatgatggttaacaca

SEQ ID NO: 68144 - DNA, 1054 bp, Homo sapiens
agcctgggcgacagagcgagactccatctcaagaaaaaaaaaaaaaaaaggacaatgttactaatttttgtcactataactgtgtaagctctggatgtatctgtaactgaccccatgcagttatgtagaaattttggaggggaggaggataagaagagtctgaaatgaattgtgaaattttattctttactttaaggaatattttatgaggggaaaaatgaatataactgatagtagaataataaaaatttaaaagatacctagtttggtatcagacacgccactaattaggaacgtctacatataagtttcatgtgccacttgagtcctggagcagcagaagttgataccctttcagtgaggctcccatctgaatcattttgtatatttacagttgcaattctgcttttctatcttttttttttccagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcaggtttgtatcttctaatttaaccagtaatgacactgaagagtcttagaaacaaagcccaagacttaaggaagtgagctttttcatagctattcatatacagagaccttctgtttaaaacctggtataaaaacaagcatgaaaaaaataagaatcatgtttcacccatttcccctttgtccaagtacattaaatgccttgatgttcccacagcttgactcctaagccatgctacctaccctgcttcctccagtgttattaatccagaagaaaggcctttgttggcagcagtgtttaacttgcttctcccttcatattcctcctgccctttctctagtcagcagaatcccaattcaaacaccttaggacatattctctgtgtgattgggcatattgcaaagcatcttcctaagagcacccgggacaaagtgactgg

SEQ ID NO: 68145 - DNA, 1587 bp, Homo sapiens
attagttttgaagtgttctaaaacctaaaatttattagtcatttacgtaacatttaaaggtcattgaactagttgtactcactgactttcaacttatattacagaatatgtttcagccatcctgcgggtggatattggttggtcaacttctctttttgcttttcaggtggtagataaatcagagtatcgtacttttgcagcccagtccctagtccagctgctcagtaaacttccttgtggggaatacgctatgttcattgcctggctttacaaatactcccgaagttccaaggtaggagatagctctgcataaaaccttgggtcctttttaaactctttttaaaagggtctctttttctaggtctgaatgaggagggttctttggttcttactcctatctgatggcaattcttatgatcttgctttaccagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtgagtatggcgactattgggacagtaaaccggtcttgtgctcattgagaaatagactgcaagggaatcgttcttttctgtggcaaaagtaataggtatggcatgatctatttttactctcaaaaccatttttagtatattttcttgccaaataactttttaaataggcaagcctgatacatttgcaaggccttttaaaagtatttcagatgttcatatctgagaggtgacattggtggctacctttactgttgctttgcattggtgggcattggtcgtattaggatgaatctccgtttcaatgcatacccaaggagaacgttatcagttgtcagcaatttagaatctgtctgccttgtctttgagcctaattatcttgattttgattcctccgtggataattactcagtttatgatactgacttcttccttcttatctttcttcttgtttttaggtcctacgttttctgtaatagagagtcaccctggtaccttactgagaaattcatcaggtaatggatcaatacattttcaaatattgaatgattatcttttaaaaatttgtggaatatttaaaatgtttttcttacctccttatttacctgctttaacattgtacttttttcatgagagaggttgaaattcatttcagtaataatgttgtaacttaaatgagtaacatgccctgctaatgttattaaaagtataacacatttttagcttaatgactgtaattttttttttaaagctttttcctaccaaaggcagacatctaaccgttccgaaccctcaggggagatcaacatagacagcagtggtgaaacagttggatctggaggtatgtcagattttatcactgtcagataggtaatactgctggatttcagacaaccgtaagtagag

SEQ ID NO: 68146 - DNA, 1026 bp, Homo sapiens
taaggactttttaaaacattaagtaactaaaatgttttaagtgaaaacacgatcgtttcgttttttccatgagagtttctcatatgccagtcgcaatagtcttcatgtaatgttacagataaacatcactaaaaatggatcaagtctgggcattgtagaaatttcttcttgaggcggggcgcggtggcacatgcctgtaatcccagcactttgggaggccgaggcgggcggatcacctgaggtcaggagttgaagacgagcctggccaacatggtgaaaccctgtctctactaaaaaatacagaaactaggcgtggtggcgggcacctgtaatcccagctactcgggaggctgaggcaggagaaactcttgaacccggtgggggaagttgcagtgagccgagatcacaccattgcgctccagcctgagcgacaagagcaaaactccatctacaaaaaaaaaaaaaagaaatttcttattgggttaaagtttggagaagtaatgttactaatgcatttcactgagctaccatgaggtggtactgtgtcttagtcaatttttatatttatccccaaaggatatattttacatcttcatatgaaatttagtaagtagtcaaaagaattgtatgaagattacatttttgttcttacctgatgacttagctactctgcagcagctctcaaaactgcacgggaactacttcacagttttctacgatgacattttatgtcttcactcttcattctactgaaaccactcttatagcgtgaggtagagtgttttaataactaggatttctaaatataggagtagtggtttttggggacagtcgctgactgtattgtgaacagtagatgtgtttttcttttacaaagcgcccttgtggatgaattaaaggagagtatattcccagtcgtccgtatcttactgcagcacatctgtgccaaggtactgtttgccttagtaatattaataacatggaagtatatcgtgtgtgaagataaatgtgtgtgtgtgtgtgtga

SEQ ID NO: 68147 - DNA, 1035 bp, Homo sapiens
aatatgttggaaagtgctttgtaaactggaggcaaaaagcaggtgtaaagtatcgttctttccccttttgaataagggaacattagtagcattctttgccctatgtaaatgacagttaattccctatttgtcctaaattctgggttatgatatgcaaagggtggggagagaaactaggtattgtttttatcagacatatcatctgtcagccattctttcacactgtttacattgtgcatttattgtatcctgctcattgtttaagaaatatatccctagtgttcagccagcaattatgccagcctgacctaccttcagatggcttgaaatggtttactacagtctgcatcactatgtctgagacccttgtgttctccatccgatcttaaattgaattttcttttctcttctaggtcatcagttgtgttttccatcaaatgctcagtgtaatattaatgttagaagttggtgaaggatcccatcgtgccccccttgctgttacctcccaagtcatcaactgtagaaaccaggcggtccagtttatcaggtgaagcacacaaatcgtgaattttcaccctgtcagtctccctcagtactctgggccctgcactaagatttctgatacatgtagacttaaaatttctggcctgatggtggttttgggggtgaaaaccaagcacttcgtagctaatgtgctttatgtgtctgggtctctgttggtaggctcccagctggggcactgttaaagagataggaatctgcagaacacgggccagcgccagcctccagcttgtttgcgctcaatatgtgggtcagcctcagagagaggatggtggcctctcctcctttcccttgtctgcttcattgcagccagttcacctctttcccttttctgttgctctctactttgcagctctttgcttttgttctttgccactttcttcttgtttctttgcacttttctattcctttccctctgtagaaatgacttgaaggaaaggattgagttgctttttacctccgtagcaataagtg

SEQ ID NO: 68148 - DNA, 1047 bp, Homo sapiens
gcaaacactgtaacaattttgttcatttagaaacactttaatttctttccctttgtgtgctttgttacactgtgcttgctgggaggcacttttctgcatttatttgcctggcaaaactcttacattcaggtccaattgaagaatcatcttattcctctccctcctcccccagtactattccctattaagctctgtagcattttacattttacatatctattattttaacactcatccatagcaaaaataataaataccatctattgactgttttttatgtggctagcacattgttagggcctttatacacattatgtttcacaaaaatcctgtatttccaatgatgaaggagagactaattatgtgtaagtgatcaagtcaggatatttgcctcgttctgactcaaaattcagtggcctctcttctatcataggctgctttttttggtatcctaagtgtgaaatgttgagatctttgtggacaagaaccctctagtattcatctttatatccctagaagtataagtggcttccctagtattttctcaaagtgtttgttgagtgaataggtgatgtatttcttcctcttcttccatcctaagtgaagtagcagagcagaagttacctgcattcgacagctgagaaaataggtagtgagagatttgaatagtgtaaagatactgagggaaaaagactaactcagtgtctcctatactctcactcaacaatcaacactgaagacttctgtgaccaaatggtagataacagggccagttactgccatccaaattagatttgatggtatttacagtagggaactgtcataagcaaaaccaaaagaaggagtgagataacttttgctgtggtctataatgacctttaaaacattactggaaatttggaaagaaacaattgtatttttcagatcttctttcaggcagcatattccatgtctttggaaggaatgctgtgcatagccacttagggtacagagaccccctccttcagggtcaagttcaagtgacaaaagatgatgaccagattgtat

SEQ ID NO: 68149 - DNA, 1035 bp, Homo sapiens
cttagacaacatgtttcttattatttggctttgggatgtatttcttgatcaagaacaaggcattagaataacctttgtagttctattcgatgtaaaagggagtttgtgttcctgaaatacacacatggacagggagtaaagatgtactatttggaagtctatttggaggcacagagtgacttttcttagacaatatgtttcttattatttggctttgggatgtatttcttgatcaagaacaaggcattagaataacctttgtagttctattcgatgtaaaagggagtttgtgttcctgaaatacacacattgacagggagtgaagatgtactatttggaagtctatttggaggcacagagtgacttttcttaaactcttatattcctcctattttatcttcctggttccccgaaagaagcatgttgtgaagtatttgtgtcatacacctgtgtcagtcattgtaaactgagcttggggcaccagagcgaggctagtgagtgagtttgctgaagctgcggtcgtgtggttttctccttcattgcattctttgactatgtgtgagatgggtggaacttcagtctgttctgaggtctggctgacggggtggcatatggcagtaatcaagttgatagcactgagctctgtccctcttccttgttaatttggaggcaggcaggcagaggtgtcacttttatcctgtcacttgctgtggcaatctcatctgcaccgatgacttattttctttgttttttatttaaaaaattttttgagacatggtctcactccgtcacccaggctagagtgcagtgccacgatcacagctcactgcagcctcaaccccctgggctcaagcaatcctcccatctctgcctcccaagtagctgagactacaggtgcatgccaccatacccagctaattttttaaattttatgtagagacagggtctgtctttattgcccaggctggtctggaactcaagcgatcctcctgccttggcctcccagagtgctgggattacatacatgagtcactg

SEQ ID NO: 68150 - DNA, 1127 bp, Homo sapiens
ggcgggccacagagggcagcttgttaaacccttcagggctgtgtctctgtcttctctctcatcccctccacagcagcgtcctccccagggatcctaggttcagccagagacttgttattcaacagaccaggtcctgtctgcccctgtggcatataaggtttgctctcctggaatgcccttttctccctccacacagcactggatcgcagcatctcaattagccctttccgtgtgttcccatttctctatttgcccatctcccccggtgaactgtgagcttcccatgagactgtatcttattcatcctgtgcttagcccagtgcttagctcagtaaatgtttgtggaatgaatagctgacttaatttctctctttcctagtcccctcttttaacttaagaaaggtttattgggacactttaaaaaggtttattgattgaatattgttcggtgaacaaacatgcaaagataaaactacgagacggactcctttgccccaaaagccaggagttagctgatgaaataaaacctgtacacaaatacatggtcagtagtggtaagggccgtgaaaggcccaagaataacatgtgattggggtacaaggcagagaaatcactttcccttacagcaggattcttgacccgggggcatgggctccctagagggatttgggggaagggtctttgaactccctagaattgtggttgaaaaggtctctgtataggtacatatgtgcatctttccctggaagagggtctgtaacttcttaaaaggatacaaagccctcaagggttaagaacctttgtacaggcttctctcaagtgggccaatttggtacctatatctaggtagcatctggagactgggagtgtttattcatgacagttccgtctcctacagctatttccttcgtgctaccatcagccgccgcctcaatgatgttgtcaaagagatggacattgtagttcacacactcagcacatacccagagctgaactcttccatcaagatggaggttgggattgaggactgtctgcacattgaatttgagtacaataaatccaagtaagtgtctcagtgccaaggttgtgaaatgattatttaaggaggttaagatgggacttgatgc

SEQ ID NO: 68151 - DNA, 1041 bp, Homo sapiens
ctgaggctgtttgctcaggtgtctgcagtcttcctgtagcctgtgcacagaagggtggtgtgaaacagtggggaacactccagcctggggactaggatcctgggtttaccacctttctctaccccctactcacatcctggttatccaagagaacattatctcttttcttccaactgccttttcttcacctgtaatataaggaggctgaattctgatgtccatgccagcattcttatcctgtgagctgagcatcaggttttaagattttactcgttctctcatgcctgatacgggctgtgcacatgtagactattgactgacccagagaaaaaaccctgagggtcaggaagtgttacccaatgtggctcacttcgtaacaactcacaaggccaggccagcggagcccagaaagcaggcgctgatgccgagagtgatttgctcttctcactctactgctgctgcctggcctgtcggcctagagcggacagaactgtgtgctttgagccatccaggtccagttctctaaagacattgtgtggagatcagaggaagggagagactggtccctgcgcttgtgggactagcctctcatacattaggatatctttcaaaaacacaaatataaaaggtactaaagcagctgcatgctggggagatagagcagatgaacaaacatgaatgggtaccatgcaggagagacgtcctttgcgtgggatgtggaagggacagaagctactttaatccaagtaaagaccgcactgggaaacagttcagccacagccatgtgggcagtgatgggtgagtgtgtcctgcaactggacgtttaaccagcacgcttggccgtggcgtgtgcgctctactgaaacagaaaggtctggccacagtaccaacatcttactttctgtactttctgttccccagataccacttgaaagatgtcattgtagggaagatatacttcctgctggtgagaatcaaaatcaagcacatggagatagacatcatcaagcgagaaacgacgggtacaggccccaacgtgta

SEQ ID NO: 68152 - DNA, 1069 bp, Homo sapiens
tgcccaagcccctttacccctctccctataggttacacaggggagaccagggcctcggcagaagactgctgccacacttccgaatcattctgcttgccaaataggtcatcttcaccagttgactgacccaagtttaggaccattggtatcgtgtgtttaaaaaacacatataaaaaaactcttgtgaatattcttgttatgctagagaggaaggtacttctccctctacggctctgcgctggggcctatggtagtaaagttgtttactgtcctttttctgcttcccctggaaatgacaggcattactctcccattggcctcccttccctttatagaaagaccaagcaggccccactggccaagaggtacggtatttggcagtctgagttctcagtaatttggaaagttaaggagttggttcctgtgtcacctttcagttagtgtgggaaaggaagacttctgttttcctgagatcagtgcagtctcaggcctttggcagggctcatggatcagagctgagactggagggagaggcattttgggtagcctaggagggcgactggcggcagcagaaccgaggaaggcaaggttgtttcccccacgctgtgtcctgtgttcaggtgcgacacacaatcctcatgggaacaggatcacccatgcgctgcccttgatgatcaaggttggggcttaagtggataagggaggcaagttctgggttccttgccttttcagagcatgaggtcaggctctgtatccctccttttcctagctgatattctaactagaagcatttgtcaattcctttgcctcccaactgacaacacacgttcattttccaaccttcctaacatcttaaacctttcttctgggagaactagaagacagaatttgctttgattctctcaggcgctgtgcacaagccaggtcttctgttttctctttcttactctacccacattcttgccttctctatccaactgtgaaagtgaggggaggctcctgtccccctctcttaaggtccccaaacctgggagtgcataggtactaaatcaagcagtgcaacttgtaa

SEQ ID NO: 68153 - DNA, 1085 bp, Homo sapiens
cacaggtacatcttacatggtactaaggcgagcagtcattcgttcaaaactatttaccaggtgccaagcactatagagtactgggtaatagtaacaggtaactctggccacattccctccctcatgggtgttacaggtgaggatgctgactgagaaaggtgaagtaccatgcccaagtttaatcagctagtaagtgggaattcatgaggtcattctggtatatggacaataaaggagagggcccactcttaccctgggtcaggggctggattgataatctctggcgagtgaagagaaccatattttttaaggggccaccagtagctttgtgagcttgatgataggatttgagctcagccaggggaatgaaacgtttcatcatccgaacaaactgtacatccacctatgtgacaacagtgtacatgacagaaagacgtgtctaggctgactgtgcccactgtatttttaaccgcccacaggaagctcctatctcagtatcacctcatctgagtaagtgctgggccgtgtaccttgacctacagtcaccccaaccgtcttcttcccctggttcatccttcccctgtcatgaaatagaaagcatagtctttaccatggaccacttagggttgtcctctttgctagatgggtcataatggggattgtttttctcaaactgtgtgtggtctgggtaagcctctttcacgatctgaaaccaaaacaaaagctttgaatcatctgcctgcagtcagctccacagccaatcttttaatccatatccaactttcatttcttccctgcacattcttaacccatctgccttgctgtacagccaatgggggctcagatatttggaaacaatatatagtctaatatatagactaggaaatcaactctgtttttacaaaagtcttaaaaacatgctctaaaaacaaatggcaaaggttattactggtaccactgtttttttcccctctgcacagttaataattttatcctgataagcttggaggagctatcatcaggcctgttttcgagtgagatcaagacttagaggtggagtgaagtctgtgctagtcggacctgaa

SEQ ID NO: 68154 - DNA, 1035 bp, Homo sapiens
tatgtgcttactaactggccaaggattgtttaatgattgaatttatttcctcttgcctagttcagcattgaggatctcaaagcacagcccaaacagacaacatgctgggatggtgttcgtaactaccaggtaagagggtaaggaggaggtcgcctgagacccaggtgggatgaatgcctgcctcctcctcatgacgtactcagtagcagaacctcttggccaaggttgctttttctcagaagcaaacctgataatgtattaaaaaatgccttaagtactctgcatgaaattttcaattggcctgtgttctggccaatgtcctggtaaaagtctgggtgtcctggcaaaggggaaggactttctaatgaattgaggagttgcagacaagaatcacccatctattaaaagcagacttgatttctgctaaaagctagtactttccagctggtgggaggatagttactctttcttctcccgggacaggctcggaacttccttagagccatgaagctgggagaagaagccttcttctaccatagcaactgcaaagagccaggcatcgcaggactcatgaaggttagttgggcaggttttggtgtgaatcccttttcctccagggagactaacttaagtagatataaagggatataccttaattaggcaacaaaaaagtacactcccccccaccccatcccccttttacaggaatagggaaaaactgccctggccccttcctatctgataactcaaagcaggccttcattcaggtccgactagcacagacttcactccacctctaagtcttgatctcactcgaaaacaggcctgatgatagctcctccaagcttatcaggataaaattattaactgtgcagaggggaaaaaaacagtggtaccagtaataacctttgccatttgtttttagagcatgtttttaagacttttgtaaaaacagagttgatttcctagtctatatattagactatatattgtttccaaatatctgagcccccattggctgtacagcaaggcaga

SEQ ID NO: 68155 - DNA, 1009 bp, Homo sapiens
ctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttccaggagagaagccaggaaattcctctgtcagtcccaccactgtcctagccagagcttgtgctttatttctgtccatcttttcttgggatatctttaacgatattaaagtgtcgggtgagtgaagtggacttagcacttaaaagcaat

SEQ ID NO: 68156 - DNA, 1171 bp, Homo sapiens
gaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgagtgacttcggtgaagcaacgtgaggctgccttgctggaaacattatataatggggcttccctgcccctttcacagcacccttctcaaacctcagcctgtgctggaatcgcctggagggcatgggagcgcagattgcgggcctcaaccccagagcttctgctccagagggtctagtgtgggcctgggaatttgtatctgcaacaagtcttcaagtgaggctgccacagcttgtctgagaaccacactttgagacccaccgctctggtgttaatgtcagagtcacaggc

SEQ ID NO: 68157 - DNA, 1043 bp, Homo sapiens
actgtccacagcgctgtcagatccaacgagagccgctgagtcacatctggccaccgtccgcagcactcacatctggccaccgtccgctgcgctcacatctggccaccgtccgcagcgctcacatctggccaccgtccgcagcgctcacatctggtcaccatccacagagctcacatctggccaccgtccgctgcgctcacatctggtcaccatccacagcgctcacatctggccaccgtccgctgcgctcacatctggccaccatccgcagcgctcacatctggccaccgtccacagagctcacatctggccaccgtccgcagcactcacatctggccaccgtccgctgcgctcacatctggccaccgtccgcagcgctcacatctggccaccgtctgctgcactcacatctggccaccgtccgcagagctcacatctggccaccatccgcagagctcacatctggccaccgtccgcagcgctcacatctggccaccgtccactgcgctcacatctggccaccgtccgcagcgctcacatctggccaccgtccgctgcgctcacatctggtcaccgtccgcagcgctcacatctggccaccgtccgcagcgctcacatctggccaccgtccgcagcgctcacatctggccaccgtccgcagagctcacatctggccaccgtccgcagcgctcacatctggccaccgtccgctgcgctcacatctggtcaccgtccgcagcgctcacatctggccaccgtccgcagtgctcacatctggccaccgtccgctgcgctcacatctggtcaccgtccgcagcgctcacatctggtcaccgtccgctgcgctcacatctggccactgtccacagagctcacatctggccaccgtccccagcgctgtcagatgccgaccaaaccctgctttggtgttgaggtggtttgtctagtagcctcctttcttaagggaatttaatctgctgcaaatggttctcatgtatgcaatagatgttactgtaactgttttataaggtgcattgccttca

SEQ ID NO: 68158 - DNA, 1105 bp, Homo sapiens
ccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccacaagcatctggggacacaaggggccgtgactgacaaggagaaggagcgtcccccgagttgctgcgctgctgccggagccctccttcagcacaaatccccctccgccctcggcaagggcgtcctgagcaggagacctgagtgagcggggagaggagatgggcactgttgtggtgggagcaagggaagcaagtgggtgtgagggagagacggggacgttgggtgcgtaggagtctaaaggaccggagtgatgtggcctgaaggcgccagaagtgtgcaaaggagattttgggtaaatgagggaacgatatccctgcttgagaaggttttggggaatgctggagcaaaaaggagtaaccagaccattagtaggagcaaaggaggaaggaggtgggtgttaagcgattggtgatactgggaactgacagcatttaaacggggttaggctgggttgaagttcgagtgaagattaaactgtagaaaagagaaccattgaaggaatctttttaagtgagaaaaaatttggaaggaagtttgggtagtaaaagtatttgcatggagactgagatgtgagaaaagctgaaggcttggaaagaggcatgtgaagagctttaaaaaggctggggcccaggaagagtaggactggggtagaggggaatccaggaggccggggacaaacctgaaaagcaggagtgatgtgggaaaccaagggagctggaggcagaggaagagaaaatgtggctctttagctggtgaagtgggagccacagctaggagtggctcatttagggaagctttctcttctctgacctgattggacacccttcctctgaattcccgcagagccgaagaggtgcaagggaacatcccatcaaaccaatggaggactcaggcatggcttgaggactcagtctggttacagctttttcctccaactcaaggagggttttt

SEQ ID NO: 68159 - DNA, 1046 bp, Homo sapiens
ttccccagcacctgtcacaagtcgcacagcaagacggtcctcctgccagctcttctccccttctccctctgccttcgaccctctcaccccaccccagcagtcctgggggatacaacctagggcaggccaaggagtgagcatgcaggtccctttggggagccctttaggaatagagggcctaggtgtcattttgaaattcctccaagccctctagggagtttgtgtcctgttgcagagcgactggagcccttcttagccatctgaattgcagagccctctgggctgctcaggccagagggctgtggagttgcagtcagtagaatctgggccctgctccccgagccgggtcctggacagaagccatgttctgctggagagcagcccctccccacagatccccataccccaagcctcagggtccagcctcactatggggcacctcttcaggaagatgtggtggctatgtttctaagtcactttccctctttgcatcttggtttcctcatgtgtgaaccaaaggctgtaccagagggcctcctggccccttcccacgctgaaagtgagatttctaccatgggcacagagagcaccagggcaccagcctacagaggacagtggtgaggacagggcactccatgggttgtccctctccccggttcattcagttcagggaacagcactgcacagctgctctgtcgcaggccctgtgctaggcctggagatgctatgatgcaaaagatacaggcctagtcatcagggtgcccacagcccagtggtgggcagacacggggccagcaccagtgttactacctgagcactagctctgtgtcaggcccaggctaacggttgccatgtgttatctccccgggtctgcacaacgtccccgtgagattggcaccattaccgtcccatttctggaatgggaagattaaggctgagtgatggtgatgttaagtaacttgcccaaggacacagtcctaggaagtaatgcagccaagacatggactccgcagcccatggtttcgaccctgtaccttccaccatct

SEQ ID NO: 68160 - DNA, 1131 bp, Homo sapiens
acagcgagaccccatgtgtctgtctgtctctctctttttttaaaggacagaggctaagctgtaaggttagcatggttctgcctgggctttgcttctgtgcttctgtgcaggctgagctgtaaggttagcatggttctgcctgggctttgcttctgcgcttctgtgcaggctgagctgtaaggttagcatggttctgcctgggctttgcttctgcgcttctgtgcaggctgagctgtaaggttagcatggttctgcctgggctttgcttctgcgcttctgtgctagcaggtgcccacaaaatgtctttttgaatttcttaatttttgggttctggatgcaattcgtgcacgccaagaaactacttgcttgtcagtattttaattctgtagtacatgtgtgtgaatatcagccagtacttacagtaggaggatgaacagaaaaactgagaagacctgtctttcaaaagatgggtttatccactttttaagggaaaaagtgacagtttggcatgggatttgaaaagtggaaattgtggaaaaattgagctgttgaagtcccacatataaccagatttaataaagcttcacatgtgaattagctccatatgtgtgtagaaggttgcttttatagcaggtccttaagtactccttttgaaattcctcctttttttttaagtcataccattacttctttggatatgaatgtcccaagtggtatctcctactgtagtatgaggaagaatggctgttaatgtattttttgaattttggtcttgtcttggcctggatcatatccagtcaccactatgcaacaaatgatgtgcactgggcaaggatatgatgggttatgaaagctgtatcttgtttgttttttcttttgcagtactccaagtggtctaaacaggaatgtcttgtaaaacctcaagactccctattgattattcccttacatatttatttacaatttatcagggtaattggtggtgccttatgaaaagtataactcgatttcttgatctttgagcatgttttgtgtttcttgtgttttctaaaagaatattagatatggttaattgcattacatctaaaagatttaaaaaattgtgtgtatgctcaggttccccacacccat

SEQ ID NO: 68161 - DNA, 3211 bp, Homo sapiens
tattgacctgtgtctttgactgttataattggttaatttgtaagatttgacatctgatatttgctaactttttatagggagttgtatttgtaacggaagaagagaagaataaaaaatattagttttaaaagtggcctatgtgactgcttttctaaaaaggtatttaatgctcttagtactttggcttatctctttgaaataaagctaatacacaggattgccttcacattgttgtactcttcctttcttgattgataattgcattgtcttagagcctagaaattgttaatattagctaaaactacttggctgctctattagaagttccctttttgtcaaatttttctcaaacatgtttctgcctcacaaggagccccaggtattcatgaggtaatggagtacctaagaggcctaattttgtggacacactatggtgaaatataattttggggtattaacttctcagcttctttctttaaaaaataaccccataagaagtcattgcctatctagacatcccagttgtttgctattgtttaagccaagaaagctctttggtttgcttttattctaggcttaatgtttatgtaacctaaacattccccaatcttgtttcctacaggtagactgggtacaatgtgatggtggctgtgatgagtggtttcatcaagtttgtgtgggtgtatctccagaaatggctgaaaatgaagattacatctgtataaactgtgcaaagaagcaggggccagttagcccaggtccagcaccacctccttccttcataatgagctacaaactaccaatggaggatcttaaagagaccagttagcagatgcttggttagtttgggacatggggggacatggaccacattgagaccttagtcatcaagtagagtggtttatatccacttggaatgttgcttccaaagatgaatggccttcagagaaagtccccttagtgctggcttcctctttgcatggactctgtgggttacattctctatcaacatatctatgcagagggtgtcttctttggtacaacagccaatatttcatgtctcctttgagtgtggtttactgcattaaggccagatgcttaattgagctctagggtggctggttagtattaatacattggtgtgctaacagggcatataggatgtggcttttgtccagctgatagtagttagaggcttacaacttaggagcagcaccaactgaaggtgctaattgcttggatctccttcattgggatagttggagagggattggagtaccactttccttccactgttacctggtacttaatgccctaaagatacaactaggagtaacagggccaaagttatttctgttagacgtcaaggaatggtatcacagtctattgacctcagcgatttgtgcttgtttgtgctagaagaacatcccaaataggagaacctctcacaagctggggcaggtcaccttatctttgtaagatgaggatatcatctagatcagaaatctgactagattggattctgaggagaagaacctactacaaggcaaggagccgttttttggctttgaaaagtcttgctgtcttgggtctacattttagggaagagcaggtacatggatccaggcttctgccaaaaaaaaaaagagaagaagatgacgatgatgaccagtcgtactatcttactgagccacagtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactgatttcataagttttcgttttgccaagctaacgattatcaattaagaatttcctctggttgatgttatacaagaaagcacaatattttttgcctgttgatcttctttgtaacagtcttcagatatttgtgggttaaaaattgaatgtaattttaagtgacagatgcctggaatacatttaaaatttttatttttccttcctaatcatccattaactattccactatcagtggagagtcatgaggatgctgagaaagtatg

SEQ ID NO: 68162 - DNA, 1138 bp, Homo sapiens
gttttcctttttcaaatccagcttttgctaggaaacttggggtgcaaaagatattaaatgccaaaataacaaaagctcagtttaattagtaagctaagaatatcactaaattaccagattttcttttttcccagtgcagtactattctctaagaaatgaacaaaatatactatgccaaatattttttattaagtgtgaatatgaaaccatacagcaaaacatgaatattaaactaatatttcctctttttaatatatttctttttgaaacagacatttcccccagatctaaacatagtaacctatttgtactgtaatgtaaaatctcctatcatttaatatttgaacagttcatagctgtgaagtttagtaattatttttgtgattcactaaatacatctcctagaaataatgaaagggggggaaatgacaatttatacagttatccaaattctgtgttcttgagttttcaggatactacatagtctgttgcccctgtgtcaaaatcatctgtggattcagttgacatcccaaactttagtttgctttatgttgctgtgggcctttcacacaaaagtagaactcagagttgattgttagtagatgaacatgataaaaaagatattggtaaagagaaggactattttttgcttgttctattatcaggctaaattgttatataacctgtagtctaggttagaatttgtgtaccagtatctcaaggaaggttatatactcttttgaaatggtagaagatctgggcttaggaagggacctttagtcaaaatcacaaaagggaaagtattgtcttatttgtaagagaattttgggaaattgtaagccagtgagtatagtgcaaacactagatttaaaaagacatgggacacttttctttgtagcaaatactgatacattaataacattcttatccaatggattagcatgaatggggactagactggattaagaaagagggttggaggtgtaagggtgaaggtaactgttggttcacaggtaccattataaaaagcatggtatctcaaacctgggcagcacagagaaccacagtttatctatccagttccctttaccagtcccaaacagccaaaacactcactctgagtgcacgtactctacag

SEQ ID NO: 68163 - DNA, 2338 bp, Homo sapiens
ggactacaggcatgcaccaccacgcccagctaatttttgtatttttagtagagtcggggtttcgtcatgttggtcaggctggtcttgaactcctgacctcaagtgatccacccgcctcggcctcccagagtgctgggattacaggcctgaaccactgtgcctggcccataaatcttttttattgtagcataatgtacataacataaagtttaccattttaaccctttttaggtagacaattcagttacattaagtagattgacagtgttacgcaactgtcaccactattcatttcctgaattttttagttatccccaacagaaactatacccactaaacaaatctccatttcttcttcccttcagcctctggtaacctctgttcgactttctgtctctccgaatgtgtctattctaggtacctcatataagagagtaatactgttttttaactgtcttgctttaaaattgttcctaaatttatatttttgaaggatgacagcatggaagagaaaccactaaaagtgaaaggaaaggactcttcagagaagaaacggaaacggaagctagaaaaggtagagcaactttttggagaaggaaaacagaagtccaaggagttaaagaaaatggacaaacctagaaagaagaaattaaaattaggtgcagacaaatcaaaggagctgaataaactggccaagaaactagcaaaagaagaagagagaaagaaaaagaaggagaaggctgctgcagccaaagttgaacttgtgaaagagagcactgaaaagaaaagagagaaaaaggtgctggacatcccctcaaagtatgactggtcaggagcagaggagtctgatgatgagaatgctgtgtgcgcagcacagaactgccaaaggccctgcaaggacaaggtgagttccaactgtttatagtcaagcatgagaggtcaaggagcaacagttgtggagacacatgtttgatatcaatgtgtagtatgtttttggttctaggatttggacttccaacataatgtcttttgtacaatttctataaactgttttgaataatgaggctcttagtgtgcctagtagaagtgttgtatttcaaaaatcatatacttaatgaacataatgagacaggagcagagagaagctatgtgacattccctggcaaacagtgcatttcatatgcagtgggcataacaagtttcagaataatcttgtgccttccctataaggtgactcagagaactaaataccttgtcggatagtcacaatggcctgaaaaaaatcctgggccagtattgtaagagctgtggcaaattgcattaagatggtattccaaagacttgaaacttttagtccatatcttacactcagagctgtgggcaccctcctaaatggaatatgattttcttcaaatcttttgcaacaaataattcaaacctataaatgcattattttaggccaggcaaggtgtggctcacgcctgtaatcccagcactttgggaggccgaggtgggcggatcacctgaggtgaggagttcgagaccagcctagccaacatggtaaaaccccatctctactaaaaatacaaaaaatgagcagggtgtggtggcggacacctgtaatctcagctacttgggaggttgtggcaggggaatcgcttgaacccaggaggcagaggttggagtaagccaggatggctccattgtgctccagcctgggccacaagagcaaaactctgtctcaaaaaaaaaaaaaaaaaagcattgttttaaaatttccaaccctaaattttaagtatagtaattctcttatggccgttctttaaatataatgttgacagtatgaacttctgagagtaatagtcagactttatgaaaaattccagttgtttaaatgattggaggcacctgttacggctcttatcaagaatattgataaatctgtagttttaattttattatgctcattatactatttgatatttagaattctaatagtgcctcagtttgaaaatataaacagtaaataaaactgcatcactgttccctataggttatgccctcactttttcaatgaaatacttaaacctttttagagcttgaaggcaccaacaggttactttgttcaggctgctcattttacagatgatgcaaccaggactcagggaaggtaattatgtgaccaaagttacagagctagttagtagcaaaaccaaaagtagaaccctagatcttggctgtcagaccaggttctctccactaacaccttaccccatcaataattgagatgtaagtacaaaaacacattccaaaactaaatgacacatatttaaatgag

SEQ ID NO: 68164 - DNA, 1002 bp, Homo sapiens
tgttgcccaggctggagtgcaatggcgtgatcttggctcactgcaacctccccctgcctagttcaagagattgtcctaccctcagcctcccgagtagctgggatttataggcatgcgccaccacgcttggctaattttttgtatttttagtagagatggggtttcactatgttggtcaggctggtttcgaactcctgacctcaggtgatccacccgcctcagcctcccaaagtgttgggattacaagggtgagccgccacacccggctggaagaactgttttttattaataaccccaaaccattttttttagagtgggccttggaattgttcatctttttggtctgtatttgtttctaattctgtttacattttcatactgatataatgaatccagatatctgaagttagtattgggggatggggggctagtctcaatatttgctttgaaaacatgttttttccatagttttaattttttttgctttgttttatggtattttttgggaaaggttctagcaccccaaggaaacaacctcggaagagccctttggtgccccgaagtttggaacctccagtgctggagttgtcacctggagctaaggcacaactggaagaacttatgatggttggagatctcctggaagtatctctggacgagactcaacacatatggcggattttgcaggccacacacccaccctctgaagacagattcttgcatatcatggaggtgtggatttaatacttatttaaacagtggttaaaaactagaatgcctaggttccttagaggtatcataaatgttggcaaaggggtggctgagggcagtaatctggctggtctactttcccacttcagccaaagaaattgggctttatggcttgctggcttgcctgcctccctgcctccctccctccttcctccctctttctttctttctctctttctctttctttctctctctttctctttttctttttctttcttttctcctttcctt

SEQ ID NO: 68165 - DNA, 1152 bp, Homo sapiens
cttgccccagggaatgaattacgaggtgataggaaactaatactttaagagtgtttaccttgtgcaaggtaccaggttaggcactttcatatgttatcttatttaatccgtaaaacagcaaaatacggttggtagtattctcatttttcagaaaacggacgttctgaaacttgtaccccatattaacagtctaaaagtacaagagccaggctttgtacccaggttgcttgatttcaaggcatgccatctttgtaccgcaccctacagaagaggccaaagtactgtactgatgtacatgatcaaatatgatagcactttgcccatttcacacttgaggaatgtttgcatggaaaccgccaggggccccacattttaggaaactgtttataactgataacttgggagaaagatcccacagccttgaggatttggtattttggggggtatattgcagtgactcttttcaattaaatgtttgtcttgtacaggtggcagttttcaaagaacgggagcaaaaagagattgaagccatgcattctctcagagcagccaacctagccaagatgacaatggtggaccgcatagaagaagtaaaattttgcatttgccgcaagacagccagtgggtttatgctacagtgtgagctctgcaaagactggttccataacagctgtgttcctcttcctaaatcaagttcccaaaaaaaaggatccagctggcaagctaaagaagtaaaattcctttgccctctttgtatgcggtctcgaaggcccaggctagagactattctgtcactcctggtatcccttcagaagttgcccgtacggttgcctgaaggagaggccctgcagtgtttgacagaacgtgctatgagttggcaagatagagcgcggcaggctctagccacagatgaactatcctctgccctggccaaactatctgtgttgagccagcgtatggtggaacaggcggctcgagaaaaaactgaaaagatcatcagtgcagaactccaaaaagcagctgccaatccagacttacaggcaagtttaggatttacattctttttctatttcatgggatatgtcagtgtataaatagtaaattgagtctgtcttaccaattgattaggaaaataacagtaacttgtcagca

SEQ ID NO: 68166 - DNA, 1084 bp, Homo sapiens
atgtgtttcctctgtaatttcaaagggctgtctctctaccaggtggggtttcaccatgttggccaggctggtctcgagctcctgacctcaggtgatctgcctgcctcagcctcccaaagtgctgagattacaggtgtgagccaccacgcctggcctgctaactgtgtttatatatgtctgtgctttagattgtcctttgaactggttgttatatctactggtactctcaattaataaataaaatcattgatgacatgttcattaaaaaaataatttacacaaactttaaaaaataggacattggaagttatattaattcaagagatggaattacattcaaagaataatatttaataaaagaactaacactaaactttgtaaggtctttcaacagtatattgccaaaccccataagagaactcaaattgtgagaatctactttggtttttcagagtggcagcaattacgcttatttggagcagcttgagagcttgtctgcgaaaggacgccctattcctgtgcgtcttgaagcactgccgcaagtggaatcacaggtagcagcagcacgggcatggagagaacggactgggcggacgtttcttaagaagaattctagccatacattgttacaggtacttgaacttcaacactctcataagcagctgataatttaagtagtaatagtattggtgagggttattttcagtttatctgattaccattatacaagtgattcttactaggtaatatcagatgttgacttgaaatctggaaccttgggcagattcatttccagttaatcttgtgctgtccctagaaaaagcagtcggccttggcttgttattggactctagtcattgaaatcgttttgttctgtttttttgagacagggtcttgccctgtcgcccagactggagtgcagtggtgcagtctcggcccactgcagctgtcgcctcctgggctcaagtgatcctttcacctcatcctcccaagtgtctgggactacaggcatgctacaccatgcctggctaattttttgtatttttggtggagatgggatttcatcatgttgcctgggctggtc

SEQ ID NO: 68167 - DNA, 1092 bp, Homo sapiens
tgttgagtggctgtattagcatcagcaccccattggacttaatgagatttaaataaagtgtttatatctgactgtatgtcagcaaatttggctgataattaacggtggtccttgtgaaagcatttctctagcagctaagattaatatttatataatttctattgtgaggatgaggaaactggggtgcctggagagatcacatagttactgagtgacacaactgaaatttaaagtatcttccacttcatttcaatacctctgtgtacttaactactttgccagccacttactttggatgcattttggtaagaaaatatttaggtgatttaattagcacagctctgagaagcctctgtgtacactggatattttgctatccagatgccatgcagaatacatactaaaatttattcatagcttttcctgttggaactgttcatattactcagtgtcttcagacgaatgacagttccaggaggtgggaacatattaagtggacaaagctaaataactttggaatgtaaaactatgattttgataaacgtggcgcacctggtagtaggccaccaaatgaaatttcgtggtaataatagttaaaaactttgttttcccagtctctgatatttaatcagtcaccaggttctgatgactctgtctccaacatgtctttcatatctctctttcaaattcattgtcactgacctagttgtagtcctcttatattttaccttgatatttgagtttggtaagtattgatggagaacctgctacatgccaggtgctatttctaaatgctatgtagacagtagtgaacaagacactcaaagatctctgctttcatggagctaccgttctagtagagagagagagagaaataaatgaatgaatttcaaataattagtgtcatgaaaaaagtaaaactggtaaagaaatagaggattatgtggttggtggaaatagtgggagttagactcttctaacttctgtcagaattatctttctgaaacacagccttaatcttcttgatctcttagtattggttattaactacttaccattattttcttgagattcttcctttgcctttggcct

SEQ ID NO: 68168 - DNA, 1006 bp, Homo sapiens
ttgagtgctgaatacttccacttaaccctttttggcctgaacttatttaattatttatttttacaatatttttctttttcttgtaagggcaggctcatgttaaactggtctaaaagagtttgctgcctcagttatataccaaagaactccttcttgatatacaataaatagaaaattagcagtttaggccagaaatttagcatctcagattatgggaattttctgtgggaaagcctttgaaactctggctgggtcttacagggttaatatttacagttaatagaatattgcctctttatatttaaatggatttggtattctgtcttctttctaataaaagggaggacctggagggtaagtagtggttctgtgctgggatatgttataagcgagttatttaatttggaaatctcattttcagttgcccattggacgtcaatgtgtaaatcattaccgacgcctaaggcgccactgtgtcttttcacacgaggaactaattttcaagatggcagcagatccagaatgcttagatgtggggctggctgccatggtctgcaaagaattgactctcatgactgaagaagaaacacgattaagagagtctgttgtacagatggtgagtttgctgagcacattttctatgtttgatactgcttatgggatatgctaaataaacctataggtagaattttcatcccttatcccctaggagttgagcataaagatcactgatttggagaagattttatatttttataattgacatattgatttctccagattaaaaacgttttaggaatcttgtcatctctaggtttttaaaacaagtcctatcagaatttcttaggtatatatttacattttaaatcttctacatacagtattgtttaaacaagaaaatttaaatcattttttttttctgagctttctgttgaataagttatgtttctggaaattacagactgtcagtttgaattaatctttttccctcccctttaagtaattt

SEQ ID NO: 68169 - DNA, 1060 bp, Homo sapiens
tttgtttcctttgctaatgagtaaaatgatacaatgaatagtcttacttgctccagtaattttgaacttttttcttattaggctttggaaacagcataatttagcaagaacaagactaggcttaggattttgccttgggcttgagctctgtttctaaacattcaatcagcatttattgagtgtttatgatacatggtaattggctaggtgtagggtagaaaatgggaggatttagataggagctggagatagtttctgctgttcccattctctctgttattggtatttgaccttgggcagcttttaaaatttcattgggcctaagttttttagctggtatgtaaagatgctgatagattcacttaataacctcagacaagttagaggatatgtgtggaagcccttgacactctttagaagaagggtgtgatataaattaaaagttatagcagttttatctgtggaataaattaatgggactaatgtttataagttacaatggataatcacttctattttatgtggcttcctcacatattataatagttaagaactgcaaatcccacagtatgatttttttcttttgcttgtttttgtgttgaggctctgagaaatttttaaagagtacgtatttaagatatgaaagagttgtgtgttgttaatagacaaaataattgctaatcataagatatatatatatacacacacacacacacacacacacacacacactttttcctttggaaagttttttctttgaagagtatggaaacactgcataattcagagatagcctcaaattttctttgctttctctgattcctttctgcctttctcaaactgtagatgaattctaaaaggctcttaaaggtccattttcttattttttctcttttatattacaaatccaaacaaaactcctttatccaagttcttctgcctgagcataggaaagaagttgaagttggagtgcgtatatacgtgtagggcatagctattgttgtaatttggtttgtagcttgataattatggaaattttcaaaatttattttaaagactg

SEQ ID NO: 68170 - DNA, 1086 bp, Homo sapiens
atttctaggtgtgtttgtataatggttaggagtgatggtggtgactttctgcatcctgtcagtcttattgttataatttatccggtatttctaggtgtgtttgtataatggttaggagtgatggtggtgactttctgcatcctgtcagtcttattgttataatttatccggtatttctaggtgtgtttgtataatggttaggagtgatggcggtgactttctgcatcatgtcagtcttcattgttgtcacaagttcaagattatgtatattgtattttgtctttacagtatctagcaccattctatcaatatagtagtaaacattttaggaaattatgctactggctataaaatagaaatagtgatgttgtattaagatgggtctcatactgttttcctgattggctggagaataacaagaattgctcatgtgctttggagtaaaccagaggtatctgaaataaagggaaatctaaatagaacatagacagaaggtaggattaaatgtttagttatatgagttacatgtagtggatagcaaagagcacagattgtatgcactagactattataaatattataaaaaaattttctgggaagactcccttggcatttctattgagcacttttcatttctgatctttcatttacagttttttcttctcttataggaatatgcactttctggttggaatttgaataacatgcctgtcctggaacagtctgttcttgcacatattaatgtggacatctctggtatgaaagtgccgtggctctatgtgggaatgtgcttctcttctttttgctggcacattgaggatcactggagttattccatcaactacttgcactggtatgtacagtctaaaatacagcatgcatgaactctactaaagtctagtggattaatgatgctaggtttttgatctttaaggtttatagacagaagtatatttaaggtttcaataatttctagccttggcctatttctttgggtagtaaaattgaactcagtgaagctatttagaagtatcctagagagcactgacttattttgatcattgtggggataattgaaatgtccat

SEQ ID NO: 68171 - DNA, 1106 bp, Homo sapiens
ttagaagtcttttgcctctttattattggctagttttactattggctagttttacagggttgaaataagcaataatgaaaaaaagtctttgaatttctttagagaaatgagtacctctattacagctgtcccaaacctttttggcaccaaggactggtttcatggaagacagtttatccatggatggatgggggtatggaggatggttttgggatgaaactgttccacctcagatcatcaagcattacttagattctcaaaaggtgctcacaacctaaatccctcacacgcagttcacaatagggtttgtggtaatgcttgcccggttggttgcccactgccgctgctcacctcctgctgtgtggctgggttcctaacaggccgctgatgggtactggtccacatcctggggtttggggacccctgctctgttattcttattcatttcaatcataacttagttcttctgtattttaataatcttaggcaatgaccagagtgagattggatttcttggatcaactagcaaaattttgggaacttcaaggatctactctgaagatccctgtggtagagagaaaaatcctggatctgtatgctttgagcaaggtgaggctcatactggtttagaaattagagcacaggcttgtgaatttaggaatatcaaatagatttggtaggaaacattgcttccaatagaggatttgtttgacaatgaaatgcactagctgggtatggtggcgcatgcctgtaatcccagctactcgggaggttgaggcaggagaattgcttgaacccaggaggcggaggttgtggtgagctgagatcgcgccattgtactacagcctgggcaacaagagcaaaactcggtctcaaaaaaaaaaaggacaatgaaatgcacatttgaataaatggaaatgacagttctcaaagttatctttaaaacttattttatatttgttgagatcaatatttaattactaaatattaatatttatcaggctctgtgatatacaatatgcaaaataaattactctagcctgctaatgttatcttgtgctgagtgtacaatgttctgtgttgagcttgtcatctttttttttgtt

SEQ ID NO: 68172 - DNA, 1062 bp, Homo sapiens
ccagacaaccacaaattgtccacactggtggctgagctactgacacctttcttttctgacggtccagtatacacaagcgttatgcaccagattattaaaaatattgcataaaattaccttagcctatgtataactttatatgaaacaaaagaattttgtatttaggcttggttctttctccaagatatctcattatgtatatgcagatattccaaaatatggaaaaatctgaaatccaaaacacttctggttccaagcatttcagatgagggatactcaacctgtattaaaattattttatcgaaaagaattgctcattctgtctctataataaagaagacttgtaagttagtctattagcaccatgatttgtggcaaaacccccctttaagggaataattaatgcattccttgtttacataccactgtgtttttttaaaaaaatctttctatttaggactggcagcctccatttgcctgtgaagtaaaaagctttcgtttcactccaagagtccagcgcctgaatgaacttgaggtaagtgttttgtcactatttctgcttcctgattcattctttatattagggctgtaggtagagaactttgagaagctcatgtaccacagcctagagtttgtgttaattggtattgaatggaatagttacttgatgtttggaggaagagtatgattttttaaaaactgtgcaaagttgttatggtttttccatttaactgagaaatgttcaatgcttagcttcagagacttagaattcttaaattctactttctctagtgtttcttactctactaaaatttttgttaatcttggaagatttctttctccctcggttcttggaaaatggatttttaaatcctattttaaaaccctagttttcagagtttgttttgttttggtttggttttggttttggttttaatggaactttgccaggagtgttaatctgatttattaagattttaagtattactttttaattactttaagtattattttttaattactttaagtattactaatttatcttaaattttctaaatggaa

SEQ ID NO: 68173 - DNA, 1320 bp, Homo sapiens
ttacgaagcacgggcggtgaggcgcggtgcttaagattaagcccggcgtgttttcgagtgcactgatacacaaaagggaaagggaccctcctcaccggaagcacaacctctgccctctggggcattacacattcctccgcgccggaagaaagcgtcacgtcgcgtcgcgcctcgccccgcctcgttgcgcctcgccccgcctcgccccgtcggcttccctcaatccgtacctctagtaaagaagagcttgtgcccctccccgaccccttaccaagggcgagctgcgtggagtcgttggactgggcagaactttggcgggcaaggagacaaacagccacactgtgctgccggggaagagaagaagaaggaaaggccagacacacaggcgtcgtgcagctgcggaaggattccgtttcctgcagggggcggagggatttgacagcacggtaacttccggaaaagtcctgaacctcagtggaaaagccttgcaagaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcaatggcgggcgtggggccggggggctacgcggcggagttcgtgccaccgccagagtgccccgtctttgagccgagttgggaggagttcacagatccgctcagctttatcggccgcatccggcctttggcggagaaaaccggcatctgcaaaattcggccgcccaaggtacctcagtctgtgaagagagagggggagaaggaagaatgggggagtccgtacactgggtttagctttacttttctgatccttgtctcgtttcatatgtactctcttttgagacaactggagcctgtttctggatgtttttgcctcggtttcttttgtggtcttatgtagacacgtctgaaagcgagaaagtggtgtctcttgggcctcttccgcctagaacttgggaactgatacttttctctcagccgtgggcctaaagcctttcgttagccgatatggtgtttaaagtacagtattatgacgtgacgtattcttccctcacgtatcctcattatggtttgatagtcggctatctctttattcaagacctggttggatcaaatatttgcaggcctcatctcagggctagggtttctgaaaaggttatctgagctctagtctcaccggatggtattactagacaagaactccagactaattattgcc

SEQ ID NO: 68174 - DNA, 1022 bp, Homo sapiens
cgccacgttctgtaaaccatctccatatcaagtcgctctgaaatccctttttatgttgttttttttaattaattaatttttttttttttttttgagacagagtcttgctctgtcgcccaggccagagtgcggtggtgcaatcttggctcactgcaaactccacctcccgggttcaagtgattcttgtgcttcagcctcctgagtagctgggattacaggtgcacgccaccacgcccagataaattttgcatttttagtagagaccaaggtttcaccatgttggccaggctggtctcgaactcctgacctcaggtgatccgcctgcctcagcccaaagtgccgggattacaggcatgaaacaccacacccggcccgaaatccctttttagcgtttgcttccttggcccagtccagacctaagctatcttaggttgagttctctgggaaacagactgtacagtggagatttgcttgcaggaattttattgggaagtgagggaacttaaactgggattcagttgcagcaggcctcgtccaacacgatagggatctctgaagctgggatggctcttcagagatatcctgaactgagcaaggggattggatttttgtgtttcctcattgaccaggcactggatatgggctgtccctgaggaatgagaggcagaaacttgggtgaggcagttcccttgtctggggattcaactacaagctatcagcaggcagcattcctggcagttggcagaatgagcccatcagccccgaagagcaagatctgagcagtaaccctcagcagccactaccattcccttttagaattagctaagaagtggccgggcgcagtggctcccgcctgtaatcccagcactttgggaggccgaggcaggcagatcacgaggtcaggagatcaggaccttcctggctaacacagtgaaaccctgtctctactaaaaatacaaaaattagccgggcatagtggcgggcgcctgtagtcccaggtgctcgggaggctgaggcaggag

SEQ ID NO: 68175 - DNA, 1024 bp, Homo sapiens
cacctggctaatttattgtattgtattttactttgtgtaggaaggggttctcactatgtcactcaggctggttttgaactcctggcttcaagtgattgtcctgctttggcctcccaaagcactgagattacaggcatgagccacaacacctggccttattctgatcgaataggatttactaagaaaatagacacaactattttagtggttgattctaaggaaaatttagtggttgattctgccagaagatgaatatgattatttaggtgacatcctgcagagttcccttatagagattcctatttgaaaagttaagcactatgattatgatgtttccctttgtcttccgaatcccttcattagtgagaaccccttcattacccttacaggtaaatgaatctgaactcctctgcgtgggaaatactgatatttcaatagcacacagaaaagctgagtaaaatcttcttgatggattttgttttctattttagatcctaaaataagcaaaagaagaccatcgagagagagaaaagaaagttctgagcattaccaaagagacatacagacactcatcctacaggtaaagaatgtattttggcagaccaagatggcttttatccacaggtgcagctctatgtcacataccctcagtgtcatgtgataagtatctccttgcacacaggttacatctaagcatcatgtggttaagaaaattgagattgttcctaatttctaagagcttatattttgaaaccatccttttctatttgaacattcttaaggtgctactctgaaccttcaattcaatatactaagccccatccaccaaaaccattacaaggtaagaattcactggcctagggatatgcagagattgcagagggaagcttgtctatgctgatagatcaacatttgatggtatattcatttatttagtgcttaggttccaaagtctaggaaagtaatgaactgttctcttacctcctggttatgtgtcatttggaaccatgatttttcatctagt

SEQ ID NO: 68176 - DNA, 1007 bp, Homo sapiens
ctcagctaattttttttttttttttgtatttttagtagagacggggtttcaccatgttggccaggctggtcttgaactcctgacctcacgatttgcccacctaggcctcccaaagtgctgggattacaggcgtgaaccactgtgcccggccaggagtacaataaatatttgttgaatgaatgaatgaatgaatcaacaagtctaatattttgaatccccaaatactacaacgatcagctgctctttgaaacctagttcttgaggcagctgctaccagagcttcctggactgaatggatcttacattacaaattgtaggttctttggaattccttcaactctcccagaaaaataaacaacttcgttacgacataaggacattaccttaatatattcactttgagcatggtgactctcatgcataacgggcaacacttttccaattttatcttctttcttcttacactgcaccctatattgcttaatctttgacatcaaattatctttttcaagcatccatgacttctctttattttggttttcagatctgagttgcagaaaatctttggtgctctcatagagcagttcttgggtgtggtgaagactaggaaagaaagtataaatgcagacatgaggatgcgcacacagcacacctgaaagcaaggattattccaaaatggaagagagtggttcttttaaaatggtgtgatatataaattttgtaaaatattagcaggtttaaaaatctgatcactggcaatcttacatgttttactgggtaaagtataatgtatctacccatgctcactggttcatagactggtctttacaggtactttcctgagtgcgaacttcagattatatgattagaaggactacagggatatttacacatagcctgcgttaactatggaccattcctaggaataagacaaggaagaactaaatcacggtgttctgacaagttaatacaaattctatagtatcaaaaacagctttgcttttgtg

SEQ ID NO: 68177 - DNA, 1095 bp, Homo sapiens
tgcccggggcgggggcgggggcggggccgggggcgggccaggttccgcgagcaggagagcccagagcccggagcccggtccggggctggcgggggcgcgggcggaggcaggcgggcgggcgccggggaagcctccttctgggcagcgagtgagggcgggcgcgcagggagggagggcggcagcgagcctgcgacgggagaggcgtggggaggagagcccggcgcggaacacacgcgcggaggaggagccgggctcggctcccggagagacctgctgggcgcccgcgcagcccggagacccctcgcgcccggagcatgagcccgagccccgccggagagcggccgggagagacggcctcggcgcagccctgagacgctgggccgggacgcggggcgccctgggcgcggggcccggccggggggcggcggctcggggggttggagcccgcgctggcggcggccgcctcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggagtaagtagcacccaggggaggcgaagggcgcgggggtgggcggcggcggcggctcctgcgttggggggacccgcctctcatcccatcctcagacccgatttcccacccatttctccctcaggtgcccggcgtcgccccgcgcgtactcggggagagctgcgggcgggggaagccgcggggccgagcgcagaattcccgagcccgggcctgcccgccggccacgtgggtccggggcaccctgggggctcctcgcgtctcccctcggagagcgacccggagagaggctccccgcccgtcccgccgagacgctggcggagaccgggcccctccagccgctccgggcttgcggttcccggggaggaggtccgtggggtccacgcgcgagctagggattcgggtgcgggatgccctcggccgtccacacccaggcgcgcgctccagtccgcgca

SEQ ID NO: 68178 - DNA, 1043 bp, Homo sapiens
tggaccgggcagcaggtagattcctacttctgtttttaacttagccaaagccacttaatatttccgtgcctcagtttcctcctaggaaaacaggagagcgtggtctctttgcctttttacatcaataggtatggctgtgcgaggtggttttcaacgtactgtggatgggcctaacaaagtaaaactgacagtgacaggggccgtaaaagatcctgtaatagttgggaaaagaaatggagaaactcccgttactaccaggtgcccaacgcaagcccggggagccgaggttcaaagttctggcacgtggcctcccatgccttcactttcctcccgctttggggaaactcggacagagtggctgagcaagcagctgagaagatactctgactctgacctgtcgtcgtgtcagcttctctacccagagttgggtgtggtgctgtgccttctcttgtggccaaagagagagaattactagggacagtcgctgagctggttcaggttggaaatgtatatttatggcctaacctttctgtggtgatggaaatcattccggctgtgagttagaggagactggctctgccactaactagcgggggaatcaagggaaaaacgacagcttctcaggtgaaaatgaggcctttggtccaaatgatctccaaggtgtctttcagtctggatacgaagactgatctgcacgcaagcgtttccagggccagagagctcagcacatcaccaggaagccatagcttccaccccggggccacgactccaagcagcagagccccttcctctgatgaccaaaatctgccgcccatagtgaattcttccctcctctgggccttgttcttccttctgaaagacagagagtgaatctattctcccccgccatggccactcaggcccaaatggatgagctcctttggagtgtgtgtgggtgggggcctgggaggcgacacctcctcccagtgtagccatcattttgtttagccagtgggatcttgtgcacaaattaaaaacagagagaaaggcagttgctttgtgac

SEQ ID NO: 68179 - DNA, 1078 bp, Homo sapiens
aaaagattaaaaaaatacccaggcatggtggcgcacacctgtaatcccagatactggggaggctgaggcaggagaattgcttaactcaggaggcagaggttgcagtgagctgagattgcaccactgtactccagcctgagtgacagagcgagactctacttaaaaaaaaaaaatggtttctagagatgaaatatctcagagccaagggatgacatttgggcgcaaatccaagacagaaggatggcatgtgctggctccttttagatctcccatttaagtgccaggattacttgctggatcccaaagtattctgaagctcaggaagccgttggctttcgctgccttacctctatctgtaccacatctctctggttggcctttgtgacttctggctgactcgagtgggctgagggaggcacacccgcggtgtgaggcagtgactgcagctctggccaccacagccgttctgatttggaaaggatacaaaccctccagtgagagaggtaatgcagggcacagcagtaatctgagatgcaggcagggagagagggagaagcaaatgagacagatgtgtgggcagaggagggatagtgtggcatggagttgaaacccagtgaagcagcaagcacaaccgcctcgtgtgctcctgtgggcagggactgtgtctcatgcagctctggtgggtgtgtgcctctctgtcccagggaacctccttttcacgtggtttacctctcgtgtagctccttttcacgtgtccggtttatcgctctttatgctgatattccagtcaccaggctactatgtgtgtcttctaatcaactttcaattctgggcacatactaggcgctcagataagtaccttctcgttatgaatgtgtcagctctgaatttccaagcacctgatattttccactggcagatactgtgtttatcagggactgatccaagaatagaacctaggaattcttgttccctgtaccataatacatatacacaacaatagcctttgaatacaaatacagaagataagcgataagacatcaatggtttttttttttttaatcataagcgtattttc

SEQ ID NO: 68180 - DNA, 1067 bp, Homo sapiens
gcaacatagcaagacccccatctctaccaaacaataaaataaaataaagaaaaattagctgggcatggtggtgtgcacctgtaatgctagttattaatacttgggaggctgaggcaggtggatcgcttgagcataggagttggaggctgtagtgagctgtgatcacgccactgcaccccagcctgggtgacagagcaaggccctgcctcataaataaataaatgcttatctgagcgcctagtatgtgcccagaattgaatgttgatttgaagatacatgcagtagatgttaggcgccattgtttattataacttaatcagcttttcaataccctctgtccctgttttgattggttttagcatgctgactttcacatatcaaagaatcctaggacagggtggaccccaggggtgcagacatggaagaaaaccaaaagcaaagcagaagtccagagattttaaattctgaaatggattatatctgcatttcttcttctaggcccatggcagacatctccaatagaacatgaaattcttttaccgagctcagctgcagcctcagaattttctcaacatttctcaccaggcagtcactacaaattgacttgagctgccccttaaaaaggttatctatttacccagcctcctgattttaccagtgaagaattgaaagcctggagagctttaatcaacctgcccatatagcagtttataggactcctggtgcctagactattgtttacaacacaccatgccactcaccctctgccttcgctcattccctttttgtttgctgaggatgcctccttttaacatctgagtttcacgaggtcagggaagatcctttctttttctaactgccctaacaatctggtagtatattgtgcctgcatatagaccaacctcaagtctattgatctatttttttcttaccagtgaactagctgaagttattgccactcagttgggggtggatcatgcatgttcccaactcagctgcctttaggggtgatccatgcactgacaccctgcattgacattgatattggagagtaacctgcaaagaag

SEQ ID NO: 68181 - DNA, 1165 bp, Homo sapiens
ataggccctgttttgcccatttgccctacttttcaagagaaacaagaaattgagggttttatgtgaaatttcccaagttttaaatgttggctcaaatttttctaaaatacagtgagctaaagtcaggaggcagctgttttatttttcttgttttcagcaccagcatttcccagccctgcctccctgggctgctcttgccgaggcttgctggccattctcttgttgctctcttgttcgatagcacagcatcctctaacgttaggattttgcaacttctaacttaaggctttcacctccagcagatgcacaaacttttaggagaagcagcttttttttttacgtttaatttttttaagagttggggtcttgctctgtcacccaggctggagtacagtggagcaatcataccgcactgcagccccaaactcctgggctcaagcgatcctcccgccttggcctcccaaagtgttgagattacaggcatgagccacgcccagccagaagcaactctttaaaatcttatctttcacttatcaacctggataaaggttctgaaagcaagtttcaacaggaggttcatgggaggatcacatctaaggttctgatgccttaaattgtggttgtggcttggtttctctaatggctttctgctgagcctagtcctgcatgtaacagggctccagtggcaggtggtgggagccaggataactgagctgggcagaatgatgcagtgggcagaaccttggctttctagtatggacattcggctggtacacaccttccggtcattccacttatgctgaaatactgaaatatttctgtattgggaggtaaatagctactgccctgaatcccgtgggtgccccaacccgggacccaccaggccttcatactatccagcaatgaatggggtcatgcctggctacagtgtgtctctaggaccgtgcttcaaggccagggctggcatccattctcagtgctcaatgcccgtattatggtgctgtaagcattttgaactcacccctggataaatctgaatttgaatcctggctccactgcttttttttttttttttttttgacacagggtctcactttgtcacccaggctggagtgcagtggcaagatcttggctcactacaacccccacctcccaggttcaagcg

SEQ ID NO: 68182 - DNA, 1003 bp, Homo sapiens
gtgacatgacccactgggtcccaaaagtcggtggtgcccagttggccactcaactagggagattgttaaatacagatgcccctacatttagaatgagaaattctaattcaggaggtctgggtagagtccaggaatcattgtttttaccaagtgccctgtgatgatcctgattaagagctgaatctgggaaccatgctgttctcttgtcggtcatctctgcctgtgtttcttcacacagaaccggtgcaggcggtactgtacttacggcaggtgctcagtccaccagggtgacttgatggattcacgtgaatccatgagtgggcctgggccagctgaggcagggccttcccctcgccctttattgctgcctctgtcacagacttcattccgtctcctaggtgggatctaggcctctcctaaggctgagagcacaggacaggggagaacaagcctgagcctcttgctgggcttcaggataaaccagacacacagaatgaggattgagttgccttcccaggaggtggagatctgagctaggcagattaacttgtttatgagggtgttctccattgcattccccccgggcatggacccagttggctgaccttgtgtggaccacctgttgacagggcttcctgtgtcccagcgtcctgcagccctcggcatcaggtgctctgacttggagcaactgtcgtagttaagcgcctcttctgcctggcagctgcgctcattgcctcctaattatacgctctggggcctcccttgaaggtaaaatattatatcacagctttaggggtctgcttccagtgttgcattggttccaaatgatgaggacaggcaagaggtgtagggacacagggctgagagacatgttaagagacggatacaaagggattggaaagagaaaggagaaacaggcgggtgaaagatgaaatgttaagagaaagactgaggaagagggaggccaagaaagacatgaagcaagggaagttaaaatctggaa

SEQ ID NO: 68183 - DNA, 1021 bp, Homo sapiens
aaggacaggttacaacaacctcagtttgactttggcaagttataatcatcagacctcgcagatctagcagctggcagccctccagatcagataatgtaccttatttgttttcaagcttgatgcagaaaagagaaagggcttaataagatccttaaaagagtgtgtttttccaaaaggagccgtcaggtggggagagggcagggtggccgtggctcctggctgctggtcccaaacccagtccctgtgtgggcctggaaaacttttttggcctcagggccatacctctttctgctttccttggattccattgcttttgcattcaacaaacaaaagggtctgtgtgagatacttgttaagacatgttaaaaaaaaaaaaaaagaaaaaagaaaagaaaacaaacgagttaaatctcagctccattatctagatgttgtagttcttgggcagatatgcactctccttaccagtcaggacctcagttttctcatctgtaaaatgggaataataatacctaccgtaaggattgttaggaagattaaatgagaccatttatgtcaagtgcttagcgtgatgactggcctgcgcaaacgcacattcgttagctgttgtgtttgtcctctgttaaatgcatgtggtgggttaaacttgttgtgttaaacctgccactatcttctgttgaacttgttggtgggttaagtgggttaatgtacagaggagggctttgtaaacagtgttgtttcccacccaggtcccttttgacatcttactgtagtcagcgtacaagtctagcctcttcataaataacacaattttatttatttatttatttatttatttatttattgttgttgagacggagtctcgctctgtcgcccgggctggagtgcagtggtgtgatctcggctcactgcaatctccacctcctgggttcaagcagttctcctgcctcagcctcccgaatagctgggattacaggtaagcaccaccacaccccactaatttttgtatttttagcagaga

SEQ ID NO: 68184 - DNA, 1676 bp, Homo sapiens
gctcatccccctggagctgaggatctggggcgggcatggggtgctcacgctcactcaccactggcgtctccgccctgcagttccggggccgtgccaacctgcatgtgtttgaagactggtgtggcagctctatccagcagctcaggaggaacctgcatttcccactgtacccccatgtgagtgcctgagggctgccttgcccacctccctccacacctgcctcctctgcccacttctgtctctcatctttccttacatcttttctggtccatattttctcctttatctcttgagctctctttttgtctgcccataatagttcccttgtttccttcctagggatcctttcaatttcatcccctgcatcatttcagtttcaggctctctggctcacaatatagtgtacccagggccaccatgtacagttgtgctggttgtgcactgtacaaggtctcctggacaaagaggcaaatgggaactgaaattgagcctgcactccactcacaaagccacagccctggtccctcctgtcatagtcccctcctggtcttcccgccaatcctggcgggaagtttccttttccctcttctgggtaactgtttccttcccctttcttggcatagattcgcacaaccctgaggaagcttgctgtgtcccccaaatggaccaactatggcctccgcatctttggctacctgcacccctttactgatggtgaggccagccccaaaaccccatccttcttcctgctctagagttctgcatcggacccaaagaacataagataaggttataggtagactggactaacttcctgttagtccaccctcaggaagagaggggaaattgagtcatattgcggtcttgtccaactcccacaggctgctgctttgctccctggtttgcagcctggaaccagctcatctctccatataagtcttctccatcttcacactgtctcccaggatgtagaaacccccactttacagagagggaagccacagcatcaagcactgaagggaatttaatcgctaagacactcacaaaagcctccagcttttatgctgatgccctccttgccctcatctggaaactctccccgctgcccagggaaaatccagtttgccattgctgcagatgacaacgcggagttctggctgagcctcgatgaccaggtctcaggcctccagctgctggccagtgtgggcaaggtaaggccagctcaaccccggtccctcccatctgctcctggagcctgttcattgagtcctccagcagctgctcattactgttagcatctctggtgtgacagcggggaagaaggggtggaaaagaagtctcctccctcacccctacccctctacaaagggataaactgaggatggggaggagtgaggagtggggaggagcgaggtgtggggaggagcgaggtgtggggaggagtgaggaatggggaggagcgaggtgtggggaggagcgaggagtggggaggagtgaggagtggggaggtgagaggagtggggaggtaagaggaatggggaggagcgaggagtggggaggagcgaggagtggggaggtgaggagtggggaggagcgaggagtggggaggtgagaggagtggggaggtgcgaggagtggggaggtgaggagtggggaggtgcgaggagtggggaggt

SEQ ID NO: 68185 - DNA, 1185 bp, Homo sapiens
agctccgcagagcagctggtgcgtggtccctggggcaagtcggccggcggaatcccacctccacccctcatcactctggcagactacccaagccttctgtgcctctgtgttctcctctacgaacaaggattacatgaggtcacatattgaaagcatttagaacagtgtctgccacagtctctgagctctaacggcttctgttactgttctttgggttcttccgatcatcctgtggaggaggtactctgattatgcccatctcaccaagagaaaacagctcacactgttagcaagtgatagagtgggggctcgaacctaggcagttaactcctggcattctaagagcaaggagaagggatgagggagtgtaaggtgctggaagggggtgggacagagccgcgaccccagggcccatggagatggcgctctgcttccctgccctctctcccgccagcctgtcagcctcccacaggtactacttcgaggtgctgcacaagcagaatgaggagggcaccgaccacgtggaagttgcagtgagtttcctgctgctcccgcctctcccagctcagttcctggcactcatctccccttgtcccttgacccctgttggaaatccagctacctcccaccttctgcatctaccctctctctcctcttccagtggcgacggaacgaccctggagccaagttcaccatcattgactccctctccctgtccctcttcacaagtgagtaggctctggccctgccctggagatggaggccaggtggggacagcctaccctgggggatttggcaggggaggaggggaggaggggaggaaggaagctcgagatgcttgggacacgggtatgaaggggtccagaacaagagtgggaccttatgaccaggagtccttaactccccagggtcagtgacccctttgagaacctgctagaagctctctgagcccttgcctcagaaaaatgcccttgtctacccacccacacacaacattttgaatacaacttcaagggagtccagagactgtgagctcacaccagatctaaaaactctgaggctgggtgcggtggctcatacctgtaatcccagcactttgggaggccgaggtaggaggattgcttgagcccaggagttcgagaccagcccaggccacatagcgacacctcatctctacaaaaaatt

SEQ ID NO: 68186 - DNA, 1045 bp, Homo sapiens
gcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggtaaggtaaagggctctcctggggccagggactggggcacgtggcagccagctggcctggaaggcaggggcctaagggctggtagtgggttcccccagccgcggaaatagctggaactttgcccccgactcaggctcctgggaaggacaagtgcccggggcccctgtccctggagaggatcttgaccaggcaggtgtttgtcccgccattaggcaaggttctgaaatccctgggtgcctggcccagtacgtgtgttgaggactggaaggactcagtagatgaggtcccctcctccgaggaaagagctagtaaatagacaaacaggcaaaacagaggctagaaaaatacaaattaagaccctgcatgtgggctggaagggttagggcgtgatgcatgactggagttcttt

SEQ ID NO: 68187 - DNA, 1233 bp, Homo sapiens
gaactacaggtgcccaccaccacacctggctaattttttatatttttagtagagacagggtttcaccatattagccaggctggtcttgatctcctgaccttgtgatccacctgccttggcctcccaaaatgctgggattacaggtgtgagccactgcacctggcattgtgttttgttttaaatagccatcctggtgagtgtgaaatggtatcacactgtggttttgatttttatttctctagtgactaatgattttgagccaaccaattgacatctgtcttataactcattttgtcttatggaatgttgattcgaccgtttttattgagggtcagtttctcagggaacctcttcagtgtgacccctcttattcagctcatgtacttagaatcttggagctgtaaaagaccttcaggatcatcacagctcaacaggtacattttcaaagagggaggcagcgaaccctagagagattgcgaatcttgcctgaggccctatagccagccagtggcaaagctaggacaaaaaccagggtctcccaacaactagctttgcaggcttctcacacaccgtgctaccctcccagtgtggaaaggaaccactcagcctccccacactttctgccataggaggtaccagctacagcgcattgtgaacgtggaaaagcgtcaggaccagctacgtgggggtcgctacctcctggagcttgaactgttggaacaaggccagcgcgtggtgcggctctcggagtatgtgtctgcacgaggctggcagggcatcgatccagctggtggggaggaggtcgaggcccggaacctgcaaggcctggtctgggacccacacaaccgtaggagacaggtcctgaatacccgggcccaagagcccaagctgtgctggcctcagggtttctcctggagtcaccgagccgtggtccacttcgtcgtgcctggtgagcctcaagctgagcctcggcattctcaggggcggggtcctcacactgtcaggagcacccacatctgcttgcactgatttgatcccataagcacttctgagaaagaccaccttatagttgaggaaactgaggctcacaaaaggaaagtcactggtttaaggttatgtggctagtaaatgttgccgctaaaaacaaacactgcctcataggccagtgctctttctttcgtactaggtttcaggattgggtgtgataactggggttgctaacactggggatga

SEQ ID NO: 68188 - DNA, 2646 bp, Homo sapiens
ttttatatgagaaggaggaacacacaacaggcagaagtgtaacaacagaggtaggatgatggggataggacgacgatactaagagggacagataacagggtttcactagtagagcgtggcagggctactgacaatgagccccagccaaggccttctcgtgggtcccctgcctgggaggagggaacgtggggagcaggatgcagaggcccccttaactggtgagcactccctctgcctcatgtctctgtgctgcactgctaatggttttgcagagttgcactgtcccctcagccgaggtccgatgggcactcctgactcacctgggagctgggggtggaggcgctcatccgctcatctttgccttgtctgtgtttccttctcctgcctgaccccctggggtagtgaagaaccaggcacgctgggtacagcaattcatcaaagacatggaaaacctgttccaggtcaccggtgacccacacttcaacatcgtcatcactgactatagcagtgaggacatggatgttgagatggcactgaagaggtccaagctgcggaggtgagggggaccaccagccagggggtggcatgggccacgtccatcctaaagtcctagggctgctgggtccagggtagagccaggagtcctgcccagccttcctgattcctagtctccaacttttcccagagggctcacctgcccataatcccatcccaggagcacacatcatctctcttctatgcctgccaacttcctccaggggaccaccgcagctgagtcctgatacgcagccctctctccccttcctgcagctaccagtacgtgaagctaagtggaaactttgaacgctcagctggacttcaggctggcatagacctcgtgaaggtaaagggcctggatggggcctgcgagatggaattcaaggctggttaagaggtagagagacatttggggtaaatgaggtggtgagcccctcagggaggacgggaatgaggacacaggaggtcctctctgctgtgctgcaggccagtgctagggtgggaccagcaaatcacagtggagcatttgcccagttgtccagggtccttggagcctataaagagtggggaggagtcagaattcactctgatggttaagacctgtgctccaatgttcagcactgtggaactctgcccagcagctggttttgtgggagtttgtgaatcactccaatagggaagactccgaggcttctcctagacggcgacctgacctcctagctctggtctgcagggtctgctgaccctgcccacatctgtccccaggacccgcacagcatcatcttcctctgtgacctccacatccacttcccagctggagtcatcgatgccattcggaagcactgtgtggagggaaagatggcctttgcccccatggtgatgaggctgcattgtggggccaccccccagtggcctgagggtgagccctgctcagactggggagggaggaaagacttctctgatcttggctcttaactccagagctgggaacagtcatatctatgagcgtcagcatcctcctcccctgccccaccctgccctcctgtggccttcactccccggaaaactcaccagacaaggtccccttgggctgagctgacagccacagcagcaggtgcagcagtgcacacctcctgcgccgtcttctccttgattcattcatcacacacttactaagcactgctgtgtgccagatgctctgccctgtggggattcaaagatgggaaaggtagcctccctgcctgtggaaagggaaacggacatgtaaactgacacacagctgtgtcttctgtggctgccgctgtccgatccatttgtagggttgttatcagcccatgggcacagcctggtagcactgctgagccctgaaccttagttaggggtctttcctccaaaacaggcaaagtacttgttcagctaagacagttttcagcctccctcaaccccagcctctgactttcagaagagcctctaggcacacagcctggaagcctccttccttcctcctcctggcctctggctcatctcacccgaagctcctgtctgtccacaggctactgggaggtgaatgggttcgggctgcttggcatctacaagtctgacctggacaggattgggggcatgaacaccaaggagttccgagaccgctggggcggggaagactgggagctgctggacaggtgactgggaagaggagggcatccacgaggcctgggaattccatggcgctccaggcagggagccaggctacagcagcctagctgtccccctcggccgcagagtcccaaagcacagtaaagagcactggactcggaggacgccctcaaatcaccggcctcgctgggactcagtttctctattagaggggtgtgactcgccctctgtctgtgtcacagggttggtgtgaaaattaacatgcctggtacaccgtgtaccaggtacaccaagctgtgtagacataaaccatgatgttctcagcaccaagcagggcaccgtgggagagactgcatcctccccagcccgagggtagtgcgcctcccgtcagctgccgagcggggagcccagagttgtgggaatggataagtagacctggcaaaggtcaggaaagac

SEQ ID NO: 68189 - DNA, 1048 bp, Homo sapiens
ttgccccaaatctcactcacttaagcgttagaggcttgaaaactaggtctattggtgttttttcccgttgagggaagaaagaaaaggaaggtgacacactaagagaattcgagtgaaaagggggaaggtaaaggaacgtagataactgggagctcataaaaagggtctgagatcaaaggagcccccagggcagctggaagccttgatttgggaagccgggtccagcagtcacctccaccttgatctctgtgctgggcttttgctgccatgcacggctcctgtacagccctgaacctcctgcctcctcggaggctcaggcatccagttcggccactctcagccctgccagaagtgcagcctccctgtgagagggacaccctgcaggctgcacatgcacaaaaggcctggggagggcctaggcgccaggtgtctcagtgcagcagccctgccttcctccgtctatgacgtgtgccctggaggctgggcgccagttatggggcactcagagtgtgccaggagccgtgctgagccctcagcatccatccttctcgtcttccccacctctgatgtgtatatagtatgtctactctaatattagatagatagaattctatatcacacattatcctctcattacacgtatgtgataatcgtcctcctagagatgagcagacaggctctgaaagaaggcgtgacatacccagtcatgcagctgggatccaaacccaggctgcctggcttcaaagcccacagccgtccactgcacctgccttccctgccccgtggggagcgaacagagggtctgtggtcgatggggaggggccccccagctgccttctgtgcttctgttggctcatctgtgtttctcctcctccaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggcc

SEQ ID NO: 68190 - DNA, 1062 bp, Homo sapiens
tatttttagtagagatggggtttcaccatgttggccaggatggtcttgatctcttgatctcccatctcccgtctcggcctcccaaagtgctgggattacagttgtgaaccactgtgcccaggctctctctcttttcttttctgttttctttttttcttttctttttcttttctttctttctttttttttctttttctttcttttctttttgacagggtcttaccctgtcacctagggtggagtgcagtggtgcaatcacagctcactacagcctcaaactctcaggatcaagcaattctcccatttcagcctcccaagtagctgggactacaagtgtgtgccatcatgcctggctaattttttttttaaatttttttatagagatggcatctctctatgttgcccaggctggtcttgaacttctgggctcaagcaatcctcctgcctcagcctcctaaagtgctgggattacaggtgtgaatcaccatgcctggttgtacactactctttcttacttgtctctccttctagtttgtcttcactgccacaggggaacctcttctagtagctgctatttcttcaagaaggacgtgaagctagagactcaggagtgcttgtttgttaggttggaattaggagccacatccaggagaggctgagtaagtccttcatctcatccagtggtagccaaacttttcaagcctgagtacctctttaagacttcaaaaccttagctgggagcagtggttcatgcctgtaatcccagcactctgggaggccgaggtgggtggatcacctgaggtcaggagtttaagaccagcctggccaacatggcaaaaccccgtctctactaaaaatacaaaaattagccaggcattgtggcgcacacctgtaatcccagctactccggaggctgaggcaggagaattactccaacccaggaggcagaggttgcagtgagccaagattgcgccactgcactccagcctgggtgacagagtaagactctgtctcaaaaacaaacaaacaaacaaacaaacaaacttcaaaaccacttttgga

SEQ ID NO: 68191 - DNA, 1781 bp, Homo sapiens
cggcccctcccactcctctgccccggggccgccaccgcccgggcgtcggacctggtcccgtgctcgcggtgccgccgccctctgggcctagcccgcccagctcggcgagcggcggcagtgggagccgcgtccgccgcatccgcctcgactcggtgccggcccctggccctcccctcatgactgcggcgcctctgctgccaccgcccgcccggccgccgctcgccgcaggatggatgcggaccgtgcggcgctaacccccgtggctcagctcccgaatcgcccgccttcgagccctcctcgtgagccgcagcagcctcggtgccagcccccgccgcagctgggcccagcggtccgcctgtccctcgttgcggcttgtcggtgctgagtgaggcgtcgtccgggtcggcgcgaacccgcccggccgcggttccctgcagacctctgcgcgggcggctcggcccttcacgcccttttcgttcacgaatccgagcccgctcgcctctctccagcgaaccgaccatgtctggcggcgccgcagagaagcagagcagcactcccggttccctgttcctctcgccgccggctcctgcccccaagaatggctccagctccgattcctccgtgggggagaaactgggagccgcggccgccgacgctgtgaccggcaggaccgaggagtacaggcgccgccgccacactatggacaaggacagccgtggggcggccgcgaccactaccaccactgagcaccgcttcttccgccggagcgtcatctgtgactccaatgccactgcactggagcttcccggccttcctctttccctgccccagcccagcatccccgcggctgtcccgcagagtgctccaccggagccccaccgggaagagaccgtgaccgccaccgccacttcccaggtagcccagcagcctccagccgctgccgcccctggggaacaggccgtcgcgggccctgccccctcgactgtccccagcagtaccagcaaagaccgcccagtgtcccagcctagccttgtggggagcaaagaggagccgccgccggcgagaagtggcagcggcggcggcagcgccaaggagccacaggaggaacggagccagcagcaggatgatatcgaagagctggagaccaaggccgtgggaatgtctaacgatggccgctttctcaagtttgacatcgaaatcggcagaggctcctttaagacggtctacaaaggtctggacactgaaaccaccgtggaagtcgcctggtgtgaactgcaggtaaagccccacctactttatttgacggtcctttggatcccaaatttggctcggcgaagccagttgatcgagttcacccttcacttggcattctctgttggactccgagtgggacggggaggccaacttttgaaaggggctgaaattaggagaatgtggagcatgtgcctaggtgttgggataggataagaattattggtagccagagggatttgctaccgggcagcggtggtgaaggtcatcttagtacaaacgaattgtctcctggtttagagtctggcaggaaacttggaatgagtggggaagttgaaagtacagatgcttcttcttctgtgcatttcaatctcatcaaaggctctgcagtgatgagctgcgtctgggtgtagaagcgtgttttcattcctgagatcaggctgttctttttaaatgagaacaaccttgtacctttggatgtattttgcttgatggttgcacaggcatttagtataaaataattattaaaa

SEQ ID NO: 68192 - DNA, 1045 bp, Homo sapiens
ttgcatgcactactgagcataatgggaaaagaaaagtgctataaaaacctaagtaccaagtaactagctagaaaaagcttttaatgggagagctggcatggtcattaatctggtagaatagtatttgaggaaacagttgcatgtgttaagctgcagtttcttttggttattgaaaaccaaataggaaattctgaattaatacttacatgctgaagtatctttgtggagcttattttgagcgttagagtgggagacttagttctaatgcaaactatagaagaatgaccttgggtaagtttgttgtctaattagtaaactgagtggtagagttggataatcctgtcagctttaggcccatgccttaaatatgcttcttatcctctcacagtcaaaaaggatttttaccttggtacagtctgattcctgcaacacctctctagttattgaatgtatagtagtttgctatagacagactactttgcagtggctatcaaacctttctgagactcattctaagaaatacatttacattgtgacttagtatatgcacacataaaaagaagaaagtttcacaaaatagtttccttactagcaatgagctgttttttgttttatttcgttaacaacaacaacaacaacaacaaaaactgctaaccatctttttcttggggttgcactactgtccaatgagcacatagtgagggcagtactgctaacgcctacataacatgcctgcatcatctagagctttgctttaccttggtacaatttttggaagaatgaaaaactgcttttccacagggggaaaatactgtttactgcccatctttgaaaaacattttacttagagcataaacttgaagctagatccttttaaccacttaattaaatcatacagtaagttgttgatagctatttgccacaaaatgaaaatatagtggctatatgaattttagctgctgtcactgttcattaatcataacataagctctgaacacagtgtttcttcttagaaaggtacaaatgattatgattttgtataaca

SEQ ID NO: 68193 - DNA, 1064 bp, Homo sapiens
tttgtacttttagtagatgtggggtttcaccatgttggccagcctggtctagaactcctgacctcgtgatccgcccacctcagcctcccaaagtgctgggattacaggtatgagtcaccacgcccggctgatactgttattcttgtaacaaaaaagcttacaatgaggaatacatttatattgttttgcttaagattaaagccatataaaaaatttacagcagaacctggaagttctttcttgaccctaacctcctttactcctttgcccagaggcaaccatatatttgtatgtatttccaattcttcatgcttttacacaaatatgtactcacattaaaaaaaatatatataaacatattattctatgactttttttttctttaattcatagagttcttaatcaggtctagtgaactcaggacaagagacacaacttggatataaatacctttaagcctctgttttcttcatgtgtaaaatgagggtaatgttttagtgttattacaaggtttaaatgagactacatgtggacaccttagcctggtaactaagtcacggtagctgctattattaataaacaaggctaacatgcttctatatgatcctcctgtacctaagaaataaacttatagcaatagagcacaatcagccagccatttaattttagagaataacatcttcatgtggcctagtaaaaatgactgttaccaaataataggctttttatgatgaatgaatgagtcagatgttttctctgtagtttttagaatcattgagataccaaattcttagctgttttatggaagaactttataaagtagagtttactgaagttgggtgactagaaaagcctataaagttaaaaaggagaaaacgtgttggttctcctaattaatgtaaattaaaacaaggagactgcccacaagagctaaatagtaaatttcggtcaaaaataatgatagtatttcttttttcaattggtagtaaaacattggaaataattattccaaatgaaaagacaggttgataacagttttcaaaaggatcaggataatagagatt

SEQ ID NO: 68194 - DNA, 1014 bp, Homo sapiens
gccaggtgtggtggcacacgcctgtaatcccagctattcaggaggctgaggcagaattgcctgaacccgggaggtggaggttgcagtgagcagagattgtgtcactgcactccagcctgtgcgacagagcaagactccgtctcaaaaaaaaaaaaggtgaaatagatgcccatgtcttgctaagtcagtgtggtgcagaaaatgataaggagggagtattccaatattgacctaaaatattttaatcaagaattccagacacttttctccacccatattttgatatgtagagttatcatgtgtggtcttaatttagcagtaaaattttgaatattgcacatatataatactagagaaatttaaatgttaataagacttgaggaccagataattttggggatacagttgttagctgtaaagtaaaaatttcaagtttaatgaatgaaaactagtctcactgctccattagcacaattggtttggaaggtttgcttctgggcgaataaagtgaacaatagcaaaggatgggattgctactttaaaaatactaaaatatgagggtaaagagagatgtctgtcagaggatgtttaaaatgaaacagcttcttaaaagcaagggacggaagatgtgcaaatggttatgaggtcattgtactaaacattagcattgtgcttctcactccagaagaaattacatcagtggataatctactgagcactgtaatttgggtagtactgagatgagcaattgttttagttgttgcctgacccccaccccacccccagcagcctggaactgtgcatgttatgaagaggtcatgtgacacggatccttggttttgctcatttatcctgtcaaaacaacttaatgtagatggaaagaaatgaacgaaatgaatagaatgggttagctgtatcagctttagtttatattgaaggtaatgaatgctgcaattgggatagtatagtatattaaggccccaggaatatccagctccataatggtgaagagaa

SEQ ID NO: 68195 - DNA, 1160 bp, Homo sapiens
gggaggatcccttgagcccaggatttgaggctgcagtgagctatgatagcaccgctgcattccagccttggtcacagagtgacttcctgtcttttaaacaaacaaacaaaaataaaaacaatgttttggttaaagatagattgattttaatcaaggcaaagatagaactggaatttatatttaggtctttgcctccaaagcctatgttcatttcctgacattaaattgcatgtctagcaattgatgacttatgttggatatggaaagttaactgcaccttacaaaaatgagactatatctgagttacacattaacagtaaagatactaaaatgatctcaagcatgaatgtatataatccaaatctatcatttataacttcagcatttgcattttttaaacaccatcgatcatgatttagtaatgtttaagtgtctaagattaactgtctgatttggtgttttatcattttaaaccacattctgttttggtttttgattttaggatcgaaaattaacaaagtctgagaggcagagatttaaagaagaagctgaaatgttaaaaggtcttcagcatcccaatattgttagattttatgattcctgggaatccacagtaaaaggaaagaagtgcattgttttggtgactgaacttatgacgtctggaacacttaaaacgtaagttcatcagtattacaaaagctgaccaagaagtatgagagaatttgattttttaaatttcaggtctaccagtttcactttggttgttcagcctaagaagggaacagtccttccaactgttactgtattagcatatttccttgcccacaaagtcctctagtatataaagtgatttgataattatttcttggtaagtattgaaatgagaagttatggccgagtgtggtggctcatgcctgtaatcccagcactttgggaggccggggcaggcggatcacctgaggttggatcacctgaggtcaggagttcgagaccagcctggccaacgtggtgaaaccccgtctctactaaaagtacaaaaattagccgggcatggtggcgtgcacctgtaaccccagctacttgggaggctgaggcaggagaatcgcttgaacctaggaggcggaggttgcagtgagctgagatcacctcacttcattcca

SEQ ID NO: 68196 - DNA, 1103 bp, Homo sapiens
aggaattcatatttggtgctttgttaccataattctcttaccaatcactaattaaatatttttggctctgaaatatttagctgatatagccaacttgatctcccatttctttaagaaaaaactagttacctaatactatcattgtttagatgaaaaagcatttggaagacttatttttctgggtctcttaatagaatttttattttaaactatcatagccctgcttactaaaagtattattaacctttagtgttactgaatcttagtatgctaaatttgatattcccatctccagtcatgttagaatttaatggaattcttcaaagcaacaaactcctatcattgataacttgtttggtatactttgctttttctaggtatctgaaaaggtttaaagtgatgaagatcaaagttctaagaagctggtgccgtcagatccttaaaggtcttcagtttcttcatactcgaactccacctatcattcaccgcgatcttaaatgtgacaacatctttatcaccggccctactggctcagtcaagattggagacctcggtctggcaaccctgaagcgggcttcttttgccaagagtgtgataggtatgtttcaggtgtaccttggagcctgactggctttctcacattccttttatttagaatcctggctctgtcagagttttaagtgatataaaccttaagaaattcatagcttgaactcaggaggtgatccattgtacttatgagatataggattctctatatttgtgcttcttggaatcatcttagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctcagcctcccgagtagctgggattacaggcatgcatcaccatgcctggctaatttttgtatttttagtagaaatggggtttcaccgtgttggccaggctggtctcgaactcctggcctcaagtg

SEQ ID NO: 68197 - DNA, 1032 bp, Homo sapiens
agtaatccatttcacggttctgccctcatgacctgatctgctctcatgacctgatcacctcccaaagaccttcacctcttaatactgtctcattggacgttagatttcaacataaaaattttagggggacacaaacattcagactatagcatacatgaaggaggaaatatagagtgtcttaaaaggtattgtcctagagctaggtttattatatcgttgtttgtattcattgtgcacagcacaccgtaggcactcattaatattttgaagaataaatgattcaaagtaatgtcaaatatagtcaaaatcagacattatgtatatttgggagagttgtatttactctgtgaaagagaagtgaaatttgaggtgaccttcagaattatcctactaaaatgaagttgaatagcagcaagtagaaactgatgtacctataaaagcaatatattttatattaatggcaaaaaacacaattacttttgcatgaacctaatagaataggaaaaactatttggtgcaaataaagcagaaaacaataataggtagaaaggctatcccaggactagaaaggctcttctgtaggttctcaaatctcagttgtaatttctgaacaactagtttaactctttccattatggggctaggtctgtattttattttattttatttttttaggtatttccccttaatttttaccctataattactactctcactttgttctttcttccctgagacttcatagggcagaccaaattgtaatttcccttggtgtagtccgtaaaatgtttcaagacagtttttctaatgttaggagtccttttttgtcaagacccatcattgtcaatttgtaaaacttgttcctttgaatttcttgagggaaggggcttatatgcattattggaagagggagatgctcagcaactgttttcttgatcttcaggaggttacataagaaggaagagaaactgtaattgaacataagaacttggcaacattgtataatattgcagaggccttggtggtaaaggt

SEQ ID NO: 68198 - DNA, 1038 bp, Homo sapiens
ggttatttacagtatatcagaaaactcagtactgctgtatttaaatatggaaaacaatctttctatatcctttgtttttattctgtagtctaccgccttgtgaattacagatcaatattcagggtaggtaagtaaggtcagcttttttgaggaattctgaaataatgatttaataattattatttagtacctaaaacactgggaatgctaccacctttaatcttaattaaatcacagcagaataatgaaatgcttctgaaaatcatgcaaaatgttcctaagatatagccccctagtactggaacttttcttttacaattataacctaaatttgctggatagacatagaaacaaaatttattaaggaaccagttcagctaattccaatagattttcactgatagcacaacaaattctagctgctaaagaaataaatacaaagtttccttcaactttttaaacaccatctaatcaggaatcagtctcacttgtttcagtaaaaaggtagggtgaattgcaatctgttatataaaaactaaaaggaattttaccctaatggctttagttctgttttttcccagacaaaatgttcaaaccttgcaatccaaaagctaatggaatcagtgacaaagtcaaattacacaaacaaagtaattaaaaatccccattatttctaacttggttgttatagggctggattcagccagattcttacagttatgaaccattagtttacaggaatttgaacataccctatgatcccattggaaaacaagcctctttgaactccctaccaaatcaagctagctctatcaaagaaattaacttactcacgattccccaaggctcgttactctctgaatacatgaaagcttgtgtactgctccagttcaaacgcactatccttcatataaaaagttgatatcattgcctgctacggtttttattattttaaaagcacaccaaagtggtgctaaatatattcctacttttacttggatcttctcattatcagtggcatagactttcatgacaact

SEQ ID NO: 68199 - DNA, 1050 bp, Homo sapiens
ttgaactcaatcccttttttcttttaaagtacactttcaaaatgattggaggaagggagtgtttttggtaaatgggtttctagtgtacatagagttaagcatccaagaaaggttttgataggtccaggagatagaaactgtgcgcaaagtaggtggagcattgagcaagtaaaaatcccattttgcttgtctaggatctattactgttggcagagaagcagaaggaatattaacagaatagttttcctgctgttgggcatgcagttttgtccatctagaataaatctgttgttggctgagtagagcaaattcctgtctgagagttggggaagcatggctagtgttaaacaagaaactgtgtttcagtctgactttgatgtctgccttccttatgctgtgggctgatgtacatcagagacattttttccttcattttcctccaataagaaatctgttttgccttttctgatggatattaaaaagaaagatttttgctcagtatttgtcatcataaattctcattgctgctgctgccctcaaaaggattgtataaatgaggtaggtaagaatttccagtatatgtaacagtttatattgtagcctttttggtgatattggtagaaagtttccaatattgaaattgttaactttcagttaaagtattgaaattgttaacttgagaatgctttaaaaatatttagagttctgtaatttagtgaatttatggtgtattctgtgtgaggagggggtaggcttttgtaaattctgaatggttagggaaaagtttacctttattaagagttaatgttaatgttaccctacgacatttgaagcatcagcttttaagaagcaagtgctggcaattcttaggatctgaaagattgcgtcagagaattctgtgttgtgactcacttttatttttctagcagattagttggcaaaacacagtatatagaattcaaatgagaagtcagcctataaaatgtgcatatgtttttgtggggtttttttagttcaaataatacaacataaaatttgataaacatttgt

SEQ ID NO: 68200 - DNA, 1152 bp, Homo sapiens
aaattatcagttataaaaattacattgagttctcatgtcttaagaacgagaaacctatgagtacattttaaaaactgtaactttgtatttattttaaacagctttctattacatgtcccagatgacttttctgtgggtcacttttaggatcagtgaggtttcataatcattccatgtacacatttacttttaatatacaatacctgtatatgcttgcttcttaaatgattcagaatacctcagctaggtattttaataatcctggcttattgatggttgctgactggtaaaattccttgttatatttttcagtatttaagtgggtagcattaagcagtcttaatcttttaataccagctactggactggtaaggtgtgtctcagttttattggctaacttggcacctatggtacattttttaaggcagtagtagtatctaaatatgtggtatagcattggtatggaattttctatacaaaactcttggctgtaggttgaaaaagcagcataacctaccaaatttaaggttgtattatgcacagttattggttttgctatatcttaatatcttttgcgcagtgagtattcctatttgtaaagtcatgaattcatatatgtttgcagggataggattaacaagaggattattattaaggataatcaaggatgaaagcaggttcaagaaaagattttccttcctttattatctttggtgattgcctttatactcagaggtagccttgggtcagcaaacttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatgatcctctggcccagcc

SEQ ID NO: 68201 - DNA, 1085 bp, Homo sapiens
gtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacagttccttgctgtgaaaagttagccctgcgagtagaattctccaaattgggtcttcggaataatacaatgagtaattgagcattatccagctttggatataactcttgtacttaaaagactttagagcttatcattttatgtatttcatttatttcatttagatctatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatccgtgtggtgacttagatgaggtcagaatagatgagatctttttctctttcaccccacctcttagacagtagcattttgttcttacatcttatgtatattttccacacattgctgttttgtttttgtttttgtttttgttttttttaaagatggagtcttgctctgtcaccaggctggagtgcagtggcttgatctcagctcactgcaacctctgcctcccgggttcaagagattctcctgcctcagcctcccgagtagctgggactacaggcatgcgccaccacgcccatctaatttttgtatttttagtagagacggggtttcaccatgttggccaggatggtctcgatctcttgacctcgtgatctgcccacctcagcctccccaaagtgctgggattacaggtgtgagccacggcgcccaacctgaaaatttattttta

SEQ ID NO: 68202 - DNA, 1970 bp, Homo sapiens
actataaacaaaggaatgtttgtttcaactcttttttttttttttggacacagtcttgtcacgtcgcctaggctggagtacagtggcatagtctcagcttactgcaacctctgccttccaggttcaagcaattctcctgtctcagcctcctgagtagctgggactacagacgcacatcaccgcacctggctaatttttgtatttttagtagagacagggtttcaccatattggtcaggcgggttgcagactcctgacctgaggtgaaccacccaccttggcctcccaaagtactgggattacaggtgtgagccactgggcccagcctgtttcaactcttgttggagcagtttattagatgattggcatattgaaaccattttatcttaagattgtttcacaatcagacttctgcttgcccagtacacaaattattgaacaaggaattaagagaacttactggtgtaaataaagcttgctgtggtagaaagtaccaaactagaaacaaaaatatttattttctagtttctatttcagcatttacagcttttataactgtgagcaagattctcaacctttctgggcctccatttcctaataatcaggagatgatatcaaattgggtgttggtcagacaagatcataaatatgaagatttgtgttacttataaaatgctatataaatgatcatgtggtattttgaagctttaatagagccaattgtgttagcccaccattactagtatactattactaataagatcattggatttaaaaattatgttacaattgtgttagctcgccattactagtatactattactaatgagatcattggatttaaaaattatcactgtcagctcttattcatgaatgagattgttatgatgttttataacttcagagtaaacctctgtaggcacccttcaaattcagcaatgtaaaaatgagttatactttcccctgtattttttcccatttttttcttctgcgaataacaataattggccacatttgaaaattattttttcaaactaatggtgttttatttttgttccttttcttttccctctgtttggaagatattccatcaaagaccttttgaaccatgccttcttccaagaggaaacaggagtacgggtagaattagcagaagaagatgatggagaaaaaatagccataaaattatggctacgtattgaagatattaagaaattaaagggaaaatacaaagataatgaagctattgagttttcttttgatttagagagagatgtcccagaagatgttgcacaagaaatggtaaattgacattagccattttaaaattgatttagacttatatatatcaatactatcattaagcaaaaaagcagttgatgaagtgccgtgtgtggcatatcccattgacataaaattgtgatggccctaaaagttatctttgattagtgggattttcgtgtgtgtgtgttttttttttttttaaacttctttgtattgcttttataatgggtgttagattttatagtcctttttaaaagtaaattttttttttttttgatggagagagagacagggtcttgctctgtcaccaggctggagtgcagtggcctgataatcatagcttactgcagccttaaactcctgaactcaagcaatccttctgccttagcctgccgagaagctgggaccatagggacgtgccaccacacctgactaatttttgtatttttagtatagacagggtttcaccatgttggccaggcttgtctcgaactccttatgtcaagtgatcatcccacctcagcctcccaaagtgctgggagtacaggtgtgagccacttcgcccggccaaaagttatttttgagaaaatatgtagatatatatatacatagggatagatagatgagatagataggtagaactagtagaatgcattccgaagtcattttgaaaagtctgtaagattg

SEQ ID NO: 68203 - DNA, 1429 bp, Homo sapiens
gcacattctacaggcacagtcccagggcatataccttctactgtccaagcacagtctcagccccatggggtatatccaccctcaagtgtggtaagtaaatgcttaagagcatgtaatactacaatgagagccaatggatagtctgctaaattaaaattctttgtacaaaccaagtaacagtatgagtctgaagtagaaaatataaaatgctgtgtctctaaagccttattatagagtaggatatagacattaatgtgtgggcattagctgaactgcctacatgaagcagctatgtgcaagatttagattagtctgcatttttactaaagggaacgctctctttagcacttaagatgttgaaactattcacagcaacaaaagctggacatacaaatgttttgcgggtggggcgagaagagtttttcaaaagcttgttaaaatgattactaagtatttcctgtaagattccctattgtacaaaacacaggtaagaccttcaaaccattatagaatgctgcatgtgagtactctagattgagggaatcctttatttgaatgactgtttaatttagcgcttgtgttgagttaatcatcagttgctgtgtgtgttcctgccttttaaagtctgtgttggacacaagttccttccccagtatatgttcttttgctttttccctttagttggtaactgttttattactgatttattttcagaatcaacttatagaaattatttcctgaaacattttatgcttgtatacacatacacacacacaattatcctgtgttttacattagacactcttgtttctcatatagagaatgttaaagtagatcatcagataataccccatttcttttgttgacctcagaggaaaataaaatacgtcatctgcctctgaaaggtattagaaaataagtaacttgtcactgtacagcacttgtttagtgagatctttaagcagacagattttccccttctcagaaagcttttaatctaaactttgtggaattcttgctcttctttaaatgaaaatctttctctgttaagaaaatacttctgcttgttcgattttttatcctacagcttggaataaaagatgttcatttgtttcagagtccgtttaatcctgctttggctaggtctcaaaatgaatggccacagtaacacaaataaaaaactaatatactaactttttaaaacaatctactttctgtctttaaaataattgagggtagaatagaagaactttataaagactgcacagaaaatatatttctgtgttctgacaaatattacttgtcagcatttcttgtcagtttctacctttaattgttttttttctggattattataactagattttgctaagactttttttttaaaattttctcttgtctatactcatcatgggggagcattaggtct

SEQ ID NO: 68204 - DNA, 1850 bp, Homo sapiens
tttttttttttgacagcgtctcactctgtctcccaggtgggaatacagtggcgtgatcttggctcactgcaactttcacctcctgggttcaagtgattctcctgcctcagcctccccagtagctaagattacaggcacccatcaccacgcccagctaatttttgtattttttttagtagagacacagtttcaccgtgttggctaggctggtcttgaactcttgacctcaagtgatccacctgcctcggcctcccaaagtgccaggattacaggtgtgagccaccatgcccggcctaaattattatttagagattcagattgaagatattctcccattgattactttgtaaaagtacaaaatatttcctatatccagttgtgaatttcttctagaaagctaaactttttcctagtagatcatgacttttttacctttacaaataaagagtggcaagtataagaaatactgtgagccaacaactttccatctcatgtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttcccccatggaagtattttttccttaggtttcaacctaaggtgggactgtagctcta

SEQ ID NO: 68205 - DNA, 1408 bp, Homo sapiens
aatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccgagtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaattcatggttacggccgggctcagtggctcacgcctgtaatcctagcactttgggaggccgaagtgagcagatcacctgaggtcaggagttcgagaccagcctggccaacatggcgaaatgtgtctctactaaaaatacaaaaattagctgggcgtggtggcgcacgcgtgtagtcccagctacttgggaggctgaggcagaagaatcccttgaacccaggaggcggaggttgcagtaagccaagattgtcactgcactccagcctgggcgaaagaggaagactccatctcaaaaaaaagaaaaaagaaatttcatggttatgcaactcttatttatgatcagaaaaatggacattttgtgatttaactctgtaacatgtttcatgtagtaaaaatataataaaactattaatcatctagcttgggagagataggagaaagacattactgtcactagtcaaattatatatcttttactatccaccaaaaatctcttctgatttctggttagaaggcatactattaattgataagaaaataaaactgaaggcctctaacatatcacagggtaataagaatatagggaaagttagttcaatagtttaaattaaagcacacttcttacagtatagaactagtcgggcttttatgccttgttttagttcttactcttcctttaactctttttctgttgatgtaatttacattaatgcttaagagtgaactttttaagtgtgggtaaaaacgaaataattacttacaaagtttaattcttccatttcctttgagagaggaaagttatggaaaagcagctcttatctaaagcaaagagcccacagattgatttcattggccctggatgtatttaatggattttt

SEQ ID NO: 68206 - DNA, 1731 bp, Homo sapiens
aagcattgttatttatttattaattataaatttagtgtaaccatttcatagggttacacagaactacccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaacccctgctgaggactgttggccaaagtcttcttccacctggtggcagcccaactaactggacaccagaggccgtagttatgttgggtactacagccagtagagtaactggagagtcatgtgagatacaggtccatcctatgtttgaaccatctcaagtttacagtgactatagacctggactagtacttccagaagaagctcactattttattcctcaggaagcagtgtatgtagctggggtacattaccaggcccgggtggcagaacagtatgagggcattccatacaactcatcagtactgtcaagtcctatgaaacagatacctgaacagaagccagtacaagggggccctacttcaagttctgtctttgaatttccatctggacaggctttcctggtaggacaccttcagaatctaagattagattctggattgggtccgggatctcccctctctagtatttctgcacctatcagtacagatgctacacgtttgaaatttcaccctgtctttgttcctcattctgcgcctgctgtgttaactcataacaatgagagcagaagcaactgtgtatttgaatttcatgttcacacaccaagctcctcttcaggagaaggaggtggaattttacctcagcgtgtttaccgaaatcggcaggttgcagtggacttgaatcaagaagaactgcctcctcaatcagttggattacatggctacttgcagcctgtgactgaagaaaagcataattaccatgccccagaattgaccgtttctgtggtagagcctatcggacagaactggccaataggaagcccagaatattccagtgattcctcacaaatcacttcttcagaccccagtgattttcagtcacctccccctacagggggagcagctgcaccttttggctctgacgtctcaatgccctttatccatctgcctcagacagtgttacaagaatccccacttttcttctgtttcccccaaggaaccacatctcagcaggtcttaactgcctcattttcttcaggaggatctgcacttcatccacaggttataggaaaacttccacaattattttaaactaccctactttgcaccataacatttaaattttctattccttatttccctgaatcatggattttggagaaatattgtttaattttatcagtagagtttccccatctttggggggttgtgaactacatatatgcatttaaaaacaaaatgtgagagaagctacctgatttacctattatatgtgaaaaccagtggaaaaaacacaaaaactagaattttagtcattcttcacaatcacgacttctatgcacgttattttcaaccagtagtgaaaatgcaagtgtatgtaatgtatggttgacccagcattatttaggaatacaa

SEQ ID NO: 68207 - DNA, 1913 bp, Homo sapiens
gcctttttaaaatggcatcagtcaagcaagttgctgtgcattattatatgtccaaataaaatgctaattcataaaattaaggactgattctaatttttagcaactaacaatctagtgagtggtgggctttttttttttgttataagaatttgtgatatgttgcaagctaaggaacagtagacatcttaggccttgtattttcctcaacaaatttaattttagttatttatgtgtatgagcatatacacacttagcaaataaagacaatgtaatgaatgtaatagaattcaaaagtacagtcagtgtttactgtttcatatattcatttggtatattttatcaaatgtgtacatcttataaaatctacatagaagactatgcagttatatattgaagacatttggatatcctacataaagtactatgtgttgttcttcctactttcttcctatgttcttccctcatcaggagcataaacaactcccaaaatgtgcacaaattatcaattatttagtgctgtactaagacacaaaaagatccagaagcttgacagctatacatgggcatgcagtatattcacatcagtattcaagttgcagcccctattataaatattaatgtattgccagtaattatcctttagactttccaaagtaaaaaataccaggtagttaatttatagacatactacagaaggaatcaatatttataatagttaagctgcagtggaatgtgatattatatccatgtaagctttaaggaaccccttgtaaactgaaatggaatgacaaaagtggtagccttttcatttcgttaacatacctatatatagtcctgcatcatttctcactttctagtgagaaacactgtagttggggtttctcagactcaacactgttgacatctgaggttggataattctttgttgtggtgggctgttctatgtattgtaggctatttagaacatccttggtttatacctcctaaatactagtagcagcaatctccctcagttgtgacaaccagaaatgtctccacatattgccaagtgcccccctgggggtggcaggattgctcctggatagcaatgatcgccctaggtacttggcagttgatgataacagattttttgatacttttgataaaagtcattgtggcactacaagaagtattaccaaattagcattaccaaatacctttctttaattcttcagataaatttcagattgatagtattaatactttgttcctgattattgtatttctaataacaaattttattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaag

SEQ ID NO: 68208 - DNA, 4176 bp, Homo sapiens
agaaacatgctgttattgatttgaaataaaactgaatcattgtattttattcttagcagcagggaatacagcagacagcccctcctcaacagacagtgcagtattcactttcacagacatcaacctccagtgaggccactactgcacagccagtgagtcagcctcaagctccacaagtcttgcctcaagtatcagctggaaaacaggtaaactttttttttttttttaaacaggtaaactcttaatttctgaaagggtgctaaaagggatttccatgtaacttgtcctttcatgtggatagacttctaccttttcttctaagggtaaccaacccttgaagtaggttaatctcattgcagaaatgaagtgaagatcacctcattggtgcatatgcattatttaatgtaaatgggtacgttactgacagcagtgacaatccaaagtttcacttctagtcttaccagtccaaaattgatgtaacaggtattagaaataacaggttaaataaaggtgctctggtaactgaacctatgacattccctagaattgtgtcagctatgtctgatattctaggtttgaaactatgctttattttcatgtagatttctgcactgtttactgtgtggaatgtttttttttcttaagtagtcctcctaatcacttgagaagtaccctgtagaaggtatgcttttctgaatgaccttttttcaactttatttttgagtactgttgtgcatgtatgtgcacagtgtattgttaccctaatatttcatcacatctgagatgctatcaactttaaaatgtaccatattttatgtaccacattatcagttataaagtagatcccaatttctcacatgttaaaatgatcaggtagtggagagggatgattgcatcctagaatgagtgaaatatgtgaattataccaatttttattgagccatgttggacttaagaattttagaaataatacgaatgaaatcttaattccactgggaaggaattcatttgaatttcagtaactactgtaacagcagtcgtaactttagtgatagcattatggtatataaaatatattccaataaagctgttaaaaaaaaaagccaaccccttgtctatggaagggtcctcttctattgccaaatgctgaagcattagcaaatatttctatgacaaaaggtgtagaacagtaatagtctatttagcctctttctctcctgctctcctttccatattcttatgtggcatattaacttaacactaatgtatgcagggttttgttggtttggtgtttttttttttgtttgttttttccttctttttggctaatacataaatcttgcttttggcagccttgcttttttttttttttttttttttttaagcctgtctgttttgtttttctttaccttcccagcttccagtttcccagccagtaccaactatccaaggcgaacctcagatcccagttgcgacacaaccctcggttgttccagtccactctggtgctcatttccttccagtgggacagccgctccctactcccttgctccctcagtaccctgtctctcagattcccatatcaactcctcatgtgtctacggctcagacaggtttctcatcccttcccatcacaatggcagctggcattactcagcctctgctcacgttggcttcatctgctacaacagctgcgatcccgggggtatcaactgtggttcctagtcagcttccaacccttctgcagcctgtgactcagctgccaagtcaggttcacccacagctcctacaaccagcagttcagtccatgggaataccagctaaccttggacaagctgctgaggttccactttcctctggagatgttctgtaccaggtattgtgttagttagcaaaagagggcaccacagagtttgatcctagtagatcatcaggaacatggaaatctaatagttgagtgtcagaataactagcaataacatgtcaactagagaagcaaaatagtaaaattctgagaaaggattggataatgatgttcagtgattcctgatccatttttctcaagacacttcttcagagaaaaatggttctctcagtattcactgtaagctgattgaatgctagatgtggttaatagtacacctggcaacttttacatatatgggtagaataaatagaatagccaacatggtatcaacaaaaagcttcggggtttagactgggaaaattagcatttcatgatatgactgttatgtggaagaatttttgcatttttccatttaagattggctaggaagaaattgtgttcctcctatttaaatcatctctaggtgaagataaccgacaataaagtagtattgtagagtcctgtctcttctgttggaaccagtctactacttcatttcaagaatgtggtctttatatgccctttagattattagaaagagattggctactattcttctttgctgtgtgcttcttttttttttttttgcatgtcttgctgttttgctaatttattgacccccaacctgctctaactcaccttcctcatttctgtcacagggcttcccacctcgactgccaccacagtacccaggagattcaaatattgctccctcttccaacgtggcttctgtttgcatccattctacagtcctatcccctcccatgccgacagaagtactggctacacctgggtactttcccacagtggtgcagccttatgtggaatcaaatcttttagttcctatgggtggtgtaggaggacaggttcaagtgtcccagccaggagggagtttagcacaagcccccactacatcctcccagcaagcagttttggaggtaaatagaattactgcatgtttatatgtaaaacgtatatatgtaattggacaacaatgataaaggagaaagaaacaggctcccctggtttagaacttatttggagaccatgtcaaactaacttctgcatgactttttcttacagcagaatgaaatgccaatgtggggtccttgtttccactggctgttctgttgggaagtgagtgtgccttggagaagatgaaccctattagcacttcacttctctagctagtactttagccattattcttgtcctttcacaaactttttccattggcagtcataagagtatcttaccctcctgtgctctcagcaatcatttttgccctgctaggagaagatctgaattcatctttgtactatgctctgtctgcgctattgcacactcttggtaagatgctggctgcatggcaagttgtaggttcacactgcctagcagatatgttggctgacctcataccatgcagtctataccagagactagctttagcaacttcctttggaattttaagaccattatctctagatgctgaatattgagaatttactagtaaatttagtgcttctaggacgtagtggggagggataaggaaaaaaataagtagattattggggatagtgaatgataaatctattactaccgagatttgagttatcttttcgattcacagagtactcagggagtctctcaggttgctcctgcagagccagttgcagtagcacagacccaagctacccagccgaccactttggcttcctctgtagacaggtacgtaaaactagaattctccttccttgactggtaaataagacggtatgaaacgccaaactgtcagacctttaaatctcatattataaactgcacttttttttctttttaaatttcaaagtgcacattcagatgttgcttcaggtatgagtgatggcaatgagaacgtcccatcttccagtggaaggcatgaaggaagaactacaaaacggcattaccgaaaatctgtaaggagtcgctctcgacatgaaaaaacttcacgcccaaaattaagaattttgaatgtaagtattcctaatttgtgagtttcatgttgttaaaggaatttgacactgaaaaagattttagaggtcatcaaatccaaaccactcacttcataaaataaagataactatctgtgtgtgacagataattttttttttttttagacggagtctcgctctgtcgcccaggctggagtgcagtggcatgatctcttctcactgtgattgcagtgcctcctgggttcaagcgattctcctgcctcagcctcccaagtagct

SEQ ID NO: 68209 - DNA, 3970 bp, Homo sapiens
gggattacaggcacccagccagataatttatatagtactcttctcatttcatgcccacagtctctttgacttaaatatcacatttttagaaaaatgaaaaggtagttcataaagctatgatagggccagcagttaatatcatttaaatatttcttaaggcttagatgaattgatgaatgtataggatcttataattagccaaatgatattcttacattccatatttctatgataaagcactacttatcttttagaaaaagaatagagagttttagtaagtagctcaaaggctaacgtcttctcaaagatttttcttgctaccagtttaagagacaaagtactagtgctccaaggaacagcgataacactatgcttccttagacataaagtcaagtgctaatctgcattgcttttctgaaattcagtaataaagctgaatatggtctttggagatgatgtaccttttttctttttaggtttcaaataaaggagaccgagtagtagaatgtcaattagagactcataataggaaaatggttacattcaaatttgacctagatggtgacaaccccgaggagatagcaacaattatggtacgtctgcatttggagttctaggtttttccttagtacttgatcttaatagccattgctctaggcaaatatgccatattttataatccatgtttttttaaagttatgcatttacttcaatgtgaataaaactatcacacccaacctgtgatttagtgatgtttttgtctaggctatgtctaactagatattgaagttcttaaaaagagaagagctaacttgagtacaaaataaataaaaatataggtaagtatgcagataggacagaagtcataaaagtgacataaagtttgagaaatgacactaattagactgacatcacatttcttttacaggtgaacaatgactttattctagcaatagagagagagtcgtttgtggatcaagtgcgagaaattattgaaaaagctgatgaaatgctcagtgaggatgtcagtgtggaaccagagggtgatcagggattggagagtctacaaggaaaggatgactatggcttttcaggttctcaggtaggttcaccactcccatagtgaaactttgttgatttaaaatattttcatagttctaaatttgctatgcaaaatgtccagtgatatcacctgacacccatgaccgacaacaaacttttatgttctcttcacatgtggcagtttgctttgcctagtcattgagattgcatttgagaatgtatttaatcacttttgtttgttgtagaaattggaaggagagttcaaacaaccaattcctgcgtcttccatgccacagcaaataggtgaatttattttctttccttgtttttacctttgacttaagaagccattagccgagggtggtggcaggcttctgtagtcccagctactcaggaggccgaggcacgagaatcgcttgaacccaggaggcggaggttgcagtgagctgagatcgcgccactgcactccagcctgggtgagagaatgagaccgtgcctcaaaaaaagcagttgtatgtgccaataatgaagtctaacaatatttataataataatgctattaagttacgtttgtttgtttgtttttgaccaggcattcctaccagttctttaactcaagttgttcattctgcgggaaggcggtttatagtgagtcctgtgccagaaagccgattacgagaatcaaaagttttccccagtgaaataacagatacaggtaagggattgattctgccacattgttatgtaaattctacagtgcctctgctatgttgaaagcttaatcataaagcagtaatttatgatgacacagataataaaaaagaatagaaaactgaagttataaccaacagataaacatatgggagagggaaatagatgaagaatacagagaattacagaaaaagccaagaagcacggccataccaagatatagtctgtataatagatattgtagtatgtgtttatttctgcacttagtactgttgtctatgttttaagattactccatattttttatcaaaaacagatatttataggagctgacttaggctagcagacaatcttttgaatccatccttttaaaatcagctgattcttatctttttgtattcctttgcagttgctgcctctacagctcagagccctggaatgaacttgtctcactctgcatcatcccttagtctacaacaggccttttctgaacttagacgtgcccaaatgacagaaggacccaacacagcacctccaaactttagtcatacaggaccaacatttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaagtccccacatccacatctgagatcgttgtttctagtacagcactgtatccttcagtaacagtttcagcaacttcagcctctgcagggggcagtactgctaccccaggtcctaagcctccagctgtagtatctcagcaggcagcaggcagcactactgtgggagccacattaacatcagtttctaccaccacttcattcccaagcacagcttcacagctgtgcattcagcttagcagcagtacttctactcctactttagctgaaaccgtggtagttagcgcacactcactagataagacatctcatagcagtacaactggattggctttctccctctctgcaccatcttcctcttcctctcctggagcaggagtgtctagttatatttctcagcctggtgggctgcatcctttggtcattccatcagtgatagcttctactcctattcttccccaagcagcaggacctacttctacacctttattaccccaagtacctagtatcccacccttggtacagcctgttgccaatgtgcctgctgtacagcagacactaattcatagtcagcctcaaccagctttgcttcccaaccagccccatactcattgtcctgaagtagattctgatacacaacccaaagctcctggaattgatgacataaagactctagaagaaaagctgcggtctctgttcagtgaacacagctcatctggagctcagcatgcctctgtctcactggagacctcactagtcatagagagcactgtcacaccaggcatcccaactactgctgttgcaccaagcaaactcctgacttctaccacaagtacttgcttaccaccaaccaatttaccactaggaacagttgctttgccagttacaccagtggtcacacctgggcaagtttctaccccagtcagcactactacatcaggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgagggtatatctacaatgaacatgagatttttttttcaagtgtggcaggattttagggttaattatgctgcacagttttccaagatggtataattatcgggtaaaatacaggtatttcttctgaattggtacaaactgaagaagtctgtatcccaaaagggagctaaatgcatctgtcagcaaaatgtacgtaaataatagcagtt

SEQ ID NO: 68210 - DNA, 1429 bp, Homo sapiens
gtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttacgtctactgtattgtatgcttcagcctctttctgcattgccattgatgtgaggttctttttatagtaggataatgcagaatcttcactcagataaaatagaaattcttgataatagtattagatttctgatgccttttgttatcagacctgcccattggttatttcttaaccagttactgttttcttttctcagaaaatcttgttttacatggcgaaagtctgatacatactgtaccaaataagtagctcaagaatatctggacactgccacttatgtacatatagcctttgttctgttctccctaggggacaactttttactgtattttactattcattttataggtatatcgtagtaacccctataataacaacattagttgtcacaccgtttttttaagacagataccagagagtaacctcagtgataaacatgtcttaactatatatattttattcttatgtttgtgcattcaaattagttgatttgctcttcagtacgcagtctttatatttagcgtctcacggacttgattttccctttgttgtctgtaggtgctgccagtgggtactgaacttccagcaggtactctacccagcgagcagctgccaccttttccaggaccttctctaacccaggtgcctcaagacttgacaaatttcttcctgtgccctactttctttgacaaagcttgctgaagttctccactacgtggtcttggcttttgcctatttgtctttgacttagtaacacctttcttttaaaatgttataaccaatgacccagttcctacttaagtaagaagcttcatagctcttttgtttgtaatgttgcttccggttatccaaaaacacttgatactaattttttttttatatcttatgaaggaagaaaacagcaaagcaaacattttgtcagacccatatagctccctttatcactcacacttctgtagaatagcgaaattgcgtatataatcaaaattaactttgagagtgccctagaaaggagaagcacaatatggcaactgagaaactttttccgcgagtccagagcaaccagtctcttcttgaatgttgatcatttctttcactagccacctaatgaaggaattagcttacttataggtaggtataggggtgatgtttcatgaaaactatgtgtgctgtctcttttaaaataaaagccaccgagctcagtgagatgctaacattatgagatcactcatggaggaactgagaccagcctcatgaacttgagattcc

SEQ ID NO: 68211 - DNA, 3438 bp, Homo sapiens
acacgctaccatgcctggctaatttttgtatttttagtagagacagggtttcaccacgttggccaggctgatctgaaactcctgacctcaagtgatccacctgcttcagcctcccaaaatggtgggcttacaggcatgagccactatgcctggccctgaccttttgttatgtatatgttgactaagacataaatctgaattctgtgtatgacatcaaatacgaaagtaaattatttactttataagcgtagccagccacacagaatctgcatctcagtacccatgtgttctctatgatggtattcaatttttcttcctagtcaaaagtggaggcgctatgtaaagagacaatcagcctactctttgacagggaaataaagtgattctttttttccttttttaaattgtctgtgatagaaattggatattgagaacttaagtttttaatctttgtccttttttatcaggtttctgttgcagcagacggtgcccagaaagagggtaaaaataagtcagaagatgcaaagtctgttcattttgaatccagcacctcagagtcctcagtgctatcaagtagtagtccagagagtaccttggtgaaaccagagccgaatggcataaccatccctggtatctcttcagatgtgccagagagtgcccacaaaactactgcctcagaggcaaagtcagacactgggcagcctaccaaggttggacgttttcaggtgacaactacagcaaacaaagtgggtcgtttctctgtatcaaaaactgaggacaagatcactgacacaaagaaagaaggaccagtggcatctcctccttttatggatttggaacaagctgttcttcctgctgtgataccaaagaaagagaagcctgaactgtcagagccttcacatctaaatgggccgtcttctgacccggaggccgcttttttaagtagggatgtggatgatggttccggtagtccacactcgccccatcagctgagctcaaagagccttcctagccagaatctaagtcaaagccttagtaattcatttaactcctcttacatgagtagcgacaatgagtcagatatcgaagatgaagacttaaagttagagctgcgacgactacgagataagtaagtatattttctcttgtgaaagaatgtcagataaggttttcagacctagatcccagggccaagattaataatatttttcgccacaatatgctaatgtctcatttcttttaaagagacagtgccacagaagccccaccccatacctccccaccacacacacacacacacacacacacacacacacacacacacacacacacacacgattcccaaccactgactcacaggcacaggcagcttctcttgcactcatacagacccatagcatttctagttctagaacttcttcattgttactatattattactgtattattgttactgtattgtattattatttttattaatagcatattgtatcactattaactgctctttatttattagtccactaaatgaatctggcactgggatgtatgattatttggcacgttttgtttggcagattgggtcagagtagcaaattcagctattgtgtgcgtggcctcaaaagtcaggaaatgtttttctcctaaaacattatcaaccatttgttgttggctaggagcttgttggaacatggcttgggtaatgcaggccagcaaggtgagttgacaaactagaatctcgtggtagtacatttggggaaaaggttcattagtaactactacatacttgaaagcaggtttaggaatatgctgttaattcttgtctgaatgaagaggattatggtattttgaattatgtttggttatctttcacagacatctcaaagagattcaggacctgcagagtcgccagaagcatgaaattgaatctttgtataccaaactgggcaaggtgccccctgctgttattattcccccagctgctcccctttcagggagaagacgacgacccactaaaagcaaaggcagcaaatctagtcgaagcagttccttggggaataaaagcccccagctttcaggtaaaaagccctggactaggtcagccacagctgtcctatcttttgtttctgtctccagctgtatgtgacctgctgaacatttgttgtttttgttaaatttcaaaggaatttggctctcctgatatttttgcttccttgactgctgtacttacatttattgtacctctttttgagtctatagaagtagacttagtgaatacaatggcttattccattgtaatccatattgctatctactggtaatctttatttatagttattcttaaggatagacatttagctttgcctgttaactcgtataactcacatttaaccaaactcttgggcagttggaagaaaatacattattctctgtttagtaaaacttgggtagattctttgttttaatggatgacttagtcataattgcaacttagatgaatgtaatcgtcatatagatatttgtgtgtatgtctaagtggtaacttcttgattaaggtttttatttcatttatattgggttaaagaacttgctagtcattggttaggcacggtggctcacgcctgtaatcccagaactttgggaggctgaggcaggcagatcacgaggtcaggagatcaagaccatcctgactaacacggtgaaaccctgtctctactaaaaataaaaaaattaggtgggcatggtggcaggcgcctatagtcccagctactcaggaggctgaggcaggagaatggcatgagcccgggaggcggagcttgcagtgagctgagattgcaccactgcactccagcctcggtgacagagcaagactctgtctcaaaaaaaaaaaaaaaaagaagaacttgctagtcattaaaatcaaagaaatagttaagtgatactcttttgtaatgtagtatatatatatatttatttattttaagagacagggcctcactctgttgcccagactggagtgcagtggtgtgatcatagcacacaacacaacagcctcaaactcctaggctcaggtggtcctcctaccttagcttcctgggtagctgggattacaggcacacactaccatgccctgctaactttgaattttttttttgagacagaatcccgctctgttgcccaggctggagtgcagtggcacgatctcggctcactgcattctccgcctcccagtttcaagtgatcctcctgcctcagccccgcatagtagctgggattacaggcacatgtcaccatgcctggctaatttttgtatttttagtagagatggggtttcactatgttggccaggctggtctcaaactcctggctcaggtgatccacccaccttggcctcccaaagtgctgggattacaggcgtgagccaccgtgcccggccct

SEQ ID NO: 68212 - DNA, 2048 bp, Homo sapiens
ttttcttagccattgtagaattttgttacttttaagtatgggagtggcatactaaaatgaataaccttacaattcagttttttatccataatctactttccaaatatagctctgtttattagtgattgctgaaaaaattcccacagaggaaagagcttttagtcatattagaacaagaattgaaaagacttgggcatctgggtgagaagaatgaaaaaaatataggtactggcttatgtgcctttgccacagtttcacagaaattagagatcagtctcttcacaggaagaatgcacttgattggtaaggagggcaaactagctagcattattcgaactaagaaaagcttccgcattttgcagatgggtagaattaagacctaatatttcatctcttacatatctgaccttccccccagaagcttgttcttctgtgtgccatcttagtgcatttcaccactccagcctcaagtttctaacatcttgtagttgtgttctgtctcttctcctctctctgttctaccctgtttttcccctctcacaggctgtgcgaagtttaactgtgcatctgaacaggtgacattcaaacctggtggcaggaggacccgatttctgagtacgccctgcttggctctttgtgtgtaacacctttactccttccttgtccttgtgtttctgctgcttggatctgatgtttcacgcagtccattttcatttgtctctttttgtatatcatctactcagtggcttggctgaattactgttaccctcagaagtttgggcccccacattaattatgataaaaaatgtcaaaataacaagttatctacaaatttcaatgtaactttctggtagaagtgcttcttcatggatctgtgacagagagtggatatggtatctaggcaatagattgctgggtcatttagaataatgaagactgaactccacagtcgtagtcagtgctgtctgtctgccctagcattagaaatgagagaaatcagccagacacggtggcgtacacctgtaatcccagcactttgggaggccgaggcgggaagattgcttgaggccaggagctcgagaccaaccctgggcaacatggtgataccccatctctaaaaaaaaaaaaaaagttagcctggcatggtggtgtgcacctatagtcccagctgcccaggaggctgaggcgggaggattaccaccttaagaccaggaggttgagactgcagtgagccatgattgcaccactgcaccccagcctgagcgacagagtgagactctatctcaaaaaaaagaaacgaaatgaagaaagcattttgaccaatgatgctcttagatcctggcagcaggtaaaaattatgtaccatttttttccattctttgtcagagtagattgaaatcttatttttcttctctattaagcctaagcagctaccagttgaaaagatgctaggatctcttcattggatcattccaccactactgtcctctaaccccataaaatcaaaagcggtttttagtttggttattctgataaagcacttagtctaataaagatcaaagcccagcatctgcaagtgaaaattctccttctaacatgatttctgggattttgcagctttctacttaaaaacaaggcacaatagcaagtcaccccatcttccccatatgtgaaatggagatgatgccagtgtcctagggccatcgtacaaatcaagctaagatcatgtacagagaaacaggtagcgcttgaaaagcactcatggtttctctctgatgagtcagtgcctacctggcacagaacaggtagtcaataactgttcgtggaagaacagtttaaaacaaacaaaaacatagttcaagtagaaaaacctttgttataatttgaataaagatcttctctgttaaggcctcaaacttctgatgtgattattgaagtgctttttacatgcatgtgctcaggccatcactgtttctgagtatgggtcagaggcccttgggcctcttcacggtgggaagaatttacaacctccctttgttctctgtagt

SEQ ID NO: 68213 - DNA, 3252 bp, Homo sapiens
cactttaattaaattccataaattctcatcccacttttaaaggtaggtggtattacccctgttgttcaaatgaaagtggtcagaaatattgaatcttgtcacttccctttgggtgcaaaatgaaaggccctacatccttagaagtcacatcaggatacatcatgtaagcctggtaaacaaatcccaagagacatacttgaaatatggaaaggaaacaggtacttgaaagagtagggcaccttactagcttgagatgtattattctatgctctcaaaatagataatggtttggaagcacggcttggcttactgctatatttatgttcagaggttgcttgttttccacgtacttttaaaaactattctggaagggaaggggttagtatatatatgtgggatgtggaaatataatagccaatttaaatgaacttaaagctgtaacagtgatactatcagtctactgtggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcctgctttctcttgctgggcgtttgtgtgctgtttggagattctaaatattttacactgatgtttctttatctttaacacattgcttctctctttgtgcttcagggaagatggtgaaaaaagtctgtccttgcaaccagctctgtagtaattatcttttctgttatttttggtccttgattgcaaagcctgttaaccatgagttctttcaactctgcagtctcatagctccctgattcctaacttccatctatctctgtatcctattctaataaatatttaacatgcttaattgagaaatcatctcctagtcggtgccctcagtgataaccccatgtgagcctagcttgtgacagacatggattggtaatggccatgggtatatatagggaggtcagggatgcctagttcctatgggagagcgatcctttggtcagcaaatatgtgccgggcagtgttattaccccaactggaaactcagcagtgacgaaagcatacaaaagtccatgccctcccacgttcacactgaagtgggagatgtgtgctagattgacgaggagaaaaacaccactttctagagtttgtcttcttagactgtggcttctcatactttaatgagaaggccacttacagtgttgtaggtagggtcaacagggaaattctgtacttgggatgttgggctgtaagttatggttcataataggttattgttagtaggatctggtgatgtgggaataggggaaatgtattataatggcaggaggaaatttaaaaatgaatcttgggggtaagtctatactacttattagggcttttcagaagaactaaaaaaggttaagaagttagcatattctctcaaaggcctttctacatcttttatagtcaagtctccttttcttaggagttaatttctggtcagaaaatgataggtttgtttcattctttaatgggaggcctgtatacagaagccagaacgtgaaggtttagctgtatggttgactcttcctcatggtttctctttcctcatagagaatcctgtattaggtaatgtagggtaaaatgaaaagtgaaatttcgttctaaaggggcctcgcagcatcaggggcgacagactagagaggtgtgtctcccagcatgagctctgtggataagcaatggtcacgcctcctgagcttcttgtatttagcttttgacagctctgctcccctgtgattatttctgttttttgttttgattgtctctcacatcaagctcaccaagcaataattgttcaaacaggatgacaatccccatgcatgtgatatgcttgctttctagattgagtcactcactgtcatgactgcccatcctcattgcctgtgcttcccacttcaccactctctcacattggctgttcatggaaggctgttttctgtgctctcatgcttctcccctcgcgtttcctgtactgtagggagcttactcttcccttcacactgtatgtgcaatagcaatccccttgtggctccagcagacaccaagaaatgagctgacactcacactgcagtagttccgtgtcttgccatagcggtaagaagcatgtgaccttcctcactgcagcttcacctcagaattagctgttactgcagcacagacctgcttgtgtgtgccattccccaggtggtaggatataagcttgacttgagaccagcgatggtcagtaacaggctttgaagtggcaggattgcgttaggtgtgctgctgtgatctggtgctgctttgaccttgaaagcaggataacgcatgcacttacttacccccgcattacttgggtaccttaaggactagtggttcacaacttactttaggagcttttatttattctgtaacacgtgagatctggtaagacagtggggggtaaggaaaacagacaagaccatgactcttctttccctcttccccaaaacgtgcctcttggaataatcttcagtgtgccctccagcagagccgaaatcaggcaggcatagactccctcctctctcatcaaaccgcagaaatagagttccttcatcataaccgcaaagcttcctcctcccctttgcaccctgcctcagctgcattttcttgtcgcttctacatgggagtgcttgctgttctgggaagagtggggagaagcggtgggaatccttgagccaattgaaactgaggtcatcttcaggaaaaccatgtcttcctgaagttgaaagattcaggcacaccatacagtcctttcctcatgaataatcttgttctttactcatgggaaattgggagaggttaacccctcccaagtttatgtttgcaaattcatgtttatgggtccaggtgaaaaacttttctgaacacagcatgctacttctcttattacctctctctatttaaagaatggctaggctgagcatggtggctcacacctgtaatcccagcactttgggaggctgacat

SEQ ID NO: 68214 - DNA, 1034 bp, Homo sapiens
caagtaagggtgaaaataatcctcatgagagggagggatgtcatgtgcgtgtgtgtctgtgtgtgtgtagttgaggatgacgaaggaaaaacgaagaagaaaaagttgagctgaccaacaagaggttaggaattcagggaaggaaaaataaaagggtacctgggggatttttgccttgtttttctaaagtattaaaattgaagaaggtcgtggcgtaagacgttaagcagcagcttagttgtttctatcaccttgactcagatgtgtgttacggattctctgcggcaaaagagagacttacctcgtaattcatgtgccctttgcttcctctcctgcctgagagattcatggcatctcgggcccaattgtctaccaacttgtgcaagtcatctgtgaatgtgcccttcctgctggacgtcatggcaggaggctgagcttgggcggcttggctgttcactgttgccccaacagtgtttgtgctgctggttcctattataagcaacagaatacgagcattaaaagaagcctaggttacaatttcaggaagagggaaaacttcacgggatgatgaatggcaagccacagaatgagaagaggatgaactgggaagccatgcaagagggaagattccaaggttttgtttagccatttgttttggtataatagggtgatgaaaacagtttctcttcagtagctgctgctaaggctgaacaactcaggatgacggtaggtacacaggcaggggcctctttcagtccattcacaaagcacctaagagtattggaactgctcgccagtacgctattcccagcatcacgttgctgatggaggtgtgatacaatcagcaaggctagttgctctggaattttgcagaatgcagggaaaaagaggttttcttgtgcattgggcacggttaaagtaggagtaggaaaagatgcttggctaaggataaggagaaggtgggtttccaaaccattggacactgccacattctttagcctttttttttttttttgagatggagtctcactcta

SEQ ID NO: 68215 - DNA, 4227 bp, Homo sapiens
ctctttttccctgcattctgcaaaattccagagcaactagccttgctgattgtatcacacctccatcagcaacgtgatgctgggaatagcgtactggcgagcagttccaatactcttaggtgctttgtgaatggactgaaagaggcccctgcctgtgtacctaccgtcatcctgagttgttcagccttagcagcagctactgaagagaaactgttttcatcaccctattataccaaaacaaatggctaaacaaaaccttggaatcttccctcttgcatggcttcccagttcatcctcttctcattctgtggcttgccattcatcatcccgtgaagttttccctcttcctgaaattgtaacctaggcttcttttaatgctcgtattctgttgcttataataggaaccagcagcacaaacactgttggggcaacagtgaacagccaagccgcccaagctcagcctcctgccatgacgtccagcaggaagggcacattcacagatgacttgcacaagttggtagacaattgggcccgagatgccatgaatctctcaggcaggagaggaagcaaagggcacatgaattacgaggtaagtctctcttttgccgcagagaatccgtaacacacatctgagtcaaggtgatagaaacaactaagctgctgcttaacgtcttacgccacgaccttcttcaattttaatactttagaaaaacaaggcaaaaatcccccaggtacccttttatttttccttccctgaattcctaacctcttgttggtcagctcaactttttcttcttcgtttttccttcgtcatcctcaactacacacacacagacacacacgcacatgacatccctccctctcatgaggattattttcacccttacttggtaaatataaagagccaataaatactacagaagactgttctgctgtatcttacaggattatactagaagtatatgttagcgccacacattttataccatggcccacaccagacttgacacgtggtggttttgttttcagggccctggaatggcaaggaagttctctgcacctgggcaactgtgcatctccatgacctcgaacctgggtggctctgcccccatctctgcagcatcagctacctctctaggtcacttcaccaagtctatgtgccccccacagcagtatggctttccagctaccccatttggcgctcaatggagtgggacgggtggcccagcaccacagccacttggccagttccaacctgtgggaactgcctccttgcagaatttcaacatcagcaatttgcagaaatccatcagcaaccccccaggctccaacctgcggaccacttagacctagagacattaactgaatagatctgggggcaggagatggaatgctgagggggtgggtgggggtgggaagtagcctatatactaactactagtgctgcatttaactggttatttcttgccagaggggaatgtttttaatactgcattgagccctcagaatggagagtctcccccgctccagttattggaatgggagaggaaggaaagaacagcttttttgtcaaggggcagcttcagaccatgctttcctgtttatctatactcagtaatgaggatgagggctaggaaagtcttgttcataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgtttggattgctttcctcttgttgcacatgtaccatgcatttctcagcttggggtactacattttgtggaaagttaatctatctatctttccacatctgaattaatcattctaggaaagaatacttattcctactcatttcctttatgatgtccaaatggttgcaggatcataatctattgtgccacctttatttctagaagtacaactaatatgttcacattttcaaataaataatactccccgtaagtaataactgcaaccaatcagtgttattcagtgctatgcctccttgtaatgggtagttattaattattttcagagctttccggaaatactgtcctaactggctatgtttaggatctttgttatctctgaagacaaagaaagaagctaggactcttaattttggggtgcttcttgactcttagttgggaaactgaaaatatttccaaccttttacccacgtcaatggcatattctgggaatcaccaccaccaccaccactaccacagaaagaggctggaggctcctgtaccctgttcattccttaagggccctgcttcccttagtaagtaagtaagttggtctacggccctaaatatgcaaatgagagctgaaggtttttaaaaggtagaaaggaaaagggcaagggcttccacccctgctttaaaatgatttatttattctctgcttgtatttcttgtggagagagtaaggatagaaccaacaaggggctgagtagctgagaaaggggccacccaagagtgaaacatactttataccagaggagcagtggagcctcatgcagcacattatcatttgttatttgggtttaataataattttgacatcttttcactcatacacaaaaaaagtcagaactggtgttatttactgttgatttcatcctcctgtgtatgaaataacaagcctagaggaatgaactagtgctactgaactgtttaaattatttttgtgttaatagtacactttgagtatctttttccacattaaaaactttctgaattataaatgttttccttacattatttaacaatgtacactgttaaaaataaaaataaaaattcaaactttgggggtttctcagcagccgttaattgtacattttgcactaactctgggtgttgcgcttcttgtaagattgcgctttgtgcttcagtttgttacctttgtagacttatttaatgaaaccattcaaataaaccaaacttgcttttgttgagctgtggggtttcatttccagaagattccttcacattctcactggcactattttgagttaagtgcaatttataactggatccctaattcctgggagctcctttgctgtctccttaacttcgaaaggaatagaaacggtcggctgccggctagtactttcagacttccttatctcaggttcacagcttcccaaatgggtctgagccaaaaaataggaagtc

SEQ ID NO: 68216 - DNA, 1034 bp, Homo sapiens
caccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctcaaataagaaaggtttatatgacagtcactggccaggcatcacgtttgtttcctcattctttagtctttgtctttcacccagcacacaccattcttttaagttgtccaattttgttacaacaccccctcctcactattcccgaaacagaactttctgtttttaaccactgatgccaacctaacttcccaccctactcatcttacacctgctctagacaaagttgttgaatgacttaaaaaaatactttttcaatttccctttggcataaccactgctggactgctggggtcacatggacctacgatttccttccacatgccctttattgatctggggtctggtaagttgatgctaatggcagaagcaatagaagtccaaggcactaaaatgtccagcaagcaacactgggaaacagaagtattcaagtacagtaatttatacaattttacattcacatttatttatctaatacaatggaaatacaaagga

SEQ ID NO: 68217 - DNA, 1631 bp, Homo sapiens
ctcatgttgatgagatgcagagcagccccgttctggaagattccttgcagccttggctggcagccggcgtccgtgcctcccaagggttcttccctctgtcgtttgaagggttcttcgtgatgccacagcgtgcccgaggctccctcagtgacgagcgcgatttgcaggggtggccctggcagaaagggttgggaaggtacagacctccacagagactgtgtgtgctcatttccgtggaaaaaggacaaggaggcagcaaagacagacccagcagcccaggaaagattcaaatgcgattttacagaacatctgccctaagtcaaaaccaaagaaggattcctttttatcaaaacttcactaacacagaacatgaaattgtttggctcctcctgctcatggagttacaggacctagaaggcgtgatggatggaggatgtcaaatgcgattttccaggaatcgcaatctgtgagtcagggagaagcagcggagggcaagagccagttgaaggaatttgtttttcttctttccttctagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccggtatgcggcctaagtcccctcctttcctctgcggcccctcctgtgtcacggggctgcctccactcaggcctccagagccagccagccgtgcgtgtcctcccagcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgagggtgagcgaggggtgggagcagggccctgggaggcgtctgcaggaggaagtgtagccgcagggtcttctgattctctgcggtaaccctgggccggctccaaaccaggcctcgctgggacttctctcaagctacacgcaggagagatgagcccaggaaattcagatatttaaatctgctgtacattttcccgtttctaaagacaatgatttcttttttcccccgtggaactaagtgggccttgataaaatcttctagaattagaaatttcagggtaaagaacttttttttgcttcgaatgctttggccatctctacattagaaagccttggccgggcacggtggctcatgtccgtaatcccagcactttgggaggccaaggtgggcggatcacgtgaggtcaggagtttgagaccagcctggccatcatggcgaaaccccgtctctattaaaaatacataaaaattagccaggtgtggtggtgcatgcctgtggtcccccctactcgggaggctgaggcagaattgcttgaatccagaaggcagaggttgcagtgaaccaagatcgtgccactgcactccagcctgggcaacagagtgagaccctgtctcaaaacaaaaac

SEQ ID NO: 68218 - DNA, 1036 bp, Homo sapiens
atggtgaaaccctgtctctactaaaaatataagaattagctgggcgtggtggcacatgcctgtaatcccagctactcaggaggctgaggcagaagaattgcttgagcctgggaggcagaggctgcagtgagccgagatcatgccactgcactccagtctgggctacagagcgagattccatctcaaaaaataaaaataaaaattggctgggtgtggtggtgcacacctgtaaccccagctactcaggaagctgaggcaggagaattgcttgaacctgggaggtggagcttgcagtgagccgagattgcaccactgcactccagcctgagtcacggcaaaactccgtctcaaaaaaaaaaaaaaaaaaaaaaaaaaaaagtgaaggttttcatagcaacagctgctcggttttacactatgtttacatttagaagtatgagagttgttaaatgtgtattttacacatatttcatcagaaacattaatggaaaaagatcaagaaatgaagtattttggtttaagaatcagtagtacattgattatcagttttcagagacatatagtaaaataaacttagcatacagattatgtggaatataatttgtttttttttcttatttattttttgtgtgtggaatgtaattgaaatctgttgctcaccaagtctttcagtgtactagagtttgggttctggggtcagagtgcctgagttcaaatcctggctttgccatggtatgatgtagggcaaactgcttaatgttgtttatttcctaaccttaacctgtaccttaatttcttcatctgcaaaatagaaataataacagtagtacctaacctcttaagctggtcaaatgaattaattcatgtatttagaacagtttgggcacataattagctggttcactaacatcatttgaagtttaactgtgtatactatttttacttaataagtatatattaaatacatattatgtaccacatattctagatgctggtatcatagtagtgaacagttctcccagcactttgggaggcc

SEQ ID NO: 68219 - DNA, 1029 bp, Homo sapiens
gatctgccctccttggcctcccaaagtgttgggattacaggcatgacctactgtgccctgcctctttttctttctttttttttttttgagacagtcttgctctgttgcccaggctggagtgcagtggcatgatcttggctcactgcaacctctgcctccggagttcaggcaatcctctcacctgagtaactggtactacaggcacacaccaccttgcccaggtaagttttgtattttggtagagacaggaattcaccatgttgtccaggctggtcttgaactcctgacctcaagtgatctgcccacctcagccttttaaagtgctgggattacaagtatgagccaccatgcctggccattgtttttcttttcttttttttaaattaggattgcctgaaagaaattttttttaaacagcagcattgtcttttgtagttgagagatacataaatttattcaactaatctctttggaaatttaagcggtctccttgctggtacaaacaatgcaataattgaatatcattgcacattatgtccttgaacctgtgaaaatatattttatggagaatattttttaaagtgaaacttctagttcaacaatgtgcacattttaaattttgatagattgtgccaaattgtacctcagtgggattttaaatttttggtttattgttcatcttttcacagggagcctaggatagcagcatatttctcgtccctagtaatatttataaccctttaagaaaatgaacaggatctttaaacatgttgaaatacagtattaaaaatatttgactcgttgatgagcataaccccattacatcaggttgtactagtaattttgagatttatgtgagaatttcacatataattatttaaatagctaatgggtggtatattacatcaggttacatcaggttggactagtaattttgagatttatgtcagaatttcacatataatatttaaatagctaatgggtggtatattacatcaggttggactagtaattttgagatttatgtca

SEQ ID NO: 68220 - DNA, 1008 bp, Homo sapiens
tgatccacccgccttggtctcccaaattgctggaattacagatgtaagccactgcaccctgccaggaaagaggtttaatggactctcagttccacatggctggggagacctcacaatcatggcagaaggcgaatgaggagcaaaattatgtcttacatggcgacaggcaagagaacttgtgcaggggaactccaatttataaaactatcagatcccatgagacgcactcactaccaccagaacagtagaggggaaactgcgcccatgattcagttaagtacacctggccccacccttgatacatgaagatgattgcaattcaaggtgagatttgagtggggacacagccaaaccatatcactcactgtttggaaacgttacttttaacatatattaaattcccatatataatttagaccctgttcttgggctagtactatacagttttcgttattatagttttacaaggctacaatactttgtaagaaaccttgcaggtcagatgtggttttgttgtcaggaattttttccagtaatacttagtggacattatgtagtatccagtaatcacacacattgttttcttaatgaaatatatgaagtcacactatgtgggatacatataaacagtaagtaagctcagatcaggtcaaggtttgctgctagatgagttaaaaggaaaatcttattttcagaggtttttggatttttgcagtacaaatgaagaattatggatttgtaatttatgttgctgttgagggctgtcttccttccttgttcatctattttaaattgtttggttactcttgtatctttactctccatttgaattttagagtcagcttgttgagttacttgaaaaatccttcaacacctgtgaaaggaagggatctatagctggttagcaaaatcctgtagagatttttcactgggattgtgctaagtagttggggaagaactaaatcttagcagtgtttgtcttctcatccatgaacacagataactttg

SEQ ID NO: 68221 - DNA, 1643 bp, Homo sapiens
ttgttgagttctgttattctaataacttgtcagttgattatcttgggttttcagttagcaagtcagatattcagacattgagtttaatcttttccttgtcaatctttatacttcttgtttttttttctttttcttttttgtagacagggtcttgctatgtatcccaggttggtcttgaactcctggcctcaagcgatcttcctaccttggcctcccagagcgctgggattataggcatgagccattgcacttggcactttttttgtttgttttccagttgcatggtatgttttcagcgttcagttttgagacatctaaaatatctctaaaatattgtttactatgagtacattatgctgtaatcacattctgaatgcgtgagtacatacatggtagaagggctagatcttctttaagtgggggtaatggaaagtctctgagaagggaaatatttattattggaggatttaatgtgtgatcttttcattacagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctcccattcttgcttggttcttttctctggtttctctttctcttcgtgtctttcctttcagcatatgttatcttttttttttttttccaattcttctgagagtataattttgccacact

SEQ ID NO: 68222 - DNA, 1230 bp, Homo sapiens
ttcaaagacaaaatatttgaatcttctgaatacttcagttccagtgaaacagtccacaggattttcatgccaaaaaacccatatgtgctgaagaatggtgaacaccgccttatctagattccaccccttgccctaattaaacaccagtgctggcagcgatgcattctccgtatacccactgtaattactacacaatcctaaaattgtataactttggtccaaaaaacgaagggtgcaattttaaagtaaagtgaaacactgcaatgagatacagagacagagaatgctaattaatagattatagtcagccagcagtggggcctaattaaactctgcattcattataccctccatagccctcagaggtcaggcatcttccacttgataaagaagattggtttaataggatttacagtaattaaatggtttccccatttcagtttgagactggggatttaggtccattctaaatattggatctgattggaccatagagatcttgttctaggatcctattagatgtaaagacgcatttgcttagaattacttgatatgtgtggttctttattatggagttcttttagaagatgtttctgatataaatactcagcaatttttatgtctcatccttttgttactgaactttcaaatactgctggttggagagttagaatagtatgtaacagggaaggctttttctttttcttttttaaaattgggagtcaggaaggtttttggtgtatgtttgacaaagaatgaaaatctagctgtgagcttggtggaactgcagagctactaagactttggatggggccgggctcagtggctcatgcctataatcccagcactttgggaggctgaggtgggcggatcacgaggtcaggagatcgagaccatcctggctaacacggtgaaaccccgtctctactaaaaatacaaaaaattagctgagtgtggtggcgggcacctgtagtcccagctactcgggaggctgaggcaggagaatggcgtgaacccgagaggcggagcttgcagtgagctgagatcgcaccactgcactccagcctgggagacagagcatgactccgtctcagaaaaaaaaaaatactttggatgattttttttttaaattctaaacagcatttaaccagattatcatcatactttttaaattatgccttgaaataattctgtatgttaaatttagttggaagcttattttaaaaatgt

SEQ ID NO: 68223 - DNA, 1036 bp, Homo sapiens
agacagggtttcatcatattggtcagactggtcttgaactcctgacctcagctgatttgcccaccttggcctcccaaagtgctggaattacacaggtgtgagccaccacgcccggctgttttgatgaaattttttgaaagaatgtattcatattcctgtagatttcccatttcccacattccctcaaatttagtttccgtgttaatatcttctattaattttgaacagtgtctttattgtagtttatgcaaagtgaggagtgagtgccatacttattttgcttcctgttgagaataaactgaagttaaattactgacattttgcatattatctcaatcattttttaaggacctgtaaaacagaataaggtgaatcctaatttgctagatgcagatttcttgtagctatttttgattcctgcaggctgctctgatttgctacttgaggaggaaagctgatttgggggttttctttttgtcttggttctagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggtatgtgactacttttttagttttatgatttgttggttatcttttttttcactgattaatcagcatcttggccccagtgaatctacgtgctctgccgtgctggtggaagagaatttcatcctttgtattt

SEQ ID NO: 68224 - DNA, 1056 bp, Homo sapiens
tttatgtgtttttcatagagatggggattcaccgtgttgcccaggctggtctcgaactactgagctcaagtgatctgcctgccttggtttcccaaagtgtttggattacaggcatgagccactgcacccagtcaggactttttattcaaatggatttttcggttttctttaggaattaggtgatgctcaagaggagaaatcagatgaaataagttgaaaatctaaattgtgtgttattttttaaaaaatgcagttttaatattttcaagtagatacagaaataccaaataaaaatgttgtaaagtataggttataaaattttgttaataaatgaagattgtttacagttagcagagttcattttatttttactcagacaatttaaagttcgacactcatttattgaacaaatactgttaaatatctaccgtgtgcccagtcaatcaccttgtagtgtgcagaacagattcaacatggacaaactaggctgggaggaggctgacgagtttgtcgttttaaggcaggtgagagattattatggcctaaactaattaatgtgttaggtgttgggatggaagaaaacaaataattttaagagattttaaaaactcttttttgatacaatatggaatgcatgtaagaaatagaataaaacaggtgtatagttaagtaaattataaagtaagcaccctcataaccactacctaggtctagaaatagaactttcacagccacccagaagtcctgtacgtgaaccaacccagccagaactctcccttccctctaaaagtaaccagtgttctgggttttatagttatcatgcctttgcttattatacttatcacatctgatccttactatcatagtattgttatcttgtattatatgttaaattaatatcattcctaggtatcatccctaagaattatgtctttgttttgtctgtttttcaaaaatatgctttaaatctcttaattaccgatttgcccttaattcctccttttttttctcgtgcagttggagcatttcttggcttattagctggaatgacaattc

SEQ ID NO: 68225 - DNA, 1042 bp, Homo sapiens
attccagtccactgtggggggaaaaaacctgtgaacttagaaactacctatggctctttgaagagggaatgaggggaacagatttgattgtattatataagttattgttatttctagttaccattctgcctcaaaagtagacaagaagaagacctaagttgacacataagtgaaaaagaataataatgtcgtgacaggtagaacaactgaaggaggaactaagttcgaaagaggctcaatgggaggagctgaaaaagaaagcggctggtcttcaggctgaggtctttgccgtaagatttacctctttgtgtgcagtggtcccacagtgggaccctgctagctctatggcttctgggtggcttaccctttcattctctatggttggcagctttgcccattactagcactaaccagcctgctctgctctttaactgactcctgttcactagtttgacccacatgtcactttgtgtgcagtgagccttcacgtgttctggaagccttgtacctggtactttattgttgcttttgtcactctgtggatggtatttcaaagcctgtttctttctcaaccctttattgttggtttatatgaatggcggccttcttttcttcctaggtacaagaatatatgcagttgttctaggcctatcacctagagtttatttgaatttgaaactcttgagcaaagtgctttaccttatgtagacattatctttaagtctccagtgagtgattttgccacaaatgttactttctttaggacagatgtatagaaagtatttatctagtaaattgaaattactaagagacttatttcaggtatctaaatctagttcaatattctaatgaacttaaaatttcaattcagaacataataataaaataaatacagttggccctccatatctgtggatttgcatctgtgtgtttaaccaactgttttttattttcagggtaaaaaaatggatgttgtgtctgtgctgaacatgtacaggcttttttcccatgtcattattccctaagcaatacagtatgacaa

SEQ ID NO: 68226 - DNA, 1009 bp, Homo sapiens
gctgagttagacatattatcaactccaaattatagacgaggaaactgaggtaacagaatggtgcctaggaaaacacagctagtaagaggcaggatttggttttatacaggcagtcttcttccacatactgcttacaagttctttactgacctatactaggctgtgcacacatttgtcaaagtgtcagcaaaaactgcttctgaaaataattgtggctaagactggaataaaaaaatacagcatttaaaaaaccaaacttgggctacttttgtagatttgctatttatggtccactttatagtatatattaaaaagggaaatattttggtggaaagggtctaatttggtttatggaaaccatatattggctagagggaaggttgatcaataacttcctttttaaaatagctactattagtaatttctgcattgagtcagacaacaggctaagcacatttcacgctttattttactgaatccataaacagtacagtggcattcgtataatttctccttattactaattaggaaactgattaggaaagtaattattcagggacacatagctagcttagttctgataggtgaatgtctgcaaagccttgtgctcctaagctttgtattatatttgcttcccctttataatgtcttcccttctcagtctttaaggaaaatttgtgcttctaaactctgcttttcttttctttttttctttttctttatttttttgagacagagtctttctctgtcgccaggctggagtgcagtggcgagatctcggctcactgcaacctctgactccctggttcaagcgattctcctgcctcagcctcctgagtagctgggattacaggcatgcgccaccatgcccagctgatttttgtatttttagtagagatgggtttcactatgttggccaggatggtcttgatctcctgaccttgtgatccacccgcctcggccttccaaagtgcaatgattacaggcgtgagccactgcacccggccta

SEQ ID NO: 68227 - DNA, 1069 bp, Homo sapiens
gaggtttctaaaaccttttttgttatatctgcactcatcctgcatttgatccatcatgttctgaagaggtctcacctagaaaaatgaaaaccatttcatcagtacagtggtgttcagttgcttactgctgtctcatagtcatctaattgaattggaatttcctttccctccattccctttctaagaggtttcaaagaatatttagaagacacaataaatgaaaactggacatttccctattggttgaataagtttagtggttttttttggctcagggttggggagatccaaggttatgtcatgcaaaaagatgaatatgacctatcacacagttcgtgctgcatttagtttcatattttgtgactcagatctgtgaaagatacagataagaggtgtttgttttatttcttttttccttaaagtgttttacttcttttctagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtagaaacaattctgggatttgtggggagttggtttcttggcaccttttcataagcgttacctgtgctgtttttgttatgtttagaattgggaaatatgagtaatgttatgattaattcttcagcagcgtgatcagtcactgtgctaaaatgtaaccatcttatttcagttgttcttagatctaacaagttaaaacaggtgcagtttatgtttttaattctttaaacttttgccaagtctgtacttcaaagtatactctgacagtattaaaaataaaaggataattgtaaaagagaaatcattgatttagaagcttcagttcaacccctggtgaattttctagtcatgaatgacaatgagcttggttacactgtgtttggagtacatttaagtgtctttaagttgtgatattatgaataactgtatataggaaactggaatctgttaaagttctagatag

SEQ ID NO: 68228 - DNA, 1036 bp, Homo sapiens
tttatagctttattttaaaaattttttgtgggtgcatagtaggtatatatatttatggggtatgtgagatatttaatacaggcatacaatgtgaaaataaattatggagaatggcggtatccatcccctcaatcgtgtatcctttgagttacaaacaatccaattacactctttaagttattttaaaatgtaatagctttattaatcgtttttcacttcagtagcttgagtgcatgcaatacagcaaaagggtcagaagagggtgccagtgttctagaggtcagccgcacttccaagtttgctactgtaatagctttggatggaggtggcaggtgtacaaaccagagaaccaagcagttggttaatgataatgcaaacatttaaaagcttgtcacagtctaataaatgacttttcccccttggcaatccatgcttctctttgtacccccctcaaataatattcttattagccaggtctcacccagatgggcttgtgattggtttcttgtaccatagagaatagattgtatttattgtcattcatgaatggtttttagtttttagccattgcaggagtagctgagtctcagtgattatttctgtaagttactagggccactgcgcaaatagaaccatctcatcataaaagataaaagaatgaaagctaactttctttggaatttgggatgattttaagaatgtaatatgtctatttattagcattgcttaaaaaattactctggtggcacttgacaagagtcaccttttccaatgtaacttgccagtgttagagcccagtaaaaggcagtttataccagctctttgaaagttttcatgtgtttctataatttgctcttagttgatttcatcttttctgcagctatcccagacttcgatctaacactcggattactaaattaagtatatatgaaaaaagaacatggagcatggagtttttctttcatttttatttttagagatagaatcttactctgtcacccaagctggagtgcagtggcatgattatattaatagc

SEQ ID NO: 68229 - DNA, 1033 bp, Homo sapiens
agaggaaaataaatctattgtttaaagccacctggtttgtggtcctttgttagggcagtcctaagagagtaaaacagttaggtttttctggatttctagctcatattcaggtcattatcaggtattttcaggtttttatcaaagcatttcaggtattatcagggagactgttaagatataatgtcatgtcagaaataacacaccaaaaataaggttcttattctctctcgaagctaaaacccatttagtcttcttcatcagaaacctgggaacccatgtttgacttatctctcttttatcccttatatacaaccaataaaagtcaagctcctagacatgacactgatgctttccgtggctaaggccttgtcttctgctgcacctcacataacttaccacctattctatgctttagcaattctctattcatagctctctgagaagttaacatcctttctaatcttcattatttgtggtatctctgctcaaaggttcttccattatcttcctcaccagccatcttctgctcatctttacatgctttgaggtatctccaagcaatctgagtgcttcttttctgtacttttagaaaatattctctacacttctgttgcagcactttctataatatatttatgtgatctattttggcaacattcttctccattaggttgtaacttcagcagaagacaggaaatatcttagttatctttgtgtctccagtaaccagcccagtgtaacttttccgatatacaaataccatgactttctcctgcttaaaaatcttcactgacttccatttgcaagtaggataaaatttaagcctcttattttagcaggcaaggatttatgatctactatcttttcaggcttgtctcttgtccttcttctgttactttatgccaagcaataccaaatgaatttacaagtatatcatgctgtttcatgtttctagattttaaagtattctatttcctcttcctagatatccatgcatttctctctgccttcccttttgtatctagtgatgttc

SEQ ID NO: 68230 - DNA, 1045 bp, Homo sapiens
tctaaaaagtagacctttgcttttgctttgtatggatatctaagtgcattatggggttgtttttcataaaagcctcatagcctatgactagactgtattatctgatatagccagtgttatgcttggtgatgctttttttcccttttcctcattttagattttctaaagcaatgtagcttcacttggaaacttgttagaaatactgattttgaaccccaaccctgttgaatcagagactaagggcttgatttagccctccagatgattctgatgtgcatgaagtttgagaaacatagttgtagagattccattgtgtaacggtgagcacactggactctgaatccagagaaacatagatgtagataatactacttttatagaataacaaaactcaacctctttataacctttataacatatctatttgaaaggaattacattcttttctttttaattcatcacttgtaaaactcctacattcttaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaaggtaaggtacaggtgtttcgagttcagtggcccattcctcatacatcttcactcctaccactaagttatttctaaatgctgtcagagtttcttgctcatttttcagtttatatttttgtgattagtaatttggaactcttgttgcggtaggtagattgttaagactgctctatatattcagtttttaaaaatttaaacactgttagtatcttccagtagtgcttttcatgctgtttctcaaaagtgccttgtaaattgccaaagtgtttgaactgacattcttttgccccttctgtcttttattgaaactgtaccaaattggtttagtacatggacttgggatggtacaacttcatttatgtgtttaataagatgacaattttaagccgagac

SEQ ID NO: 68231 - DNA, 1024 bp, Homo sapiens
ttgtttacacaatcatcttttgtgcccctacatcaagctgcctcctattgcctatttcgtcaccttctttcttcgtagatactaagaattttctcagttacttctgcttttgtttgcatcttcaatctcttcgcctttgttgtcccctctctttatgtgtaatatgatcagctttctattgaaatatctcctgatcttggtactccttatggtcttcttccctctctccttttctattagatatatttatagccttctcctgcccatgaaggattgactgctacaggaatttccctcctacaattaacaactcaaaaactgggaaaccacgtgaaacaactgattttagacattggacaacattcagtgcagaacagtgctctcatcttaccttccaaacttatatgatttttgtttcttaaaatatacttcatatgtgtatcaaggttaagggttagggaagcctatatttaagacataaaagatttttttctacacatgtgaagccttaaacaaatgaacttgggaaaggacttatcttaaaagtatagctgttactttcaccaagcgtttaatacaattatataaacatttctcatttactcaaggtactttgcttcagagctttctgaaatatttcctaagaatatatattttctcctttaatattttttcaaaccattttaagggactaaatatattctgttgtctattgaataagaaaaaataaaacgtctaagcttttgtcttctcattaaacacattatacatacatggctttagagattccagaagacagctagggacttgaaaattagtttttaattattgaaactgttttgtattccaaaatgcattaacaatattagttgacttttgtaggatcctgaataaaaatttttttctcagatcttagtgtggttctttcaaaaaaatttttcttaaacaatttttttttccaatagagatggggccttgctgtgttgcccaggctggtcttcaacttatggctgcaagcagtccc

SEQ ID NO: 68232 - DNA, 1038 bp, Homo sapiens
atcttgaaggaggtggaaaatgagaagaatgacaaagataagaagatagctgagttggaaaggtaagaaagtgaagctgattggggcttatgaggttaaagtatggttttaaaagtatgcttttggggacatactttttcagtgtatctaactctgaatttaggttctcgaattcttgctattactgtattagctgccttttttctaggtcagttgtacgttctttgttgaggtgtctgaaaggcaacatagaatgggaataaattgggaagctatgggctgtaacataattgattggcaaaaaagagagtattcattaatttaaaattaaagttttttttactggcaaatcaagagaggacaaatgtctactttttaatttctctatataatgatcaaatgatcctcaagcaaaggagttaatcttttatcactagtttagacctttgttgttgagctaatgctctgttgggctataaatttttagacttttcacagtttttattgttgaaaagcacgctgttacttcagtgcattagatcaaaattaggaggagagacactttgaggacaatttaggagccacggatatgtttttttatgaagctgtctctgacttggaattcttcaaaatattctgtgtttgaacagatctaggcagacaggtctcctataatttttttggtgtgttttcttattattttatgctaaaggtcaagcatgtgcctcttgacctcttcttttacaccacatatttaacataaatgtaaaactgtgcagaaacaactctgccggtagaactttgttaattacctgtattctgaacagccagaaagactgacagtgacagaaaggggtcactaatctacttggccttttgaggactgatccttaagaataatttttttttttttatgatcttgaaggctgagaagtattagagtacttccataaattttttactaagttttaaagttttggggttagtggtagacttgatactgtcctctgaaggtattattttttcctattctatagt

SEQ ID NO: 68233 - DNA, 1025 bp, Homo sapiens
tcactgtttattataatagttgggagcttagcaattgtgaatctaattttaaagcattaatttatttatgaattgctctaatttgtcctcttcctgcttgaagaatggtaaaacatctatgttcactatgaattaaattcagattagttcaggcaaaacagcagttgagagagttttaataaatttactaaaccattaaatccatggcacctcacgataggaatttactaacatctgggttttcttgagaatttagattcaaatcaaactagatgttaatctacttataaggaaaaagaaggaaattcctcatttcacaagttctgttatgtctcagaatgttttttcctaaatatacattccagaaataccctccttttactcttttaacttatatttagatgatactccctcttatatctcttcccagagaaacagtattgaaaaggataataatgaggcaagaaaatcattgtgtgttttcatcttttccagttaattcatgaattcagaactatgcatacattcataaaaccatgtgcatgcacacacacacgtacacagacagacacgcatacacaggacgagaaggtgggggtaggcaagagattgatttaattgtctcacaattttctatacttttcttggttgcctatcatagataaaaccattttatcttgatagtcatcctttagcctatagagtgaaggtgaagaaataatagtggtgaaactaaagataggagatttaaaatatgaaaagaaaatggattaagaaaatcaaagaccaaaaacttaaaagaatcaaagaccaaaaaaatgtgccatactgtactactttgtatatctagtctgatataggcaaacaacctattttgagatacaaccatatctctttttagaaacaacttttaaagaaaattttaaaatattttatgtctgaagtagaaaatttagaaactgtaaaaaaatgataaaaaagaaaaaaaaataggctgggcgctgtagctcactcctgtgatccca

SEQ ID NO: 68234 - DNA, 1218 bp, Homo sapiens
tgtaaactataaatgaacagttcatatatatatatgtagcaaaacaataataaaagcaaagggattttaaacataaattttgagatataggttgttcttattaatggaggatagaccaatagtagagagagacacaatagggagcttcagaagtaaatatgatgttccatttcttaagctaggtttatggatttttatgtcattattttcatatacatctacattatatacagtgtattgaatgtttgaaatatttaataatggtaaaattagagttgttttacaaagctttctttttctatcagccattctaatatttcagtgcgtcgatgtcaaaaatactgcttccgtatttccaaaatctctgacttggtttctttttagtcatttcaaatgatcccgtgcctttcttttgttttatgatttcattgttcttcgtagaatacatgctgaaatacatgttctttatgggaaaacttatttttgtaaacgaatgtgctaccattgagaggaacgaatttggaattgttgaaaaatttcgcagcatgtatttattcgttggttttcagccattccttattgtcactggtgtaagtctctagataaacatatttgtttctatacatacatatgcaaagcttgatttttctccttctgtcattaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggttagaacacaaggagaatctgaaaggatcgggtgaagacatttgatccgtaatcgcatgttgtttttctcttcatctttatcctcctcttttttctctttctaaccctgcttgctgccttcctctcagaccaactgtttagcaatgaaggaatggctttaagtagaaaatgcaagttttattccacagctttatgaggacacctcagcataggagaaagttcatcttgcttcaagttgatcacacttaattggtaagttcaatgacagtttaatgagtgggttatattaggcttcagggttgtcagtatacctctttgccagttccattcattaaaatggattgctaatcttggtttgtgtctttcttccttttttctattcttcctttctcttttccttctacctctctaacctcc

SEQ ID NO: 68235 - DNA, 1003 bp, Homo sapiens
gctgcttactgcactttttcatgtaggcttaactgcagggaaagagtgttttgatattcggtcgaattactatctcatcaaagctggctttatgcttagagagtagttcaaaaacaactttgtgcttttaagtaatcaagcccttgccacctctgctgtctaacacagttttgttctctctgttacagagagcaaatttctcacatttgtcttgcttaactaacttgagcctttgctgttaatgatatacttcttcagcctccttctttcctttccttgctttctttattgtgtcctctgtgacgatatcttgttgacctggatttgcttctgatggaaagaacatttaataagcaaacagccctttcttaataaataggctctccctgggttaagtaattaatccacttcacctagtcttccatcattttctaggacagtctccgtaagaaggatgacaggattgaagagctggaagaagcactaagagaaagtgtacagataactgcagagcgggaaatggtgctagcacaagaggaatcagccaggaccaatgctgaaaaacaggtctgctattttatacagttccaagcaatgctgctggttaaccaaaaggtaacacacaaccagtatagtttaggtaaactatacatattgtatgtttatagggtttcaaaaacacttcatagaggagaagtcccaaggagttccttcatagcggtattagatacaaggatgtggtttcttttgtgtcaagtatagaaagaaagaccaactttattagcaaagctgagagagaattgatgaacattttgcagaatgagtgcctttcagtgccctgttcctagataaatgccttgtctactctttcttaaataagaattgaaataaagttgtatgagaattgactcatgttaacacagaagtccctgcattaataacttaggtctgatcccatatatatttatgtagcatgtgctaatgtattggacgagatgaaatg

SEQ ID NO: 68236 - DNA, 1034 bp, Homo sapiens
aaatcctacttcttccataaaaccttttctgaccttccaagtctgagttacatgtctctctcatgtttttgtttttctttttctttttctttttttttttttgagatggagtctctctctgttgcccaggctggagtgcagtggcgtgatctcggctcactgcaacctccgcctcccaggttcaagcaattatccctgcctcagcctcccaagtagctgggattacaggcgcccgccaccatgcccagctaattttttgttatttttagtagagacggggtttcgctatgttgaccaggctggtctcgaactcctgacctcaggtgatctgcccacctcagcctcccaaatgctgggattactggcgtgagccactgtgcccagcctctcatgtttttcaactgcacttgtacttagtcctgttttttttttttaataacactgcattattattacgtatttactacctattgctttaagagactgtctccattttgtctcctagaatgaaagctccttgagggcaggagctgtgtcttatttactgttgtatcctcagcgtctaccattgcacctggtacacaatggcattcaatgaatatttactaagtaattaaattatgagcgaataaatgaaattttgtcctgacttaatgtttgcagcatcactgtacttactaaacaatttaggatttaatggtaattttatcatatttttatacttatctaaacagtgttttgaaatgttttctttgttgcaattgcgtttccactggatttgataaactactttttcatctgaacagaagaacttaaaggtgtcagaattgtagatttaaagaattagaatagatatttatgtgaaagttatttacatttttgtgcttgattttaaagaatggtagccagagtggaaaaatacaatttagaaatcattattatccctgacctgtccttcagtggcaaaacagagggcttatatgtctcaaaaagtgaatgtgcaaaattgtaggcccactgttgttgacctctta

SEQ ID NO: 68237 - DNA, 1041 bp, Homo sapiens
ctgggactgtgaggatgctgttagctgaagacatttaacttgctcacttctggaaggataaaaaaattcaggtgccaaaaaaactaaatgcatttgcttactatcattgtttaacagctgttaccaatcaacgtggaaactttgtttaggtaggaagcactaatttccaagggtcagtgaaacaactttgatttgtcatgctgatttttgactctaggtttctctgttttagtatcacacaaatggggtttatgtaggagtcaatgaatggcaaatgccccacctctacctgccctaccttctacttctgaaaagactggttattaccaagattatttcttggcaattaacaacctaacataaagtcttgtaattgatgcagttggctgtttgattacatttgcttctgaattaaaatgaacaagtttatttaaataattctgatttggtagccacctggaataagtggaaattactgataaagtacttaccttgctctcttagtttcttttccttatgttttagcattttgtctgtcttctctggtggctttttgtttgttgtttttcaggtctgttgctgtcaaggctttttttttttccccatgtcatttttaaagcattctgtctcctttctatctggtatgtacacacacacacacacacacacacacacacacacacacacacacacataactatataggtatatagggatatatttccttcctgcctatataatatatagtatatatataatatatatatatacactgcctatgtagtatataggtatatatatgcctgtatagttatataggtatatagggttatatttccttcctgccttccttaaaaaagaaaccctacctacctggatttagagcaagaaattgtctgattgaattctagcagtttctttaaaaagaaattcttcttaatgatgtaaataggaaaattttagtttagaggactaaaaattattcgtctatgtatacaggaaatctgttatttgccaagtttatgtcttttatttcctaaa

SEQ ID NO: 68238 - DNA, 1093 bp, Homo sapiens
aattcctaaaatcttctggaaagttcaggcaaaatggcgagcttactggggaagagggctgttggttctgaggttgtatgaagactaggcaatttttaaacacattttttattgtaaacatttccaaaggtacacacaggtagagagaatgaacccccatatacctgtctccaagattcagtagttaccattttgccacactggaagccaatttttagaaaattgtcacttttagcagagctttgctatacacattttcctgcttcccccacattttgtaggttgctgagaccataatctgttgtgaagcatgtatacatctgctaatacatagtagatgtttcttttacttctcagtgaccttctgtttaaaacaaacatgtgtcttttgaaaatccagttgtaccctctcatttaccattcctaatccttccccttacctaaagaccctactgctattttactgaaaccaggtctatcctgggatccctcagttaccctcagttaccctcgttctgtgagcagttatctttatttttgttgtcttcttttctgtctcagagaataggtttttttctccttcataaggccagattcttctttctgtcacagatttcaagtccccgcctcagcagcctttcactgtcagttctttctcacgtgacccttgctcacttcttctctgcataaatgcacagtctgtctttggcctaaaataaaattttttcactccaactagtgctttaaactgacatcagtttacttttctgctactttgaactatcagtaaactttgaatacctgaataatagagctgtacagaatcttgccataataccttagcatgaattctcatgggacatgatgattgtgatattgtgactgcaacccaagaatgttgaggtgtcctctgtgctttcacgttcttgggctatagtgcaaggctacgagattctgtccttttagaaaagcattatgagtgatatgtcttggaagtaatgtgtaagtgaagccggaagtggattggcatagggggagaattaagagaggttagagttccgagtagcatcatcagaaaaaagcttgcaggttt

SEQ ID NO: 68239 - DNA, 1030 bp, Homo sapiens
gccccacccccgtaagttatttccacttaaactcatcagctataactgaattctttgttattagcacttctcctgctttggctaaagctcaatacctaattattattttctttttatgcactatttttatgagtttggagcaagaggggagggtcatgttgggttccttcacaatatttatcacaagtacaagttccaatttaagctaatttattttcagtctgttaggatttttttctccttctctcctaatttttgtcaactgttatttttgtaatcattctttttcttcctgaagtcttcaaaatccatcagatggatttgattgttgctttttagatatatatctgttgcaaagtttttgccattgcttatgggatgggatgaattacagctctcttaaacaacagttttctgtggaaaggcagcagaaggcaatgatgaaagatgtacttcctgctcttcatctctatttctgaaatcttattttgtttcctgagtttctgtaagagttacttctgcttaaaacttctgcctttacccaaactttatggtgtcttctggaatagtttatttttccagtatactttaaagaaaaaaaaaccttcggttctcagcctgctcatgacatccagctcctgttgctttggctcagagttccattctacctcatgataaacaccttcgtatctcattatatcttaaattctctaagctctaggagcagacttacagagggagcatactgtactatttaaatgagccatgacaggcctgggagtggaacttactgctgggaagtagaccaggtggtattaaaggggcttgttccatgtggcaattgctccacccgttaatactgaagtagaaaattggaggagtaaaccacgttcagttgctaatttcctgtggagataagacagacacactgtgcttgtgtatttccatctctccatgtaaaactgtattggaaaacatttctttttatttctaggtctgatttttttgttgtagttttattttattggca

SEQ ID NO: 68240 - DNA, 1015 bp, Homo sapiens
tctccaagttaactgccagaaatttactgtgtaattctcagctctttgtaattttgaagaagaggttatggaaaagcatttcctctgtgggagtaattatgtgtcagaaaatgccattcctcaataaagggggaaggttcacaaagcacagaactttgtcctatttattccatgttcctgacttctgaactgatgcttgctttctgctattttatgttctatagtgatactttcttcatttttcatcccttcatctcaagtcagcgtcagttttattgctttaaaagtcaacagtgatactatccagttctgctaagagtgaaactttaagaataaaatttgattttaattcatcccttattatatgtgagtatattttttatattcgctttaaggatagtatttacctctgtttgttagctttctgctttccttcgtataccaaatagaaaaattctcattcactcacccccaaagcatgtgcctgttatcacatgattcagtttgagtttctatattacacaatttctgtttcttacattgctttttcctatttatgtactaagctctctgtatatgcaggatactgttaggtatgatatgagatatttattattttctttcaagtaaataaacaaccattatccatgcatagctggtcagtcccataaattttagtactaaaatatcacttggattattttattagcaagactttattgtaatgatgtatttcagattttgtctttccatttaggctcatatatgttacattttggtatcattattgaaacaaattcatgaattgagttcatcattagaaaatgaaagcctcagaattttggtaattgttttggaccatcacaaaaatgtgcttggcatatttaaattctgtatttttttcccttacctgtaataacttttcaaagtacctaaagctatgatagaaatggaatagcatatagaatacttgtgtgtgtgtttgtatgcaggggggcggcttcttatttttacc

SEQ ID NO: 68241 - DNA, 1766 bp, Homo sapiens
cgccatcgcactccagcctgggcgacaaagagcgaaactctgtctcaaaaaaaaaaaaaacaaaaaaaagataaagcaaaaaatgcagggatagagaaaccatggcaaaaggtgctaagtgctgaatttaagtgtagaacctagactcaatctgagaggacatcatcccatgtctgcctggtattgtacagaccctcctagtcttttagctagctcttaaaggataaatcagagaagagagcgttgcgcgtattcttagttgataaaatagcagatgaaaagtcacagaggtatgaaatattaatattaatgtgtatttgaggaactataagaaatttagtattgctagagcaaagaatgtttgaggagaattttgaggaaaaggctagaagggctttctatgccatgccactaatttaaattgctattctatagcaaggaagtgatgtgatccaatccatatttcaggaagatcgtgctgaccctgtaatccattacatgaatgcagacagtaacactctcaaaatttattaaacacacttaatgaaataaataccagtatctatgttatctgccttttttgcctgtcactcatgcggtcctcacaactccttccagcccctaaactaatcagtccgggcattagagagctttgaaatgtttattaagaaaacagtcctgttttgacagacaggagttagagcacctggacttaaagcaggctttacagctctactggggatctctcatgtaggcaacatgaggccagcagagccctgtgcaaacaggcatcataagcaaatgaccatttcttttccattatagacttcatccttcaaaagggagtgccattcgtcccaactagtattttccccccttttatctgtgtcactaatgctaaattagttcatgggtcattcaaattctagcagctttggtgttagtctttatatttcagttccagtgctccgctgattattttggcatgaaactatcccatacagtcatcatgctgcttttaattcaaaagattcctatgagctgcaccaggaatatcgtatctagtacaaaaactgtatgtctgttcttccctgaagcagattctcttgtaacttgagtttagttatcttagtattgatattgagttatttttagagagttctgtggtggttagtggctcggtgttttcatcagtcgttcacttaactatcctttcggaacatctgtgccacttacgctgtctcacttctcacccaagtcttagatgctttttcattcttcatattactaggaaagattaaacacatcatataatgccagtgactgcaggactttcctttaaagcttctaaactacctgccagtatgctgaaataaggtatattctgaagcttatcgtttaaattgtagatttcatatgtaaaaacattttttttttttaagacagtcttgctctgtcacccaggctggagtgcagtggcgcgatctccgctcactgtaagctccgcctttcaggttcacaccattctcctgcctcagtgtcccgtgtagctgggactacaggcacccaccactgcacccggctaattttttgtatttttagtagagacggggtttcaccgtgttagccaggatggtctcgatctcctgacctcgtgatccccccacttcggcctcccaaagtgctgggattacaggcgtgagccaccgcgcccagcctgtaaaaacattttcatctttgtttataaataaaacatctgattatac

SEQ ID NO: 68242 - DNA, 1005 bp, Homo sapiens
cagtgggtaagtgaagtcagggaaaaacagaaaacaatggagataagaggatgggatgcgttcagtttattctgttgttctcaccacagtaattgactcagaagggactcattctgaatttagtatctagtgttaaaagaacaggcctggggcaggcggaggccagcactgagacacagtggtgggttgagacctattgtattttttaagttgttccaaggctgtccaggtgtcctgatttaaagcctgcttcttaagtcaggaaattgtatcttgttctgaggtttactgtaataaagtacacagtcctaggggatggtacttctggctccatgaatcactttacaggctggctgtactgacccaagcctcatgatttatttatgccataccacagtaggaatggcaaatatgtaagccacacatggtctatgggatgggcctttaactgggaaactgccataaatccgtgaagtcaggtaggacagagccagcaggagctcatgtcgtgtacaagatttcttcctgttttatagggacttacagttctagagctaattaagttcatcctccttagagtgtatctgtcttagtctgttgtgtgttgttataaaagaatatctgcgcctggataatttataatgtaacaaggtttatttagctcatggttctgtgggctaagaagttcaagggcatggccctggcttctggcaagggctttcatgctgcgtcacaaaacagcagagaaggtcaaaggggaaggggacacatgcaaacaggagaacctgagggtccatcctggctttatcacaacccactctcctgggaactaatctgttccctgcaatacctaatgcagtcttgtcagagtgggaactcactcactaccacaagatcagcaccaagccattcctgaaggattcatgcccctgtgacctgaacacctcccatcaggccccacctcccaacaccatcatactgggaatcaaatttcaacatgagttt

SEQ ID NO: 68243 - DNA, 1107 bp, Homo sapiens
aacagtcctttatcaaatgtatcttttgcaagtattttctcccattctgtgtcttattttctcattctcttaatatttgaatatttaaacacatattatttataaattaatggtacattatttataataatggttaaacggttggtaagtaaatcactgctgagtatatactgctttgaagggcccaaggatccattaggcctccagctttaacccagcacagcattctgaaatacccaattctccccagagtttcaagagtcaccaggccttaaccttcttattgcctcaaggactcttagagctcaccaggctcctcctaccacaagccttcatcatatcaccctgttcctgttgcttagggagctttctcaggatagcatttcaagattgagtacccatcctagttttctcagtgttccttgtgagccgtgtcacatagaaggcatttaataaatgtgtgctgaactgagctgaaccagcaagggcaaaagggatttaagagactgccgttttaattgaaaaggagtaaaaagacactgggaaaggcagcatgtattgggggaatatgagaaatttccaaatcactggaccatcaggctggaaaatttaggttggagccaaactgcaaatggtttgaatgtcatcatgtatagtttatgtatttatatatacttacctttctcatagaagggtgaatttttatattataatagctagaatgttcttagaatttatcttcttaattcagaaaacatcacattgagatctgtcagtaaaccccccacacacacaaataatttcttgtcctcattgaccttcggtctgagctcttaatgcagttttctctactacacttgtccatgcacatagtggtcgcagacatttgagagaatgaaaatcatgtgtttaatgagagattgttatcggagactgtagcacttgttttactttattctttctattgctttttctctttttgtttctttcaaagtacatacaaatacatattcattatatcctatgtaagggaatgtgtatttactctagaataggactactttaagtttgagatggctttttgcttttaaaaatatagatgagtgt

SEQ ID NO: 68244 - DNA, 1060 bp, Homo sapiens
atcaaagatagacattactcagaattcatatgattatatgtgcaatatataatcaaaacattttattctcttgactatgaattgcccttcttaggcacctatacatgtagaaatcagtgtcaggagtatacgttgtaaatggaaagcagaaagacatgatgatctgttaggggatttttagaggatgagagccatggtcataggagagaaagtttgattctgtatagtccatagcatattatcattgcttagtaaaaaaaatagcatcaatgaaataaaatctctatttgaattgcataaaaaatacttcaaattatatatcttgttaaaaagacactattccaatggctcagactccaatgccacattcctcaaaactttgaaattagaaatctaagttgtcatctgttatttcatattgtgatttgcaaagttgacattttaccccagaggtgaactgtaccacactagctgtccaagcataccatttatgaaagagtttggaattcagtcaagaagcttcaacaatatggaattatttttactatgtcatattacaatattttccttaagcacaaaataggcctcaagtctgatcgcctttgtattttgcattcagcaaaggtgctggtatttcaatctaattaggtagagtaacttatctgtcattcacctgctgctgcttgcctgctactaaatatgtgattctgactattggtgcacagaaatgtagcacccttattgggaaagcatgctgcctcttccagcttggtcagtctttgagcttcccgaaagggaacagatgaccgcagtcaacaggaaactgcatagttagaccttcttgaactctttcacctttaagctcatttcaccacttaacatatttttttcaagtggtcagtggatatatttagactgtcattatccctttagtgttgactggatcctcgtggtataagttgcctgccatttcttagaattacgtagtgtggggacagtgcgatgagaatcttctctcctcttccagcagcaaaactagtgaaacaaatctttatttcca

SEQ ID NO: 68245 - DNA, 1042 bp, Homo sapiens
ctccatccgtaaagaaccagaaacaaaaaagaaacggtgcgatttgtttcccttttcactgttccaggctgagcatcacctttcggtacacgcggtctttctcccgtcatcccagcactacttccttgagatgagatgacatcaggtgatcccgttggtcttgagaatgatcccatattcttcagtcaagcattttcatacagtagttttctactgtgttatgtgtattttacttgcttaatcctccaaagaccgctttatttccctaatcactaagttcttgatgggaagagtatttcaccgttgccccaagtactttcagtaggtgtggtatgaaaaaatacctgaatcaagtgaataatattttgagtaactgtcttttattaacttccgtccactctctagtgaacagttttcagtctctcttgtggcactgcctatgatacctttgctcttgttgtttcatcggtaaagctgagtactttgacattcactgattaggttgggaaaaccagcctatgctttgaattggccgtttctgcaatctagcagacattctagcacacattcactcatctgtgaacctgcatttgtacatgctttcacacttccccatccctattagaatgccagttaccatgataacacgattcaatgctctgtccacatatcccactcagaaacaatttgtcctataatatggacttgctatctttcaattcatttatttagggttattttactcctttgttgttagcgaaaagaaaatgtatataggttaatgcctttcttattttgactttaaccttttttctcacatgatgtagagctggccattggcccacctttaaatggctgtatatcatctatcttttcctcctcgtggaaaaggctactgtctattatagaagcatggtgtactaattatgaagttgcggttgaaaagacactttatcatcactctagccacttggaactttccaaataaatcattatttggactaaaatttcccagtcttgtttatagtacaaaggtgaatac

SEQ ID NO: 68246 - DNA, 1033 bp, Homo sapiens
aaagacagttcatgaagtgcttgatttggggatattgcctcttccccaaaaatttctgtatcaatttaattgccagtcttagcccaagctgccataataaaatgccattaactggatagcttaatcaaacagaaatttattttctcacagtttggagaaatcaaggtagtgtttgattcagttcctagtgaaggttcttcctggcttgcagaggctgcctaattactggatcctcatatgacagagatataaagagaaatccctctatttttctcttcttcttcttacgaagcccagtcctatcagattaaggccccacccttatgacttcatttaaccttaattacctcctgaagaccctgtctctgggtatggtaacgttggggtttaggggttctacatatgaatttgggggaggcacaattcagcccgtagtattggctaaactctttccagtatcctcagaaatcccatatttagtttattttattgcagacaggattagttttatcctttcttatggaactcttaaaatactcgttactttacagtgtgtcatagaaactttacttaaatttaaccttatgaataatttcttcctagacgcaaaatcgaatgaagctaatggccgacaactacgaggatgaccacttcaaatcctcccattccaatcaaacaaatcacaagccctccccagaccaggtaagatggctctggaatgttttattaaaaaacccacacacttaaattttgaaatgtttttgtactagcatgttgcaaattctgagatataagttagaagaataaaaataaatagctaattcagttctgaaaactctactcttttcaaaaaaatcacagattcagtttctttataggaagaactggatattttaagagcagatacttgaaagatttgaacaataaagaatgcttgaattgggttgagaaaaaaattaacctcagagatacacactaataatatgtaatttttaactgtctttactaatttttaactgtcttggttttcttt

SEQ ID NO: 68247 - DNA, 1049 bp, Homo sapiens
gtcattggcgcacagagtgtgcttgcatttaaagtaattttacctttgaagactgcacctggaatcctttgtaaattttccacaatgagtatactttttgttgttgttgttgttttgagacagagtctcactctgtcgccctggctggagtgcagtggtgtgatctctgctcactgcagcctccgcttcccgggttcaagcgattctccggcctcagcctcccacatagctgggattacaggcgcacgccaccatgcccgactaatttttgtatttttagtagagacagggtttcaccatgttggccaggctgctctcaaaatcctgacctcacgtcatctgcccaccttggcctcccaaagtgctgagtttacaggcatgatccaccatgcccgaccacaagtatacatgtatgcccagaaataaaatacaatatttttgaaaagttggtattgtttgcaaaaaactatccagctcccccactctaaattctctacttgattgaaacactgtcttccttctgtgactggctgtgttgacatgcctgtcataggtaggaaattccagcccagaactggtaccgtaaacctgctgattaggagtctcttacagagcccagcagccttccacagcagaactttggtgtttatcgtttatccttagagagagagagagaattttaaaaacaaaagtaatgctaaattgattaattttctctggtttgtctagccaggctccagcttctgtgtaatatactgtataggcctaaactgaactctgatctttttagcaagctgaagattgttttagccactaagcccttgctctttattctcttttaattatttcctggaaatagtattagaaacaaaggaaatgtgctatatgtattatgcagccatgaaaaacatagtttcggtcatatataatgtagtgaacagtactgacaatataatgttaaatagataatgtatcaagcaaaatgtgaggtgtgatactgttagaagctgatttatataaatttattaaaagacttggcaggaaaattt

SEQ ID NO: 68248 - DNA, 2100 bp, Homo sapiens
gggactacaggcacccgcccagttaattttttgtatttttagtggaaacggggtttcaccatgttagccaggatggtctcgatctcctgatctcatgatctgccctcctcagcctcccaaagtgctggtattacaggcgtgagccaccacacccggccaaataattacttcttgatggaagtgtatgcaaaagtcttatttcctttatatttttcttttttcccccaattttttggagtaaaatatatattgttttcataataaaaacataaaactttatttcttaaaaaaactcttgttgaaaaagaaataaaggaacgtggcaggagcagtcctctgagggggtccaaggaggaatcagtgttactgtggaaagtaataccaggccttgcttctgttgacttgaagattattgagctcccaattcattagttaggccagaggtgtcctgttcatgaaaattgccaggccggtgacatgcaacaggtgcagacctgctgtgtgagccctgggaacacactgagatctgccagcgttttggcggtgcttcgcagtgctcacagctgctgtgtgtcaagcaggggctgctctaatgcttcagtgttctgtgatggtgaggtctggccccactctcttcctcagcactccaggctttgaccagctaccaaatacctggccagactattgtcacgagagctgccaaatgaaatcctggggcaggagtcatcagtcatttagtgtgcttccagaaggaatcaaaggagtagctgttcaagcaggggaaaggaatgagaaaagaaaaaacgtagagcaagtctgttacttaagaaaaacacagaaccaatgttacaactaagaatttcagagtccttggctgtgagtcaggtgtttggtgttatatagggatttatcagtcactggttcagaagaatatcggataacctctgtgaaataaatgagaagagcataagccaggatgagacagaattcgtaatgagttccctcatcacatctcttggccaagaaaaacatgcactttctccagaggcagaatttttcttccattctaggaggtggaggaacacttggagtatatgtagtccaggctttcagatgagcagtttcactagcagttttttgtaatctactcataaataagtgaaaagagaaactgtgaggtaactggagtctttctgtatcaggaatagcatctctgtaaaaacaagttagtcctgtgcttaattcctgcctcgatacagagctgtccgtctggtgtgaatatatgaagccagcgttctcttcctgtctcccagaagggcggctgcgtgtgacagcgtaaatgtgtgacagtatgtgaaaatgtttctgtaatcctgaagatttcagtagtgattagaagagctttagtctttggtcaattttctttgacttggaaagcataaagaatatttgaacctctcatttcagactgaccttgactttcctcattttattttattttattttatttttttgccttagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcaggtgagcctctcactcaaactttgaaaagagcctgtgaaaatccagttgctgtgtaggttgatgcagtgggggctaccttggggaatccagttgccgtgtagttgatgcagtgggggctaccttggggaatcccgttgctgtgtaggttcatgcagtgggagctaccttggggaattccatgtttagattcaagatttggggggtggggaggggtttccagatataatttttaaactgatttttaattgattttttactgttttatttttttaattcaccaattaaaaatgtatgtttctcatgtacaacatgtaattttgaaatatgtatacattgtggaatggctaaatagagctaacatatacattccctcacatactttccattttt

SEQ ID NO: 68249 - DNA, 1804 bp, Homo sapiens
ggagatcttagtgtattttagctgccctaattgcttttttcctttgtgttgaacgtattcccatgggagaagaaagttcaccctcctgagtccctgagctcctgcaggaagaattatttaccatcctggaattttaatgagtcttgacaattactgtaatccaggtcattgaacgcgggtctgtcatcgccagtgtcatcttccagagatgatgctcccccaactaagctgagaagaaaatgagtccttgtgaatgccaaagagacatgaatgtgacctgcaccaatgctgcaaacctaaagccagtgggactagaaactgtggaaatgacagtcttccggtccggtcagagcatctgaaataaattgcccacagttttcttccaaacttttaaattgtttacaaaaggtttggtggtaccaatcttactgagacggcctagaaatacaagtaacgtaaatttcttacagagtgtctacaatgctgcatgccagaggcactcagcacacctgaaggatgtgaagctcctgtaggaacagtagctctgtacaacagtaatctctagacaaccaacgtaaatttaaacaaaaaggtgtgagaccacacacccttcttccagtggggcataactgcccaggtgtaaaatcagacaggaaccctgaaatatgaaccatctccagtttgcagacagacattgctgccattctccacttgactcccctgtgcccatgcctgaaagccccgcttcccctagagaggtgggggcagtgtggccacagcctctctccccgcagtaccacctggtcccaaaagtcccagccctccacggcagcactagtgaggcctccttgctgttgctgctgttactccctgagccttctagagaatctcctgcatgccctgtgagaatgtgctgatgctggggccactgccacagtcgcgggttttctcccagacccccttctggtgccaagtaggaaagatgggaccaggctaattctgttgccactgagacaagtgaagacatatcctgatgtctggagttggatctcagaaggcgccttccagtgtataaactgatatgaaatggtggttaggtcctgtggcactgcacaccaacactgtattaccttgctcgggacaccgtaacaaaataccacagaccgcgtggcttaagcaacgtaaattgatttcctcacagttctggaggctggaagtccgagatcaaggggtcggcagggttggtttctcctgaggccccctctccttggtgtatacatggctgcctgctcgctgtgtcctcacgtggtctatcctctctccctgtgctccccagtgtctttctgtatgtccagatttcctcctgttacaaagataccagtcatactggatttggaaccaccctgcctgcctcattttaacttaatcgcctctttaaaggccctgtctccaaatgcagtcacatcattctgaggttctggtgatttaggcttccacctatgaatttggtggggacacagctcagcccaccacagacattatgggtaaaataggctcatggcaacaacttccgaacctaactactgcttgggtaattgttaagggtttcaaaataactgactgtcaaacaagctctggaaactgcattccaaataaactgtggggctctgcctgttaaaaggtaggaggtcctggcgaatctgttatgtccagtaattactgaatactcccttaggggccattcagggtctgctggttacttcaataaagaatgctgtaagaaaagcactgagtctctggccct

SEQ ID NO: 68250 - DNA, 1055 bp, Homo sapiens
gagccctgctgctgctctgatgggtccctttggtaaggagggaaatttttctccatttttataacgacgagcccttaatttgaacgtctctgttcacttcagttaatagatttgtaagaaataatgtgagatattaccaaatcagcttagacaaccagattaaaaatctgcctcactgggaaatctgcttctttgtttagaatactccacactttctcaagcctgcatctgcaaatctttggcctgataaagacttccagagtccatccgtccatctcttgcttcaggactgtacttcgtccaagcattccacacagaagggtaactggcttgttctttgagtgggataccacgtcacagttcctttggtgttccagggacatttctatacaagagatggtcccctgttttcttagtgtatagaggctcatcagaccaatgtaaatctcctgttgagttttatttttttaattcccatttttgtcttttatagtcatgttttctgttctcttgccaaactcccgtgctattcagctcccttcccagcttgttcagaaaaggtataacacccacatcaagataaaacctgctgagcatggtggcacacacccgtagtcccagctgctcaggaggctgaggcaggaggatcgtttaaggccaagagttcaagacccacctgagcaacacagcgagaccctttctctaaaaaattagagaggtataacttttcaggaaagaggataatctggaaagttgctgtaggcacagactatcacgtagaaaaaactgaaattatctcagctagggaagaatgctttaggcaggaagacagccagaattttagaagtgtctagacataagtaagttagaaattaagatatgagtatgttggtgacatctgcgaatacaaaatataatcatcagaaagcaaacatttgttctggattttgtccagataacggtttaaaactgaagtgttgtatctattgtagtgcgtggttccagctcctgctgtacatgaggaggttaatttggagtgacaggtgttagcaaca

SEQ ID NO: 68251 - DNA, 1126 bp, Homo sapiens
atgggagagcagtaacatcttatttacttttggtctaagcaacagcctttccttcctgtaaaaacaaattcatacattgcctggcaagggagttcatcacaaagtaggaaggggagctgggtgtgatggtgcgcacccgtagtcccggctactcagcggtctaaggcaggaagatcacttgagcccaggagttccaggctgcagtgagctgtgatctcgccaccgcactccagcctgggggacagagtgagactctatctcaaaaaaaaaaaaaaaaaaaaggacagggagggagaaggagaagtccccacagcagcctcacagccattaccacttccggcccacttgcacagtctctgcaagtgcagacttgaaaggaaagaggactttggagttaactttaatgagtgggaaataaacataggataaattcttcaagagcaattttagttttccctggtactaagtgctaaagggattctgtagagtcaagaagtgaccagatgcctgtagaaaaatagatccctgggcaaaaaagattgaggtttagagggattgtagagggttagagggattccagatccctctgactgtgtaagttttatgtcttattcaatagatgctcttacggcaaaatacatttccatttattccagttgtgtgaaattccaaactaggaagttattttatgtcttcgtatctcctaagaagcctgcagattcaagttaggggcttgtgggccagacctggccaggacgagcaccatttccacttgatctgtcagctccaaaaggctccgaacatcatgccagattacagctcagacctcatggcctgtgacacatcctgggacttagctgttagaacctcaagtttagattcttgtctgcttaaaccaaactaggcatttctgaataatttcctgccctccaccaaaccatctgcagaaaggaattaatctgagtcactgccaaccacagaggaattcattcactgacccctcttgtaaccgtcccttctttatacccatcaatacatcctccctttcacctcatgctttgtgactatgaatagagttgtttaccttgaaatcaggccaagtccacagaacttttaactgtatttt

SEQ ID NO: 68252 - DNA, 1044 bp, Homo sapiens
cctcatctctgaaatgttcccgctctgctgagcttcctccgttcgtttcttccctgcacagtggtagggtgaggcattctccccttccctctgctgcatacgcttccagcctgtgttgctttgagcattcagattgagttgctcttgcatttgtgattcttggctcaagtccctctagaaatcatattactactctgagttcagggagggctggaacagctactaagaacagaatgcattttaataacattcaacacacaaaaaagccagagaatttctgccagaggccaccttcgtatcctatacttgtcccgtattccatcccttaagaactttaaacacagtggagtgctacactgtatggtttatgtgccctgctgtctaccaaagggcctgtatcatcagattgttttggtttggacatgcttcaaatttgaacttaaatagctctttagaacattatcgaggcctttccccagaattaatatctattcctttatttcattcaccattttcagattgtctgctacgtgcaggccttttgttacgaggcaatattggtatacaaaaaagaattcaccaaggagcttgaagaacagttggggaattaaacataaaaccaactattgaaaggggacaaaatgaatactgtagcagtttacacttctaaccagggatggcattacagagaaaaggggctcaaccgtgaaggataagaaagatagagaagaaagatgtgtaggaagtaagattgtccacattctagaatgagaggaaaggaaaagcaaagacagggaatggcaggtatgtaccaggagatgaaattgaagcagtagctcccatgccaaaaagcttagtcttttattttgtaggaaggaaatcatttaagatgttggaagaggaggagggaactgttccagcctattttagaaagattactcttacaccagggttgaagtagttatgaagctattgcaagatggtagaacatgagagcttgaattaggattgttaacaaggatatcggaaatgaaaaaactaggc

SEQ ID NO: 68253 - DNA, 1058 bp, Homo sapiens
taaacactttgttcattttttcttttttattcacaaactaaatccaccaggaaattataaagttatttaaaaaccgtgctgtgtccttctttgagtgtcacccagctgatcatccaggcaaggtgtgtccccaaatgctagaaaagatggacaaggtctgcagtgcccaagaggccaactccaatggcaggcagcccgagggccaggggtcccaggatttacggtgggtgtgggagtcatcacagccctgacgggcatgagcctcctttcccttcccgcctgatctccgggtttgcagcttttaaagtcaattcccggttccctttttccttctttctaccctcagccccgggccaggttatccgtatcaggtctcactgttccagagcttagagtaggtgcccagcgctgagggatggtgctgctgttgtaccaaggtagaagagccagaagggcggccaccaagggagggctttgcccaggactgggactcaagcttcagcagggcgcgttctgatgcactgactctggggcgtgcaggctgggtcaacagaaagtgtgtgtgccaagagtaaaaggagccgagaaaccctgtgcttggacgcggctgtcatttccagctttgggatttgtcttgggctttatgctcaataagaaattattctggaggatttcttttatgagaattacttttctgcttagccacacttctgtgtctgcccgagagaggaatcaagccagcttgctgcattccttccctctcccgtgtaaattctgccacacgctgggtgttggctcttgggaattgtagcaagagagtccaaactcgttcttcccggtcggccctcccagtgcccaggtcccaccctggcctcgctctctgcagccacagcagctgttgggaagctctgccaggggagacgtgcccgggagacagggcgctgtggacacggctgcagggctgaggttgcttgtactttcatcatatgaagcaggaacaattttactagccgagcatgtattattctgcacaatataaaatcacaaccacaagcaaa

SEQ ID NO: 68254 - DNA, 1158 bp, Homo sapiens
tcttcaaggtcaagaaaggcagaggactaggctggtctgttctaatttttaattctaggatggttctgctgctttctggattgccgcagcctggcttctctagcatggagggaagtttttacgtgtggtgatagtccttgtcttctctgaaatagaaaccagtcagtccaaaaaagctctcgtgtcagcgagagctttttctctctggctccttttcaaaccgcctgccatttatctccttcatcttctaaccaggtcttcagagcccatctttgctccagcgctagtcctggatgcagtcctcagagtgtgtggtcgtggtggtagttactggttgttgggtaactccatcaggtctctgaagacacacaacagcagtagatgtaaaagccctctgggcaatgagagcatgtgggagctccacttacgggcagccttggctggtttctgttgagcgtcttcaccgttatctacgagtccagaaacatccagcagagggattgtgcatcgatattgccatcaagatgaaaagacatgctcattttaaatctgagccaccctttaaagtaaaactaaccttctgtccatctctggggcgcagcctgtgtgctcccccaagcagcatgctggaggaaccctgaaaacggatccgctgtttggtacagttctggctggactgttcccttcagcgagaaatgccccaactctggagagcaggtgactgcacagcccctaccaggccctctccacccctggcccggctctgtttacctggctaaatttaaacctccgccccctccatcccagtttgagccactggcttgcggtctcgccactgggctggctgctgcggcagcatttcctgacttcttcgcccctgtggttgcagtgtggtctctttgtgctgcatgagtcctcttctaggctttctaaagttggtctctctccccgctgcttctccacccatgtggctttcttcccatctctttcctcctgggtgagttggaacctggttcggtactgggggaagatgctctcccctaacccttccagatactgtgcacggagatcacaggaagcctagactcaagctgtcatttaaggtcctcagggggctgtgctgactgtaatcattacccagcctggctgccgggctgt

SEQ ID NO: 68255 - DNA, 1055 bp, Homo sapiens
ggcaggagtgatgtcctccttgtctgggctcctctctcctcactgataatcccaccactcggcgttgctgctgctcagccatattgacacgttaatgagctagtgacttctaaacaggttatcctccccggttcaagaaatccagccataattaccatgtttcatcgatattaagatgcatttcaacatatctgaggtcagaatgcatctcagaatcaatattgtatgacagtttgatgacaagtacttttctttcttggtggtacaaaataatggtgcattctagaatcagtagcatcttaggtttggtgaaataaggtaattgatcactgtttactaaggggacctgttgtcatttcctggtgcctaacttggtgttcacttggaaatgcacttttgtattttgccaaacagaatatttgtttcctgtcaccttcaagttgaacatctattaaccatgttaaaattgagagaggaaattctaggcaaaaactggacgtcccatggaccctggaccctgatgcttgagcctgctgggctgctcgtggccacctgggaatcagcagtccaggatttctgcccttgcattgctgagaatcttgagcaaatgtgctcatcactgccagtctccctcttctcattggtacatggagtcacagtgtaaccccttcctatctcatagaaccgctagggtcaagcgacatggcgtgtagggaagtgctttatacccaacggtaagaacaacgaagtgctgttcctacctgatacgcagaagggaactgtgacccaaagacttgtttaaattcactgacaaagcacagctccaggtgactcagtgttgattcatacctggcacttgtcttcttatttgtctatttctaggagagagactttgaaattatagaaacttgtctggtgagatgaaatagtatcccaaaggatcaaaaagaagttacatcctagaagtagaatgcaagcttttttttttcttttttcattttatgctttcctgtttcactgccttggcactggaaaatatggggtaaaatgttgtt

SEQ ID NO: 68256 - DNA, 1052 bp, Homo sapiens
ggtgcccaaagaatttctgtgaagctgtctcatgctttccaaactttcttaacttaactagatccttttcttcttccaatcagaatctttcaaccagtctgccttcctctcaggccttttctttctcctgctttctgtgttcttctcccattcgtggccctccggccccctgtggacccttcgtcatcatcacatcccttcgtaaagtcatgcccatttccagttttgaggacttctcggaataaatgttagtatatctaaaactcaattatgttttggttactcacgttccagcccagtgacttatactcaagccataaagcagtggattttaatggctgaaaggtcagctggaaatcatctaatcctgcgcttcccaacatctgttcttcctgagaggttaataggcacttggaggaaaaaaaggttgtgtgatcaagtaagtttgagaaatgctggtttccaccaaattaaacacatttttttaaaaccacagaggtttaatgtgttcatatgccgtgtgactccctcaggagcaggagggagtgtatcccatgcttatttgtggaacccttcgtcagagggcaccatcgatctgtcctctgccacgtttagtggacgagcacactcgcacaccctgagcgtctgatgtcagtcactgaggttgctcatcttagataggctctggggactgttttgtagctccagcaggagccattgtgacagtgccagttgctgtgatgtttgtgaatctttaaccatgcgtttagcaaaagttttggctctgctgtgaactggtgccaagggaaaactgctctgaactttcccaaatgaaaaataagaattagacaggcaatctggtgagaccatagccagtgacacgccttttactaaggaacaccgagcagcgcactgtggccccaggaggaagctggactctcactcctgagccgggagttccaagcccttccgattcaattccatttcccacatctctcctggatgagcccggcatcacggccggtcagagccgcctgctgttttcctgagca

SEQ ID NO: 68257 - DNA, 1085 bp, Homo sapiens
ttctccatttccctccctccctccctcccttccttcctgtcttcctgccttcctgtctttttttttttttttttttgagacaaggtcttgatcttttttttttttttttttttttgagacaaggtcttgatctgttgcctaggcaggagtgcagtggtacaatcacaacccactgcagccttgacttcccaggttcaagtgatcctcccacctagcctcctgagtagctgagactacaggcgcacaccaccatggctggctatttttttttttttttgtattttttttgtagaaacagggtttcaccatgttgcccaggctggtctcaaactcctgggctcaagcgatctgcccacctcggcctcccaaagtcctgggattacaggcgtgagccactctgcgtggcccaggctccatttctaaagtccagctcccttctgcttgatgagaagatttagttactcgtcataccttggtttccagtaaggtgaccctcatagaagtgaacggtagctgtttgaacaccgtatgaacaagcttatgccatagggcagtacttcaaagggaataggggtgactcttggtggtatgaaaagttgatccccgccatacctacaggaatgggagaaatgcattgaagaatagaagagctaaaggacatgaattgatagtacactttgcgtggtggtacaaaagttaaaaggcactccagggcagttcttagaataacagaaaaaaacttggttcaggtatttgctgaaacttgagaactgaaaaaacataatgtaaacttcgtgtaaaccttatcatctagaagtaataaacctcaacagaaactgggtagtagtcaaggaacagcttcatttcccttctttttctaagtgtcattgtgtgtagcccttcaatgttcttactggaaagattatctataaatcacctgtggggctcagccaatttctgcagctcccaagctaggcccctaacttgtccaacttaacatttactaaaactaaaagccagtaccagtatatcctaaaaataaactcgaaccgatcatgttctttcatgagtcagatgaacaacaa

SEQ ID NO: 68258 - DNA, 1889 bp, Homo sapiens
gctgcacccgaatcaccaagcgcggcctggagcgcatcacgcagctgccgtgcctcaaggtactcaacctgggactctggcagatgacggacagtgagaaggtcaggtgagggcggcagcaccagctccccttgtcccgccctgttcatcctcccattaccaccgcccccacacactcacacgcacacttacgcacagatcattgcagcggatgagatggggctatgacagaagcctcaggctcgtttcctcctccctcctccagccccctcccggcttccagcccattctctttgcagctggggttcctaccctaccctactcccagctccttttccccgcggatggagagatggactctgctgcttacccacccactcccctgcagggggtggaggactgattcagctactgtatccccactgctgtgactggaaatgggggtggggagtgactggtcttttcaaccctggggagttgaggaaaatgtctgctttcacttcagctttcatttgaatactgtgatctggtttttattttgaaatgtataaaaagcaaacccagctacaaaggccttttcacccttccactttgtaactaatcccagtctcttctcatcactcctcctcttacagtactctgctattcatgctcatttcatgttcttaatcttctttcctgtttaaaaatttttttttggaaaaaatttgaaatcatggtccttttttctgctgaatatattctatatattatatatatataaattatatatatatatatatacatatatatgtctggctacctcgttttagtttactttttttctgaagccctggaattctacaagagagatattttgagactgaaacatgtttgtgcctagactggaaagatgcccttgggtttgtccgtctttttgtgttggcttcttcccagcctccatccgtccagtgtgccccacttccacattctggctataatttcctttttctccttgttcattgggatttgaggacctatttctaaatcttaatttatagcacaaatatgtgggagcaatgagagttgaaccgttgtttttgttggagatgcagattgtgtcttgaaaatgatgattatatatgcaaattctgccctaccctcaccctcttccaagtttccccccaaaaaggtcacacagtgcggcttcctgtgggaaacaggagcagagctggcctgcagagcccctggggctgtgatgaagctcatatcttatctctgttctattaacaaaatgggagtttgtgggttttaaaaaattccgtttctaaatggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgtttttgaaaaaaaaaaaaaaaacaacagccttgtatctgcgaattatttttaaggcattgtgtgcttgggtacatgccaaggtaggaggtgttgtttgtatactctaagaggacgcaaggtggagtttggtgcatcctatgtgggggtgagtcaactcatgggtagaattttattctgtataaggtttactactgacatgttttgtttctagaaatgtgattagactggagatttatataatgtttggctttaaactttcaacaacgtggaaatttaaagaaatt

SEQ ID NO: 68259 - DNA, 1023 bp, Homo sapiens
tcgcagatacaaggctgttgttttttttttttttttcaaaaacatacttcatatttcctcttttattatataaatatcagtttaaccttttactgtaagaatataaacgttttaagaggatctttgttattatttatacaaattcacaaacagtacaattaattgataaaggtctctgggtttctttaactccatggtcttgcatgttgctgtggagggttctaaagaaataacaacaaaaatccaacgaaaatatacatcctactcagaagtgatttctttaaagccacaagtcccaacccccaccaaaagaaagaaagtcatctattcctccatttagaaacggaattttttaaaacccacaaactcccattttgttaatagaacagagataagatatgagcttcatcacagccccaggggctctgcaggccagctctgctcctgtttcccacaggaagccgcactgtgtgacctttttggggggaaacttggaagagggtgagggtagggcagaatttgcatatataatcatcattttcaagacacaatctgcatctccaacaaaaacaacggttcaactctcattgctcccacatatttgtgctataaattaagatttagaaataggtcctcaaatcccaatgaacaaggagaaaaaggaaattatagccagaatgtggaagtggggcacactggacggatggaggctgggaagaagccaacacaaaaagacggacaaacccaagggcatctttccagtctaggcacaaacatgtttcagtctcaaaatatctctcttgtagaattccagggcttcagaaaaaaagtaaactaaaacgaggtagccagacatatatatgtatatatatatatatataatttatatatatataatatatagaatatattcagcagaaaaaaggaccatgatttcaaattttttccaaaaaaaaatttttaaacaggaaagaagattaagaacatgaaatgagcatgaatagcagagtactgtaagaggag

SEQ ID NO: 68260 - DNA, 2007 bp, Homo sapiens
cctcccccctcccctcagcggtggctcccaagaagtccgagacacgcggtgaggcggcgacgggctccgggtgagggtctctggagtgtgggcgccgtttcctgggcgcagagggagagcttggggtcggggggaggtgagagctgaggggcgaatgtccctggcgcgggcgggagagcgcgctctcggcccggcccgcaacttgattcctaactctgacctgccgcccggcgcgccttggcctgagggtcggccgtgtggggacctggagccgccctccttgcgaccgctgtcggaggagtccggcgcccgctgttcccctcgcctcgcctttcgcggcggagggtcggagcctgctgccctctgctcaccttcgggtgcagttgctccagctccctgcccgcggagaggatctgcccgcccctcttcgtctcttgtctgtttttatcacttctaggaatttgtttggtggaggcttgggatgggctctctcagcgctactttcacagtgactggggtggggaagagttccctcacctttttcaggtggcgcgtcaggcagcctgcttggtacctggagtcctgttttcccaagcccccgtccgtcagtgttcgcttcttctaaaattaccgatgacagggttataaatcagtttttagggggctcggagagagtttgggttggaaactgttagctcttttttcctcctggcttttgatcttgatttaagcgtttgcctctgaaattttgacaacttcataagatggtccaaaagtgaattttggtagaaagatttaaatgcacagttgggattttatgggggtacggtgacttcattgcaggttgttgactttttttttaaaataagatgttcttttaattttttgactctgggtttctgagccttggttattgtcccccatttctgttccaaaagcagactttttttttttttatcaccccttcccctcacccagagaatccctttaaacgccaagaaagctgtcataacatttagcattatttgatcacagaacttttccaaatgaaatgctaaaaattccttcagaaaaaagcatccatctacccatagcattattttttggggggaggctatacgtcttgtcagttctgaaagtttgaagtgacctcttatcaaaggccacccttatgtctccttaaacgactcttaggtaattcctagatgttttcatccgttctgataaatttgttgtcagagtgttgattgtgatgatctgcaactaaaattatttcatcagtaaagatttccacacatgtggcagctgcttgttggtgaattatgaaatttgaaaaaattgcaaattaaatgtgaaaggcatatttcttttaacttctgattgtaactgtctgtcctccagtatacgttcctatctagactttggtctgcttagcagatttcctcttttcacttgacactaggaatgggagtaggatttccagagcctaaaagagagtttgttttttttttctatccctaggctccttgtatgaatttataaataaatggttttttctatcaatagtatcaatttagctggtgcactttttttttttagtataaatcacattttgtttcctaaaatgaaaataattttgttttattctttatttcagggattgacagattttaaagcctgcaggcccagtcctgccagttgcctctttttgtaaataaagatttgattaggcctggtgcgatcgctcacgctggtaatcccagcactttgggaggtcgaggcgggcagataacctgagatcaggagtttgagaccagcttggccaacatggtgaaaccccgtccctattaaaactacaaaaattagccgggtgtggtggcgcactcttgttatcccagctgcccgggaggctgaggcaggagaatcgtttaaacccgggaggtagaggttgcagtgagccaagattgcaccattgcactccagtctggacaacaagagcgaaactcc

SEQ ID NO: 68261 - DNA, 2095 bp, Homo sapiens
tagaaacagggttttgccatgttgtccaggctggtcttgaactcctggcctcgagcgatcctcctccctcagcctcttgaatagctggatttaacaggcaggagccattgtccctggccatattcttgcactgttgattttactggggcctctgtcagcttaccctggaattctgcatcatctgaggatttggaagaactgaatcacagttatagtagacagcatcatattcttatccttgtgtgttttatactgggacaggtcttgaggaagttcttctgtcatggctaggggacattgagctattacctcttatagcactgatttggactgtcatgtcttccctaaagttcttgtccataacataatggatggtcacagtcatgagcaataactgagtgatctctgggactaacaggtgatgaaatgcatgtttagcaaacagtgatttctgttacttctctgtggtgcagcagcagaaacttttgcccaaaggcatagaagttagagggcttatgaatttctgccaatctggagataagatttatgagcatcatgttaactcaaacctctgcttagagatttctagctgtgtgcttcaggagtgttttggtaaaactttgaggatcatgaataaagctaatagcttaaaagttaaacactgtgagttttttcttcttttgtttcctgggcacttttcataaccttttcagtgttttgtgtttggagccactcttcccagtgacatactgcacttgtaggtctcttgtcactttatcctcagattctgagtctgtcctatttgtttctcttcttcatcttatcctaggaagaatgtcaaggtggcaaccaatatctcaaaacatgcagttgtgatgacattgacagttttggcatcagtccggatgtttcttgtagagttcagtcatcacatccaaagatatcttggctgcagttacattgctgtctcttaacacgatgtatatgaaattctgcagtactatatccactttattcttgtgttttacagttatattcttgctatcagtcacaacatgagtatgtaaagtctcaaaagcttattatggcaacttggaagttcaaaaaagagctctagcaaacttgatggatggatatgatacttctcagcaagatcaaagctttgtaaaatgttattagatgattttgattcaagacagtacagtataattgtaggaaagtagatcttttagctcttgaggaaagttacttagatgttctgggtaacagtgaccaatctgtgccataaatatcaccagctctgtcaattctttgccaggtttattggttttaatttgagaatctccatattggatttgtagtgtatatagtactgctgtagtaaccctttaatgtcagccagtggctccactttattagattctataactgctgcttgttactgggcagctagtttctgcaggacatgttggctgtagactggatccacagtgagtagttctcagagaacccgtactgctgacatttgcaaacccatttcagctgtggtgtggagctgtggcgttgtacttctggatgtgaccagaaacagtgtttgggagctcagcaggtggtgctgtcttggctgattgtgtgtgtgtgtgtgtgtgtgtgtgtgtgtgtattttatttaatttctgagacagggtcttgctctgtcacccaggctggagtgccatggcacaatcacggctcactgccctctcgaactcaaacagtcctcccaactgagactcccacgtagctgggactatagatgcacgccaggctaatttttgcatttttaatggagacgaggttttgccatgttgcccaggccggccttgaactcctggactcaagtgatcctctttgccttagcttctcaaagtgctgggattataggcttgagccaccatgacaggccctgtgtgtgtgtttttaaaattaatatttgtggcttactttacatctgcatctactctcttctttttagtagttctctagtgtagtattattaaatggatatgctataacttaatactgctcttactgatggatatttagattatataaa

SEQ ID NO: 68262 - DNA, 1030 bp, Homo sapiens
ttcttagcactcaagagcattgagatattatcaaatattcattaaacatttgtgtgcgtagcactttctgggaacccagatggatgtaaaacgtgtatgctttggtcctgagtttcttccttccagggtagtctagttagagttcagaataactcaaaaaagttgaaatgtaagacattaagccttttgaatacaaaatattatggataatatgtgcttataaatttgaagactttgtcctgtttattttttataaagtatggtgaattttgttttcctttacctgtgaactagaaataaaaataccctgtggggtcattgtgatgtttaaatgagattggatatgtaaagcccagttataatatataaacttacatatattctttctaatacatacaattagtatttagaattctaatttctaattgtatactattttttaaattaaacaagtaatatgatacatggttaaaaaaaatgcaggcagaacaaagtaagtattcttctcacttcagacccgaggttcttccatatgttcttctgtaccaagagtatggttttaaatatttttcattaattattctagaacatatgcacttacatatacttacatatttttataacatataagtgggaacatattattcatgttgtcttgtatcctgtgtttttcatttaaaaagagatttttggctatattccctgtcaacaaatatagcttttaagtacattattcttttattattgattgctgagtattctgtcgtttggatatgtgataatataactgatattttccccagcactcctttaatgcattttttcaaaactttcatcttcttaggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtg

SEQ ID NO: 68263 - DNA, 1041 bp, Homo sapiens
tgtcgccaggctggagtgcagtggtgcgatctcagctcactgcaacctctaccttccaggttcaagtgattatcctgcctcagcctcccgagtagctgggattacaggcacctgccaccacgcctggctactttttgtatttttagtagagatggagtttcaccatgttggccaggatggtctccatctcaacctccttatccacctgcctcaacctcccagagtgctgggattatagacgtgaacgactgcgcccggcctctgctgactcttaaaagcgtacttaacctgctttatcttgttgaagggagaagacgtggtctatgggtaccatataatctaatttaaccatactttagctatgacgttatctgttatttttggagaaattcgaattgcgtgttagagctacttttccagaaattgtttacctccagtgtataccttgggagtcagtagagttctgaaagctgaagcagattttattctttcatttcctagagaaaagagcaacctttaggcaactatacctatagagcagaagtatcagaaagtcattgttacagacattttgctatgtgctttggaacttccaaattatatagcatgtgtttaatgttttattactagtacagtgtttctcaaactttgggttgtacctattagtgggttttgaaattaattgtattataaagtgttaaaaattaaagatcaaaatagaataaaaacattgaagtgtgtatatagtaagtaatacacatttaaattgttttagttttatatagttatgtatataaatatgaataataatatgaaatacatttcttactacgggttgtggttaacattttgaaagcttctactgggaacagcagctgggggaagagtgtttcaaggtagaggaaacaagctagtgccaaggtccaaaggtgggaatatgcttatcttccttgccttcccctcctgcctcccaccaccacctgcgcctgcttgtatcatctttctcttctttcatcttctcctttattttattattataat

SEQ ID NO: 68264 - DNA, 1041 bp, Homo sapiens
aaattcagtatcttggtctctctctgacactaaaagaagcagactgcagaggttgacagacttccagcagttccaacagaagggatactggatccctgatcccctttctctttctctccataaagtcctgtggaagatctcatacagctacttttgtaagtggtagtactattagcagcagatgttaaaaatatagattagtcttttggcattattttattttattgtatgttagaagcaagcatagaatggccacattagcaccagtaaccacagaccccacgttttgagttggaaagtgagggaggagaggttttgtatggctgggggcaggaagagtagggaagaggcagggggctagtttggttagagtgttaagagggacacatctgttcttaaattgttagtcctcacttcctttggatgtggagatgttacacagaggattagttcttttacaaatatctgtaaggaagtaagagagcagagaacaagaaacaggttgtggagcaaaaggaatgggcacagtagctggtgagtaagtggcagtctttccatagagtagagagagagccaagtttccatggcttacccatattgtcacaagaccctgtagtgggtagggtggaggtcattgtctgaaggtgaatcttgctgatttgcagcctggattcttgctttatagggtaatagactggaagaactgctgagcccacattagctggaagataaaccatgtgcctgccatttttccttacatctttctgtctagcagaagcaagttagtcaagattaagtgatccttgtggtgtgagctctcggggctatgagacattaaaagaagcagagtgcagaggttgacagacttcctacagaggggatatcggattcctgatcccttttcctctagaatctgatgcgggagggaccatgaggaaacgggaggaaagggctctgagggactgaaagggtggttagggctgagcttctttaccatctctctgcagcatgagaaggaagatggattagtcactaactgtc

SEQ ID NO: 68265 - DNA, 1447 bp, Homo sapiens
gaaagctgtatttcttggcagggtttaggggtattggaattcattgtaaaaacaaaagcaaaagcacaatggacctttgaaagctggactatgaggtatgtgccaaaaactgtataaatgaaactattctacatctagaggtagaagtggcttcattatatcttctaagaagtagcagcagtgtctgatttctttttagattatgcccttagataagtttttatattctgtatattcagtttatgaagctgaagtatttctgataccaacaatgttggaagtaaaccacaattttggataggcttcagttatttggaagatttttctcattgaacttttgattcagatattgttgtaatgcagaaggattgaaaacagaatcagttataatactgtctcttctaaagggtgatattttatctattttctgtgctctttttcctaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaagtaagtatctgtaaagtccgtattttggccaatgatttagaggtagtgcgttagggaaaaacattcagcagagttggcagaattcttaatatcatctcatgcaaacttttttttttttaaaaattaaagagcaacccagtttggctcttaggtgtcgttgatggcttatgtcatgagggattaattggaacctgtagtggccagtagtttttaaattactgcattaaatggattttttttttctgtcatagactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggtaagagcacggggaggttctacattcgacattcatttattcactagttaaattcactatttattaaagttctaccatttgccaaacattatgctgtgtatttgtgatgccaagatgaagaaatcatagttcctattgttgggggtttttttatgtagtagtcgtagtagttgttgttgttagtagtgtttattaattgtcttaaagcattagggttgaggggtcatggtgagtatgaggtgatataatttgggactgttacttacttgaatttatggctaaacaccatccagaaagcggtagtctataacttttgtaaacaatgatttctcttactcattgtggagtgtactttttgtagtgattctttttttgt

SEQ ID NO: 68266 - DNA, 2052 bp, Homo sapiens
acgccttgaatttgagctctgtcacatccattccctgccttctgctcagcataaaccaggattaaacgatcctaagaatctttagcagtcttaataatgtatgggtttctctacccccttctcttcttttttcccctccagtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccagtggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgag

SEQ ID NO: 68267 - DNA, 1033 bp, Homo sapiens
gacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgacctgtcgtgtgtttttttattgccgttcagcttacctccccttggcttttggcacttctctgaagctctaatttagacactgtgatttaagaaatttttggaaacttccccttcgggatgcagaaatcaaagtgcttatgcccaactcctgtttcctaactcaagctttcctcgtaagttgcaccaggtttagaatggaggggagagcagctctaaggggcagttcttatttattattgaagtttataaaaatagtctctaatgccaagggcaataggctctaccataaagcctgggtgtgtagtaggctgtaccatctaggtttgtgtaagtgcattctatgatgtttgcgtgacaacgaaatcaa

SEQ ID NO: 68268 - DNA, 1019 bp, Homo sapiens
cacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacat

SEQ ID NO: 68269 - DNA, 1048 bp, Homo sapiens
ctcctcgaaatgtcatgtagggacaagttaaaagaaacagcctgccttcctctaggccaacttttgctcaaagagacgctaagggattgattataaaattacagcaacttctagcttgctggcctccttgcctccctcttaggagttctttcggggagttcggaggctgataaataacattctttttcttccctgagttagaagcaaatgatagctgtaggagtcagtcagataaggatcaaaatgtcacttgcataactgaaagggctgttagaaaacttggtttcaggtctgtttgccaagggagttagactcagcagacaggctctggcagggctgagcaacaggccgcccgggtcagcccaaacacatcagctgcggaagctgaagatgagggctctctgcaggcaggcagatcctgtcagggaaggacccagaaggggtggacccacacatcactctccctccccacgagaagtgagtgaggccgcaggaggggcggggagttgctctcacagcgcctcctgtgctccggggtcaggaggggaaatggggaggcccctaacaagggtggcagctcacataggttgtgagacctttaggtcagggtcatggacaaccaggtctaaggaaaaggtcagtagtcctaaatgcacttgccaaatactggtagcctgaaaaataagctgtcacccagaggccaagctgcatatgcagtggaaagaatagtccccacagcagacgataccagagctgctcagtgatgctgaaggaaggtgcatggagcagtggagcaagaatcagtttcccataaacttttctcagctaggaaagctgtggacagggaatgcttagaccacccgtatctgccgctgcaagctatcatgccgtgagctgctcctgaaccccgctctctgtgtgtatttgctgtgagcaggtcatctcacctcagcgcatccctgctacagcagctccgtctctgcttatgtcccccatggtgttcgcacaacccacctccgtcccgccaaaggaaagggagagcggcctc

SEQ ID NO: 68270 - DNA, 1031 bp, Homo sapiens
acacagacatgggagaaaaccgtaatttttgactgtaggaacttagtatggtctgccttgaaatcaatctggaatgccaagcaactgacctcctcttgtttttcagtccacagtaaattattcacttatttagtaaatatttttgagcacttactacatgtcaggcattgtctacatgtgggtacataatgatgaagaaaacagactccttacccacagcccatgctgtaggttcttgaaataaacaaaaaacagcctatttcctcctgaaaggtgcagccagtttttatctttctctgtatcgtcagtatagcctactgtagatcaggagaggtatgcatgccacccacctccaccccccacacaaactgccagagagggaaaatatgacagtttttagaaagattctctcctttagagaagatgcttttccatgtccatcactgacttgggacagtgaggaaaccacaagctattgatcatctgcctgtgggtaacatctggagatctgacattgaattgttttccctttggattggaacacattcattgaaagtacattgggtttaaaaattggaaagttctccctgtgtatcacatatatcatcactggccctttgtcatgttttgttatgtacctttttttgttttttgagacagagtttcactcttgtcgcccaggctggagtacaatggtgcgatctcggctcactgcaacctccacctcccgggttcaggcgattctgctgcctcagcctcctgagtagcagggattacaggcacctgccaccacacctggctaattttttgtatttttttagtagagacgaggtgtcacgatgttggcctggctggtctcgaacttctgacctcaggtgatccacccacctcgggctctcagagtgctgggattacagtcgtgagccactgcacctggcctgttatgtaacttataacagtttctcaaaaatcttgaacttttggctgggcatggtgactcgtgcctgtaatcccagcactttggaggttaa

SEQ ID NO: 68271 - DNA, 1042 bp, Homo sapiens
ttcctaccaaggtggttcccaatctgtgaaaccccaggcccttgaagatcttatacctgttttatcggtcaacagatattaaaatataataactgttttgggggtgcaaggggagcatgctgtgaaaatttttgacattaaaaaggggatctcatttttcaagtttattattattatttttcattctctctaatcaatcctttgtaaatagaataagtcatcagataagttatgtttcatagcacttcctcatataaccaaattgtttgtagactcatgtcagatatctttattttttccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagca

SEQ ID NO: 68272 - DNA, 1026 bp, Homo sapiens
gtgcaggtaggtaagataaaagatttctggtacactgataattgcaaaaccaaagtttaaagccctattgccaccttttggcaagtgagtaattcagattcataggttcctctttaagatacctgcttaaaatagcactataaagacatttcttgtaccttttgatatatgaatcattactgacaagaagcagaaattccatgcccagacattggtcaggtaagaggggaaaaaagatgtagttagaatatcatagctgttttaacagcaaaatactattaatataattacgtgtttagaaagtttgaatttaaagtcttttttcccttgtaaaaacatgttttgttggttttcattgccctatcgtaatattgctgctgttttcagtgaagatgttttaaatgtgtgtgtagttaatgcattacttagatgattaatgccatcagatcctcaactagatatttataaatgtcttctggagctgcttcagcctttgctataaaaatgatatagataggcacatactaaagtatacaacttatttgaacattattgaatgaatcaatagcaggtatattatgtcacagtttctttcattactaaatgaggaaatcatagtcatatctaatctttcagcagttatacattttctgtaccattttgaagccagaagtttattattaaattttattttttccagtggcctctccctaacttacagcttacaaagccactttctcagttaacatgttcctgagagaaggagaaggggagggaggcttctaggcataatttgagtatcaggtttctgaatatttaaaaataaacatgaaatgtgtttatgaaatgtgcaaatggagtgtagaaacaatgctatctcgcagccaggaagtatagaaattgtgatttcattttccgtctgtattcatttgcttcagaggattttgccgagtgcctgttgtgttcaggtgccatgttttcacgcggagcacagtttcttcaatgtgtgtgggtgcgcgtctttgc

SEQ ID NO: 68273 - DNA, 1012 bp, Homo sapiens
agttaaaaggaaagtaaaagattggtgtttcattatgtaaaggcagtattgcattgcctgttgcctcaaacatcactttttttcaattgagaatttccaaagaacggcataaaccaggatagtgcagttacaggcaaaattttacaacggtgtgtggtaaatcctgattaaatatggagagatgagttcttagagtgaggaagtcacattctaggtatcattaggatatttagagtaaatttcaacatgttcttcctactctttatttcactttagggtttcttacctccaggagagatgtagaaatagttgagttgagcttcatgcaccaaagtacccttaaacttgacctccgtgttggcagacaggtggctgggaagcggctggtatgcaggcgtaccaggctgaacaaaggctcgaagcattgtgaatttccagatgtatattaattggttgatttttaaagctaaataattatcctgctcatgatctcttataattttttaaaacccagaagctattcctgcagtaacatttcagtgccacaaaagttgacatggccgtatcgtatcgctgcaagtttaagttacagtaaaattccttttaagttttagaattctaaaaaacaaaacaaaacaccttcttacttgattcttttcaaccttgtattttcgtcttccctgctctgctccctgcctatgtagggatgggcctctcagccagtggctttacgggaaaacttggattgaaatgtgaacttcatggtttctgtcagcctgtcagctcatcacctccctaaggcatggtgatctctggtttttatatatctccacagactgctttgatagaccctcttgtgtggaagagtgataggtttgtccaggggttggtagaccttagggctaagaggcaggaaacttggaatgcatacttccatggaattcacagcctctttcccaggggaatgcactcaagttgcaaaactattttagggagaagaaagttaggccca

SEQ ID NO: 68274 - DNA, 1122 bp, Homo sapiens
tcccatcaacactacttaagcataagaaggtaaagtgtttgaagcaaaataaactctcagtgaaggttgaaggagaacaaaagcggtgatatgaggagactgtccatgctgaaatttctggtagaaggtgtaatcaattgatagagaattctagcatatctagtccacatgttgaattattccaggaagtgataattattgatattagcaattacaagggttattgatggtagaagagcttgaagtcttagatttcatttcaactcagcaagtatttgttgaatgtctgcacatgctgtttgctgtactgggtgttttaacaaagtcctcccctccaggagcttatagtctagtggagggaacagatttataaatgcttaatttattaccttttttactacaaggatatacaaaactacaggagcaaagaaaaagttgggactgtttattcctagaggagtgagaaagcctgggtcttcaaggacgagtagagagaaggaaaagatgtattagggactccctgcatgatatttgtggccaaggagattttgaaatttttcagcaagattatgaacaaatgaaaatataaatttaagtggccaacaaagcagaataagttgtttctatttatatttgttgtaaactatggacttttctgcttcctaatttttaaaagtttatttactctgttatatctcttagattaaaggaacaaataaaactaggaaattagtatacgatgaaaaagattccatatgacctttggtaaacctgagggtagtagatgacctcaaggttcccagtttaggaagatgatgatctctgggaagattaggaagattgaatgatataacatgaatccattataaattaaaactttctaaaagattaaatctgtcttttactgggaaagtaataaattctcatttatagttggagagtacatattaatttaatccaaattagtataatgctttaattcagagagttttgtttgtttttaatggcattaactttctaataacattaatttatttagaaaggggaggtttgtttctactgtttcccccaaaatgttcatgagtattagtcacccataaaatagaaactgcttctcatctg

SEQ ID NO: 68275 - DNA, 1001 bp, Homo sapiens
atacctcttaaacgttttaatagaattcaaatatgttatataataattatgtatggtttacatgttctttggtggcatatagattggttggcctttctttgggcaaggaactcagctttactcaggattgtttttgtaagactatttcctcaagatattctgtatagtcaagaatctctctgtctggtctttgcatttcacattggcttatgtatgtcataggccatatttgggcatttcaaatagacaaaggtagaattgatagaggtttgtggtgaggttttttagattcattaggagagaaaaaaaaaatccctttcttgaattggatgaatgtagaagagcaaaataaagaaatgaaaatcccaaactctcttcatttaatcagccaaaaaaagatgcttgataaatagagtaacttcattcaaacacaaaatagattactttattacagaaaagggtttatacattgtttaaagggtttaaacattgttaaaatggggtttgacctgtatgaactttaaaagtaagtaagatagctgttaaagttagggcaaacatttcattcattcatttattcaacaaacatttactgtctgccaaacactatgttcaggttttatatgggttatcccataactttttcttgaaaatactgttattcctgttttataaatgagaatactaaggttaaagggattaagtgatacgctgtggtccatgactattttgagatggaaacaccacttgaaccaagaaaccttaacttcgagacccaaggcccaagcagtgaagtactagcagtaaataatgcatttgagccaagtttatcatttacaaacacttagttattttagagtacgctccaaggtttaaaaagcaagtttttttagccttgagattcaagcatatatcagttattagagagattagtttttaccagattaaaaactaatttaacaaaaagctgaattagaccacttcttttgtaatattcccat

SEQ ID NO: 68276 - DNA, 1048 bp, Homo sapiens
caccagtgatgtctgcagctttctctatacccagtgtggtggaaggagaaaaaggcagcactcttctttctaattaaatccgcatagcacacttattttctcattgtttcagctaagggtatgctgctatccctgtatttggtaaagagagataatgatgatttgttttataaatgacaaaagaaagactgcttcctgctgcctaatctgcagaggcacaatgatgacatagaacttgctttctccttttcctgagaataactcctcatgttgggtatatttggcccattgaagttatatataattcctattctatgagaatttgttttatacctttgtgaattgaagagaacatacatgtcttgtgtgttttgtttttattgtttaggagaaaactgatgtggaaggaaccttatttgtttatacaaggtaagagtgtttcacttttataaagaaactaatcttcaaaataatattttagctccgttgtgtcactcttcttcaagtgcatgcagttttatttcaaaaagaagtaaaagaattaaatctcagttttgaaattattagttgacacgaagaagggaataccaaataatgtcacctggtatatcgtgatgaatactaatttcagaatataatttaaacttcaatgtagatgaacttaaatcattgactgggcactgtttaaaatagattaaatattctttgattcaagtgaatggcacaaagttcttgaatataatgcattggcaaggagctagaagaacactatcagaaatactagattgttcagttaatatttggaaaagggtttcattgatcatttttcttttttttgagatggagtctcgctctgtcaccaaggctggagtgcagtggcacgatcacagctcttggcttgctgcaacctctgcctcctgagttcaagtgattctcctgcctcagccttctgagtagctgggattacaggcatgcgccaccacgcccagctaatttttagtagcaacggaggtttcaccatgttggtcaggctggtctcaaactcctg

SEQ ID NO: 68277 - DNA, 1049 bp, Homo sapiens
gttgactcatattgagtcgtagcctactaaaatccctagggtccttgtcatataaattgctgataaggcaagccagggttccacctaccctatgtttatgcagtgaattttttcatctaagtatagtcctttacattgtgcttattctatttcatctcgttagtgtggaccatagtttcagcttgttgaggtcatttttattctgactgaaacttccaatttactagctattcctcccagatttgtgtcagcagcacatttggcaaatttgtcttcatccaactttttaatttagtgttcaaaaggctagagccaaagacagagccttgggtcacatcagtagagacctcccagggtaaatgtatcagtgagtcaatccctaggcatctgtgcatagaatcagtgcacctatgaatgtgtcaatcatcagtgcatctctggatcagccaactgcagaccctcctgagtgtattaatcacactggtgatgtgagttctattttcagactcttctacttctcattttttaaggcaatgtcaaccttttccattattgaaccaccattggtaggattatgactttcaaatttaccttttcagcccagatatctgtctcttttacatttttaattttttaattgaatagctgcagaatgttttaatttttcaaagtaaatgcactatctccacgtcctctgaaaccttcttctctttctgtgatcaacttggtgccaccaagttggccaagccaggtacctggaagccattctcagtgcttttgctttcttctcactccacagctaattcaattgagtggggtaattataaatacccttagctgttctaagagattctacctccttaatacctcataatacacccctcggactctgatccgtcttgcctatacaactgtaagaaccttctaactagattctgtactcctggcctgactccttctagccctcatcctgtactgtgtcaccaggaaacaaaagcctcactcagattatgtcagtgtactgcactgaggcctttgctagcaccctg

SEQ ID NO: 68278 - DNA, 1113 bp, Homo sapiens
gagatgaaagatttttttcacttggtgaatcctggcattgtgggaagactctcctaacacagacataattctcttgcaatcccacaggcgcacacatacacagaggcgtcacacacacacagaggcacacccctggtgtgtcatgggcgttgttttgcgtggagaacgtggagcgtgaagacacattttctatgacagtggttcccttggtgtgggattgatggacctgtggacaacaggagttttgttagtgctcttcagggtcccggagatcatgtactagaacacctttcctccacagaggaagagactgcaacccagagagctttgtcacttagacacacaattttactttgcttgggcttcagtttccctatatgaaaagaaaaaaaaaatagaattgccccaaaggatcttaaggactttttcagaattccgtacataatgagtttttattgtcattttctcaccattctttggcctttgtggaactgactagaatagctcaattgtttgttaaggaatttctgacctcaatcagttttccttatataaggagttaccagttttagagcctcatgtcacttggggctgtgtctcacttaaaagtgctgtgagagcatattggattgctgaaaggagaaactgaccacctcttagaagacatcaccaattcaaatgagggtgtctcctttcctagcgaaaacgggcacttagactagtttagagccaccggaggtgggaggatgagccagatgtccctggaaagccagtttaggggtgcttttctcatgttttccagggtttaattatgctccgtgcttgagagaaatatttttgaacctgaggattttttatcttaacgttgaacaaattatttatctttctttttctgtcccctccatagttccccaatgactctaatttttattattgttataaagcatttttccttaaagagtaaagacgcaaataaaaaaaatctgcagcttagacacaagaacaagagtgaatctgacagacctaaggttgagtgaaagaaacatggcaaaggggtgtgttcagcaggactccattcctgttaagctaaaaatgggccaaatgaagctatct

SEQ ID NO: 68279 - DNA, 1050 bp, Homo sapiens
gggtcagggtctgtgagacaaactgagatgtgctggagacattgcttatggatttattgatccctgacttgttcataccatgtgcctggaattcagcacttacacgtttccatagcacaatggacatcagtttaatcataatgggatttcttaagtgattactatatgccaggtactatgctaagtcagttatcaacacgacctcctttaatcctttcgacaatccgatggggaagctctcattagccccacttgccagaagaggaaactgaggctcagagtaggttacatgactaaaagagcaggggctctgcattcaggtctgcctgacccagagtgtattatcttaaacatatgtgacacttcttgcttgccttcctggtgctgcaccatctgtttttccctgtgaggtcccctttccccacaaactggctgtgagcacacccgacccctttcctgtcctgctgcccccttgcctgtcctgctgcccccatccctcggtgctcagcttgttgccagcagagtcaaacacacagactcatggtaaaacgttatcttacatttgtgtaccttttcatgttttcagaaccttttccaggcagtatctaatttaatttttaccatcattctgtgagtgaatattttctgtcttatggttggggaaactgaggtcagagaggttaaatgattgcctggggtggcactgcctagcctctgtgtggtggagctaggacccagtcgaggctcggagttctaatccaccagtctaccctggtaggaacctctgtgcaaagccagcccccatagcagcctctctgtcttgggccaaagatacaaatcagcaacggccaggaaatgatttgcatgaggaactgaggtggggcggtgggcaggagagaggctgaggcagcaagggacagagtgggcacacagaaacttccctctggaggcctcagcctcttcccaaggctgagcatctgcgcagggcttagtttgttcattcctgggagctccaggtaagtctccctctcagagggaaaagctgattct

SEQ ID NO: 68280 - DNA, 1081 bp, Homo sapiens
atgaagatacatggaatcctatctctcataacggcctccagccatgcccattttacagatgagaaactgaggctgagagggagaaagaacccgaagctcagctccagccagagagagttcaggtaaaagaacagaataataagaagggcaaatgaatttccagagttccttcatcccagagtaggatgctcagccttgccaggcagctgcactcagcttcccgccctctctgagcaggggggttggaatgtgtctgcggagggcagcgaggaaggagcctgctggaattccttccctgtggcacatctgggaggggtattccccctggtgatacttgggaaatcatgctggcctcgccagtccttttttccactgttcttttggtctcggagcacccgccaaacatctgacactgttcaggatcgattgcacataaaatgaagaatgggtatttaaaaaacaggtttttttgtgtgtttttccccctgttgtcatctaagaagcaggtttttaggttctttgattctctcccagaataacaaccatatggggcctccacttacactgagcagcctgtgccttgtgccagggactggtttgtttccattgtcagcaaaccttgactggctccaaacattttcacttcaggtggtttctgaaagagggaaagactgaggggaaagtgatgatgtggtccctctgaagagggtttagctttcaagggtatggcaggggtggggtcgacagccagaggggtgtgactttgagaagccaactcaccggcaggatccagcgagatccaggctcggtggctggaacaaagaatgttttgaaccacacggggctctggcatgtttgttgatcgacttatccaaggcctgggccagctgctcttgttccagaagatttcatggattaactccctgggctttggaaaattgtgtcttttttaagaaagggaagttttgaaaagcaaatgctcctgggcaggctgggggtgtggggagtgttggctggagtgggaggtcacattcgccccatggtgggatggccaagggctcccagcgagggaacagttgga

SEQ ID NO: 68281 - DNA, 1036 bp, Homo sapiens
tgggtagcaaaccaatatcagtcacagaattctactgaaaatgcagggtatggaagcatctgaagtcacaaggttgggctggacaaattagagccttcacctccatgagggaagaccatggaccccttactctatatccacactcagcctgcagggacagggcattattgccacgagccagtctgtcctgtatactcactggattagggattccactttcagaattttatcaccttagcacccagcacagtgcccggtacacagcaggtacccaatacgtgtctattacactgaaatgtttattggcacatggtctaaagacagtgccagggaatcctgtgaaaatgcagtgctgattcgggagatccaggatggggatccaagatgatgcatttggaacaagctcccagaggatgctgccgtctggtccgaatcctgggccccactttcaatagaaagggcctaggacatgcagagtaaagtccttcctcctgagttagcagcagctacttgtgcttcattcatgcaggcatgaagctgcttgcaaggatgttagcagatattagatatggctggtggggaggagtaaggagggccttggctatgcctttttccaagatccgggagctggatgctcagagatctcatccctggcttccttgtccactgaaaacaaaacagcagtatacccgggtgaggagagagaccagccaagcacgtctttcaacaactcttaacttgcttggctccagccacgaaacaggaacccgccatccccctagctcgtccctggccctcaggaagtgctgaggctctgccgggctgcatgagtgaggggccgatgtctttcagatgttggggcttcagcgggggagtggggtaagctggggagagggagcatttttttgtgaatattttacccacggaaaaagctgaattctctagaacagacctctagatttttttttttttttttggtagtgggaagtgagttactggaatttcttctgaattcgaagccaaacaaagtttcttg

SEQ ID NO: 68282 - DNA, 1055 bp, Homo sapiens
caggtaatcctcaagacctgtttgttaagagtacaaagccataattgggaaaacagtgaggtcccgattgtcatccagaatgaattaatttacatgcacttatggagtgcctcctgtttgctcagctttgtgcttggtggcatcacatataaaaaggaccaggccgggcacggcgggcggctcatgcctgtaatcccagcactttggaaggctgattgcaggtggatcacttgaatctaggagtttgagaccagcctgggcaacatggtgaaatcctgtctctactaaaaataaaaaaaaaaaattagctgggcgtggtggcatgcacctgttgttctagctacttgggaggctgaggtgggagaatgacctgagcctggaaagtggaggctgcaatgagctgtgatcgcaccactgcactccagcctggtgacagagtgagaccttctctaaaaaaataataataatacatgaaaaggactggattcctttctttcagggaattggccgtctggtctgggaagtacaattagctccctttgaagaacaggagcaggacgagaggatgtgtaattaagtgctaaattgtgtcactaggactctccagggctagatgattcaaggatggcaacacaatgagccatggaggtggctgggggagcctgttgggagagtagggagggatctggagcaggaaactacaagcaaatccaaagagatatccaaggagggtcctgggacaagagtgacggctgagatggggatgacgagcagctgccctacctggatggaaggtgagggtccctgttgtcctggagctgcacagccacttataactggggtcatctgggtctgtggccccctgacagctggtggtagtctgcaggcatacactccgtgtcctgtcgtgagccggtcctcagggcggcatctgcccaggaagccacaggcacacttagcacggcccaagagcactatctgcaggaggcgcttggccccagggctgagctgatggtggttgggtggggtgtaggcgacaggagagcaggtggcct

SEQ ID NO: 68283 - DNA, 1086 bp, Homo sapiens
tgctttctctacccagggtctgagaaaagtttctttggcaaaagcatttcattgccaaaaagaaaatctgaaagctgctgatgtagtttaacctcctttatttaacagttgaggcaaattaaggctccaagatgctgagacctgtacaggatcacacagctccttggaagcagctgagccaggactagcacccagctccctgcttcccagtactcatggtctttcggctgcatagctctacttctctgcaaagggtgctggggccgagattcatggcctttaactatggttcttaaatgttactgtgccgcagacccacccagggcactttgtaaaaattacagaatcatccatcttgaagggccagggtcttgggaaagttgcttcatcttttgaggctctagatggagtgttctttctgcgctgctgaacctggagcactgagaagcttttcctgctctcaggtgcatttgaatttgcatggtctgttttacagggcaggaggtgcaaattcctattgcttaagcccacttacataacaaactggccacaccttcaattccaaaaggcaatgcggctgcccactattgcagactatgaaaagtaaggtagaaacaaactctgggagccacagaggctactcttcatggacttatttaaaaggaagacctctggctctttccccagagattatgatttaggaggtctggggtggaagacaagaatctgcattttaaccagcacaccctcttcccacctccacccatgtggttttgatgcagttcatccttggactacacttggagaaatactgacttacatagtaaagaaccaaaactgtgtaattataggaatcactcaaacacccacatgctaggatatgaggctagaaattcaggtttatgattgtccaagtgggttagagaaagaagcaaggcatcttgatttttaatgtggataacatgtagcacaatgatatcatcctgataatctttttaaaattttttttgttattgagatgtatgaatatattatatattttggatattaaccccttatcagatatatggcttgcaaatattttct

SEQ ID NO: 68284 - DNA, 1029 bp, Homo sapiens
tagtcgccacctttcttgattaggaagctgtgttgtcagtgtgctgacttattagggagaagaatgggctctagcaggcctttaaccatcacagttctcattcaggaaagaaacgaaggcaggtgttgtacgccccgtgcctcccacagagtcccgcaagctgtgagtgtcctcaaaccatccatccatcctcccttgaagggcttgggggaaggggtgtaaaagggaagaaaaaaccctattaattgtacgcacattaagttctaggcactattttaggtgcgtgtgtacaatttccggagcaaatgagtgaatgaatgattagttttaaaatacaattaagagttttgctggcttccccagaacagaaattttctgagacttttcctagatcacttttagcagtaagagtgccctaagaataatggctttttggtcaaagtctcttaatgtcactgaagcttgggaacatgttctcatcgggcaagagaacaacaacagaaaggaactgcattccagttccttgtgtataaaggtgctcctgacctctttggccccaactctaagggtaagaataaccataagttattgccagagggcagcaccttcatggacagagagcaggtgtttgagggtcccatgctccacccaggaagctgctggctccactaagagaatgggctttgggcctgttcagtttctaccaatgtggggcaggcccccaaagctgaacatagatggagacacagaagggcagaacagttaaaaatttaattccacctttgccatctcttatctgtatggtcttgagaaagtgcctgtgtttctgtgagaccttggtttccacatctgtaaaatggggagaatcatacctcccttattgggttgttatgaggattaaatcagtcagtgtatgtaatgtgcagggcatgtggtaaacgttcaagagtgtaggctttttgttattggagaaaacatttgtcaggtatctactgtatgcagacagaggccagacatgccttcaggtac

SEQ ID NO: 68285 - DNA, 1101 bp, Homo sapiens
caactcccaaccttctttctagtttggtactggtaatctgccacaaagcttgttaaaattgggcgcaaaatgaccaggtgaaggtttaagagtctctcctttggagacagtgtttgagatttagtgcctgggttttgtggcctctctctatttggctgttcacaacctttttcttctctctgtctgaagtgtaagcaaggaggaagggtaacagatcgaattgccagatttaacaaaaaacaaaacaaagaaacaacagaacaaaaccaaacacaagatgcccagctggatttgaatttcagatagacaacaaataattttttgtaagtatatcctaactgttacatggagcatacttatactgaaaaaaaaattatttgttgtttatctgaaattcaaatctagctgggtgtcctgtattttatctgtagccctaataccaggactgtggctgggtgggcagtgtctgatctgtaatgacagcagagtcttcagtaagagtgggggctgggaaaataaattaatgggttgcagaatgtatagtgttaattagataatgcttcctggaaaagacggatcttgagctattatttacagggcagtagggaaatgatgtggccgctagctgcagaaagagcaactcatatgaaaaagaatggcagaccggagaggccaaggctcagagacacatgcacacaccaaataagggtctgtttactttgactgtaaaagtgtattactttttgactgcaacaatgtttcatctcctgcctaacataatgaccagtttggttcctgtcctggaaatagagaaaacggtgccaccttccccacacacttgagttgatctgacattgatagtttgaaaactttggttcccccaggcagtaaatttaaggagcaaccctgtcttgaaaacggaattaggttaccaaagacttccggcagttgagaatttcttgaaatccagaatatcatattttcccaataatgccttcttgcgatctcacacatcatgcttttaaggccgattgctactactgttaggaaatttacctgtgatggtctcaggtaatagaagttgtggataagttgaaaatt

SEQ ID NO: 68286 - DNA, 1030 bp, Homo sapiens
ctcctcaccaccttctgctgtcctttgctgaattgccaagaacactctgcaaagggacctgattccatataaatggaggggtttttgtttttgttttaaaatgagttcctttgatctgaagagcccaactcggatgtaagtgccttaaaacacactgtggtcccagcgcctggaaactcctggagaaagttcacagcagtcactcagccacatgaatcctacataaaggaagtggccatctgagccaccctggaggccctgggatggggatttaaatacattttgtagcagaagagccaggtggctaatctccgaggctccagagcactttagccaatgagattatctctactttctgtgtttttccaaagaacaatcaggaaagcatcagtggatgttctaaaagttctgttttgacctttctcccagccctctcctcccttcctgtcaaatggggcagcccaggcctcaggagccctactggaaataccacgcctgtcattgtgagaacttatttttcccaaagagaggaggatattccgctctctgaatcaggggaagggtttggagaggtattgcctatccggatgtcagtcacatggacaatgcctcttctgccacttctccagaagcctggcccattatgggtgcaccccaggtactgaacacagtggcttcaggccccctgggaaggcgcaagcaaaccccagcccaaggtgctcctgggagctcagtccactttagaactcctttctactcttccctcttcagtttgtggtatctgagaacaattctggactcatttgcttaaattttgctttcagttcagctccagtagatttggcccatgactcaagacataggagacccctcagactaggctaggaccagatgagtttggagatggtgtaagggacaggaagacagaggacctccgaatgcacagcctctcctacccatggcatgcactgagcacttggttaccggtgtgctgctgggtggtatcatctggagtcatgaaaccgtggaa

SEQ ID NO: 68287 - DNA, 1030 bp, Homo sapiens
tgttctagatacagcaggtaaaaagtcctcatggcaaagaatgcctgcagtcacacaggaacgtcacatgtgtgctaaggcacacacacattcctccagtcacgaactggtctctttttgatttgagaacaaaatgtaggaggcagtgataaatgttagggttacctccaactacaagcaatattcagcatccgttcaaggccttcagactcaaagagcttgattagctgatgaatcggcccagtggtctagaaacacagggacgttatccctaatttagagataggcaaatccaggctatctagttcagactgttttccagtcgggataactccctccaggacttggtttctgttgtttggaagagaacacagcttcctgagccgaggggaatcacattgcttctgggctgtagggcgccctgcctggctctagagattgagagtagttcatagtttgcctgttgccttatttatgtttcaagagttgtgagccccttgggtggcaggacctgatggcaaatagtattgttgtcacctcaggaattgtgatggggtgggaggcactccggcctgccggtgaggagaccagggatctaagtctggccagctgtgtgaccttgtcatttaacctctgaccctcagcctcctcacctgcaaaatgggagggtacaactgtattcgccctagagtattagcctttagatgcctgccgtgctcacctttcaccatggcagttgccctctgaatcatgcgtaattttcagtcagctgacttcttgagcaccctcttgcatgttagttagtttagttttgttttgttttgttttttaatatttggcttgggaacgtttcagagccaccaaggttgttgccatttctgttgggggtaccccagtagactatgtggtgtatgaccccaaggatatacagaatcacatcgggaggggaaaaacttgttggtatatatatacatatatacaaacattagccaggagaaatggttctgtgcctctcacaaaaagctcacaa

SEQ ID NO: 68288 - DNA, 1012 bp, Homo sapiens
cattcgctggagtcagagtccctgctgggaagaggggcccaggacacagctgcagaagcctgtcctctcaaatactctgcaatcaggagcttgctgtcccttcgttcccaaacctgccgtctgatcacaagccaggacccactctgtcactcttagcacaacacgatgccgctgctatcaagcccttgtccacccacagagtgggcagtgcagacaaggagggaaaatacgcgagaacccagacatgtctgtgcagccgtggagtagaagaccaaatacttgcaggctttgaaaccaacccctgagtgttttggagagttttatataaactttggaatgggtggtttaatttttttctttctttctttctttctttttttaaaatttcagactttggattgaattaccctattttccgcaaatttagattacacaaaagtgctttgtgagcctttgttgtaatttttgatgagatttacatcaaattctttttatagtccaatattatttcacagactgtgaattttatgtatctctagatttcaaaatacgtttgattttgagccatgtttccaataaaatccataaagaaagttatggaattgtccaggtgagccatgttctacctctagactgcccttccagggagcagccccggtgaaggcggtctcagaagaggcggcgtttccctaatcccggaggcatctgcaaggcgccttctcagctcctcaacagacacatcaccatatgccgataccttttgtttccggttgtcccatctgtttgatggtgcactgagccaggtcactctgaatagcttcccaatcacagtaattacccctgagactggcacagagctggttggctaaaacctagaaatgaaatcatcttcattctatttactccttaaagttgagttttaaaaaagtaattgatttttgtcttcagtgatttctccttggaatcactaactggagctctcccaggattgcatgtttgtgttggtattaac

SEQ ID NO: 68289 - DNA, 1058 bp, Homo sapiens
agtgggcagtcagagggtgggggaacagcggccgtgaacccttccctgacacctccctttctcctcctccccatggtcttggggtcacatacgcatcttgatggaatggttgatgaagagcgtctttgatttcttccaggtcttgcctgagaaacaaggcatgagcttttcaccctaacgagtcccctcccccacccgccagccttaggggaaggtcatttttccagtgcgtcccacagtgcaaaaccctggtgtgcaggcatggatgagctggccaggctggcacaagggttccgttcaactcctcctcccatgcagagttccttctgccctcatccttttcttgcctctttcctcaaaagggagctagaaggcagaattatgtattcttagggcagaagagaagaagtcctgatcttctaaaaagaagttatataaagaaaccatttttattgaattgtgtagcattgtgacatgctattcaatttttactttttattttactcttaccttaacatattagaatagtccatcagacaaatgcattggcagcatttttactattccccaaacatgctgctggtcatgtgatgcctatttagaaatacactttttttttttaatttttattttactttaggttctgggatacatgtgtagaacgtgcaggtttgctgcataggtatacatgagacatggtggtttgttgcacccatccacccgtcatctattaagccccacatacattaggtagagaaataccacttctcgagagccacccaatcaatagcaaatcttcgtttaccttaaagttgccccttttattacccagtagccaacactactttgctgcgctttgagcctctgaagtgccagatttttgtacagcctaccccacaggcaaatccacactccatatttgagctgtctcgattctggcaaagtccattattaggaaaaactccagaaaatttattcttcatagtgtctccaacttcagcctgagaaatgacttgccagaatccagtgttgttctccagaatttgggcgaataaagc

SEQ ID NO: 68290 - DNA, 1092 bp, Homo sapiens
atcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaacctctgagcctctcctaggagaggcaggtgatggtctttctcctatgtcccatcctctagtacataacctgttaatagaagaaactatgctcatagactggcagaccaaacctctccaggcccagccccccagatccactcaggcctctgttccaccctcctcccatttcatcagccacacagaccaacctcatataaaacattcagccagggctggatttgctcagggctcaggactgagggctccagcccatgggcactcctgttccctgcctaagaggctatggcattgctccttacatgctctggggcaggaagaacaattaccagcaaatttctctgctttgttccttgtgtaagggcaagaagattaggcctgctgctgaatgaggcagggtcagaattcctgttctttggatcatctgtgcccttcctagccagtcacccccattgtcctcagtggtggaggagcagacactggtatgagccacaccttccaccctgggcctctgtagatgggtcagaatcacgggtatccactggccgggattcaccaccaggacagctgcttctgagggaggctataagagcaactgagcagcccccaggctaccataacaccttttggagaaggatgagaaggaacgagttctaggagcatcatgcagttacagacttgagacaatctctccagcttactgagccttcccctccctcctttggtagttttcccagaggcaacacagatcaacaggaggccaagagcaagaatccctggccatatcttctattttcattcaagttt

SEQ ID NO: 68291 - DNA, 1074 bp, Homo sapiens
aaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatccaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagaaagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagctgagatctagagatccagatttagagtgttctgtaaagcctagagaagtgtccctttctttctcctccctcacctcaccctatatctccaccatcccctaaaagggcatcctaccaactagctatgaaaaaaaaaagaatttgctgagaaatctgttacccaagaaatattttcaggctgcaagcaaatgtctagttgtgcacatttccatccttcaaaaattccataacacattttccttgtttgtaccttaaaaacagaaatacaagagcaaccatctgaaagtggagagtaaaagccaagtcctgactttctagaaagagttagcagctcagat

SEQ ID NO: 68292 - DNA, 1035 bp, Homo sapiens
ctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagtccctgggagccctgcctggctctcactgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggtagggctccagggtaaggagggaagacaggtgctctaggcaggagatggaagggtggacgatgattcctgttaatcagtgtctgtggctcctagcttccctgtgcttcaagtgaaaggccaccataaaaggtttcagctgggatttgttactgagcgcgtgattgaatttccagtcactccaaccttgctatcccttgcatttttctaaattcctgaagtccgttaaaattaggctgcagccactgttccgcagcaagctggaagcagaaaaacaagctccgttgattggaccactcctgttgtaggagtctctgattcgcgttggttgaagtgataaaagagacgccattcagtgtgaccttgaagcctccttggcccagccgcctccaaaaggctgccgttatgcatttctaaccgggccaagtatgagtttttagaaggaccagtggggttgattgaccaagccaccaagtctgcaggccgaggcaagcttgg

SEQ ID NO: 68293 - DNA, 1023 bp, Homo sapiens
tgcacaagaatttactggacaaaggggttttgtggtaaggaacaaacctgaaaaacacgggcctggacaacctggtgaccgctatggcccttcgagttcagcatttccagaatctggccatcgccctcctccccgtaggcgtttcagcagcatctgctgacagcacctgtcatgtcctcggccagagtcgcaggaccctggtgtcctccgctcggctagagaggcccttcgaatgggcccaggactgcctggccatgtgatcagttcctccgctcagccattgttttcccattaaaacagagtgacaatcagcccctgccagctcggaggagtctttgtaggtttgaagttaaggagaagcaaagcgcttgggtcacttgacttcccccagatgagcgcagaacccgtgaaggcggtttcatgcttccctgggctggcggaacgcaggcttctctccccccatggaggggccgctctcagcctttccaagacgagaatctgtcagggaagatggtctttgtgtgccccaccctggccagtccctgcccggggacagggcatgcctgggcctggtccaggtgaggaaagatgcccgtccccgctctgcccccagcagcctcctgccagggactgaccatccaaggctctcgagggagctcccaatggccaggctgacccctgcctagtgatgagctggggctcctgcactctgagcccagctcagcccaggctctggggattcggaatagtagacaccagcggaagcaggactgccgctgactctgtacttgggtgcacgcggaacccacggctgtgagttgccatactctccctgcccccccgacatctcctggggctgggaagaggcacagaccgggtgactgcgagggcctgatggcggcgcaggcgttcgggccaggcagctggcgcctgctctgacggcaccctctagtgaccggtggccacggctgaagcggcgcccgggaacacgggctgggcctcccatcctggggaccatggcct

SEQ ID NO: 68294 - DNA, 1003 bp, Homo sapiens
ctgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagac

SEQ ID NO: 68295 - DNA, 1161 bp, Homo sapiens
gtcagtgggctggtaggataggttcgaggtggacacaagctgtcacaagcagaaaccattttctcaggaccaagctcagggaggaatggtttatcacagtctgttaactctttcggtcactcttttttttttttttctaccgttctgtaactatattgatctctgtctccccttctcctcatcacctcccaacaccttactcccccttcaaaggtggactgtcttgcatcttaaactcttttgttcagggtcacgtgatcttttacagttcttagacctggtagcacttaatacaaccaggtacctcaccttctggtcccatttctaaaggatgtccagcttccccatgagtgtggtgcagtaactcttcaggagcactgtttgagcccagaatcagaaccctgctaaggcggtcctgtttgcttctgtacctgcaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtgagtgtttggtcactgagatccaggctaagagccaggccttatctcagcccaatgcctggctgccctccagcccttcctgcttcttggagacaatgtagccaaggctgagggtctggccttatgggaggagaaatgcagagggctctgctgctgctagtaatggaagtaatagaagcttcgggtgggaagaggcaggcacaagcccctctccagactcaaagcatggtcagggttaaggcatctttatctccagagcggtacccagaagaatactgaaaggagtcgggatgtcagaaactatgtcccgttataaatggcagtacagaatattggtgctctagagaccagaagagggagcagtagctcccctgtgggtcaagggctgagaaaaggcttcactgaggagatagaacttgacattgttcaatctgaaaatggttgagccaatccgtgggcccttgaatactgagaaactgctgagagatgttgggtaatcatttctaatacctaccaggttgggcttatcaggtagtgtgaattaggattatctgggacgcgtcctgatatgtccgtgttag

SEQ ID NO: 68296 - DNA, 3001 bp, Homo sapiens
gcccatgagttagcatgggaaggaattgtgtcacatcttgtcccacaggtggagttgtttgagtttaagggagaagatctgacggaagaggaagatggcggaatcattcgcagaatacagactcgcggtgaaggctatgctaagcccaatgagggtgctatcgtggagggtgagacagtacagtctgggctttcaattctcattctgatatttaggccttgtgtggctttgggcaagacacttccgttctccgagcctatcttcttgtccataaaatgaggggttggaccatattctcttcatatcactccagatttgagaacacaggagaatcttgggatgatgggggtgatgcagggaggctgatggcatccttcctcagtcacctgccctcttacaactctggtacactgcctctctttcatgccagttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccaggtgaggggtgggcacttcgtagggtaggcaggcaggcaaaccaagatcaaagatataaaatgaattgtagaaccagctgtttgtatcctttttaactctggccacaccaaacatacaccattatgatatcctcagtgtacttagaagtatggcccaattgtctacatctccttggatctaagcccagtcttttcagtcatagttgctacagattctctcctctgccatcaagattttcctctcccattaattcatttcagtcattactgaaacagctactacatgccaggcactgctgaaaattcctatagggcttcagagactaatagaacattgtttctgccttctaattctagctcattgtttagtgaggtgctatttaaattagtaatcacactgctgcctggctgtaagttattagaagggtatgaaggatgctgagggaccatctgacagtgtgaagaggccagggaagatttgccaaacatttgaaccaagtctcaagggatgggaaggtactttccaggaaatggacaggaagccttttcagcctggagcaggttaagtgttgccaagatgatacatagtgtttttcacccctccagctatgcttttggcagtgttgggaaggaaaagttccaaatcccaccaaatgctgagctgaaatatgaattacacctcaagagttttgaaaaggtaagtttgctcagggtcttcccatctaaagtcaagttccaccctgtacgtgactctggggtagctgacaactttgtttctctcctggggtgtggcaggccaaggagtcttgggagatgaattcagaagagaagctggaacagagcaccatagtgaaagagcggggcactgtgtacttcaaggtgagccaacagtcattgtcctaaggacactcccaggaagagttgctctgagcctccccttcccttggtgactgagatcattttctgccaagaagtggacaggttggcacctgccatcttcacttcatatatgtgagcttgctggccttgccagtgggaagggtgggagcaggaacctcttgtggccatgtgtcactgatgtctgcagggtataagagcctagtaccactgaaactgtgccaggtgcctgagcctctctcccattccaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggtgaggccccctcagaggtcatggaagcagcattcacaggcagagttgggtgagctgccagcatgtctgaaacttccccttggtgactagggcagggatagcagggtggatcagtgggagctctgaggttacagaccaaaggcacggatgcaagtattcatagcaagaaccttagctttggtgggaagcagttggcaagaaggaggaggacacggaatgggaagaatcacataaagagttttcttccaccttggttcttagcctctccgcttacctacttgctttattctaaagtgaatgttaatgtctgaagtctttatttcatccaaagacctgctgtcttccctctctgcctgttggattaaatgaggtccctggattgttccatttaatgcctcaggccttgttcttcctggggtgcagccagccacttgcattcctcctcatcctcctgaggggtacctttggaacccagtctaggccagatgagctacaagccctgagctcccacaatgtggcttcctctctgcattctttaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggtgaggattggggtggggaacagttggaatagcatccctccacttaacctggctactgtgggctctttgtgcctttggttgtctgtgccaatcccggaaaccagaagttgccttttccctggagcattaaggagcacgtgttcctgctgttggggccagtgttctgtgatcagtgcgggaaacctacccacaagccccagaagttgggttggttgccctgagtgtaattcccgatttatgttttcttgtgggccaggcgccgtggctcacacctgcaatcccagcactttgcagagccaaag

SEQ ID NO: 68297 - DNA, 1413 bp, Homo sapiens
aagtgatcctcttgtctcagcctcccgagtagctgggactacaggtgcatgccaccacgcccaggtaatttttgtaatttttgttgagatgaggtttcaccatgttgcccaggctgatctcaaacttctgggctcaagcaatctgaccacctcagcctcccaaagtgctgggattacaggcataagccaccaggcttggcctatacaggtatagctttaggacagatgtaggagaatgggtgtatctgtgtaattctgctggaaattaagtgtgtgttttttcacttgggaagtcagcccgtttgctgttcatcttccttgcaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaccctttctgttcagccttggagtggtgggtatgggtgggtacataatgggtagtagcacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacactt

SEQ ID NO: 68298 - DNA, 1221 bp, Homo sapiens
aaggatgcagagaactgtgactgtgccactgcacgccagcctgggcaagagagtgagaccatctcttttttaaaaaagtccctgtgtaactgctttcttactgggcttacctcacatcacagccctgtgtttgtggtttgtgtctgggtcctcttggtatttcaaaagtagtagattcttacgcctgcagccaacaataatcactaactcaagcatttatggagtaagcctagcactgtactgacagcatcacatgagtgaaactgaatccttgcaaccatcctacaaagaaggtataactttaataaccctatttacagataagaaaaccaagactcagaagttaaatggaaaggtgaggtctctgaactaatccagactctcccatgaggttcctttggcaagtcctgggcttctgtcctcatctgcaaaatcgaaagcattcctgaggtttcttccagctctgcatcctgtaggattccaagaatgtaaaactgcatgtaaccgtggaacatctagagataagtcttagtttatgtaacattaaaactgtctagtgaggatgttttgttaaaatgcctacaagtctttcagcctaaaaataatcctgccacatactcaagtctgccctgggtcagtgctacaagttcatttcccagtcagttgtccctgcctaccgacacttaaatctttctatatgcagagaaatgtgcctgaagaaagaaaagttagtagcaagcagtactgtgagcttttaacaagctttgcaagtggtctctagaaaaatttaaaatagggtttatcttgccctagtgctggttctaacatcgagttccatgaattttatctcccaagtatttctactccctccatactagtaccgctccctcccatcaccatgcactccagcctgctctcctgcaaatcccaggctcctatctgggattccctcctgcccctcctgcagttcactctgtactgcatcccaatcgtgtccctccgagtacttaaatcactttcaatgattacccatcccatttaggctaaagaatccttatcatggcccacaaaaccctgcaaggcttggcaaagtgcacttaacacttgccctcactctatgccagcttcgccaccctgagggtgaatggaggactgtattccatttccattggagaaaaaatatgtgaaaggcactttatgcaggactagtaaagtgtagta

SEQ ID NO: 68299 - DNA, 1042 bp, Homo sapiens
aggctgaggcaggagaactgcttgaacctgggaggcagaggttgcagtgagccgagattgcgccactgcactacagcctgggcaacagagcgagactctgtctcaaaaaaaaataaaaataaaaataaaaaaaaaaaagataaaaaggaacagcccctggtccaaaatcccagataaggtagaatcattttttttttttttttgaaacaccaagtgcgagtcagcctgggtttttagacctaaatctaaaaatgtattgaacacctgtatgatttcataaatattgccctgattgacgaggcaccccaaagaaaggcagaactggattcaacatggaaagaaagtatcccaagaagccagccatgagagtgacagtcccatctgtgctacaagagtaaggctactgaggttgagatgcaagagctttgtgctggggggccacaagacagagcagatccggaatccaggcaaccttcacttccagcctgaagactctcctacgaactatgatagtaaatgatggagaggccctagggtttgggatcaaacaattctggtttgagcacgcaccccgccccacaatccttccttctgccattttacttaatcttgctgaacctgttttcctcagccaaaaaaaaaaaaagctcgcatagtggctgaactaattatgtgaaatatgtgaaatgtgctttgcagcaggtggcttttaaactattgaccagaaaacacatacactgaaaaaaaaaattttttttacattataagccagtatacacatataagtatatacaattgaaacaagagtttcacaaaaactgtacttaccttactacctgggagtcacttggtatattactattgtatttaattttttatatgctgattgcaactcactacattgttttcactcctaatgggtagttttttaaaaacacttttcaaaaccatgcaattatcagttattacgaagattagtaagattctcaggaatggtctgatggctaggaatcttcattgccagggaaacaaaggaaaaagg

SEQ ID NO: 68300 - DNA, 3360 bp, Homo sapiens
ttaaagtatagtcaaaaatgggggcaataatttgagtaagtctagaaatgtgatagcctagctctattaaatacagagtttctattttattttaagtgcaggttgtcttaaccgcctcaggtcttcatgttgctgtctgggtaaaccaaacctacagcacagtaacgccgttaataaagaccatcaccatggttcatatggcgaaagtcttcagtgagcgatggtgattagaaaacctgcccgctcctcctgcttcacagagatcagggagtactggtctcccttagcgtctccctgagcctccctttctctcttacagctgacttgcgttggggttggagacgtgtgtaataaaggaaaggtaagaactataggggaccttccttggttcttagctcacagtggaaatcagttgaaggttaaaggcttcagctctgacctctgtgatctgatgatcaggcttgtttccaaaactccctccccagtccatctctactatacctctgtttgtcctagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcggtgggcatgcctacctttgcaggcagccaggagagtaggagtcagtggatactagagcatatcccaagggattggggtgagagggagaatccgtattcatgtatgcatttgttatgtgctgagctcccatgataagccaggcatcactcaaggcactggaattgccatagtgaataaatagacaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaaaatacaaaaagtagccaggcatggtggcaggcacctgttatcccagctactcaggagactgaggcaggagaatcgcttgaacccgggagacggatgttgcagtgacccaggatcatgccactgcactctagcctaggcaacagactccgtctccaaaaaaaaaaagaaaataagtgcagccgaccacggtggttcacgcctgtaatcccagcacttcgagagcactttgagaggctaaggcaggcggatcccttaagctcaggtgttcgagaccagcctgaccaacatagtgaaaccccgtctccagtaaaaatacaaaaattgggctgggcacggtggctcacgcctgtaatcccaacactttgggaagccgaggagggcagaccacaaggtcaggagaccgagaccatcctggctaacacagtgaaaccccgtctctactaaaaatacaaaaaaaaaattaaccgggcatggtggtgggcacctgtagtcccagctccttgggaggctgaggcaggagaatggcatgaacccaggaggcagagcttgcagtaagccgaaatcgcgccactgcactccagcctaggcgagagagcgagactccgtctcaaaaaaaaaaaaaatgagctgagcgtggtggcatatgcctgtaatcccagctactctagaggccgaggcaggagaattgcttgagcccggaaggtggaggttacagtgagccaagattgtgccactgcactccagcctgggtgacaaagactctgtctcaaaaaaaaaaaaatatatagtaagtgcaatggagaaaataattcacagaaagagctagagtgtcgaggtagaggtagcaattttaaatggagatgttagggaaatcctcactgagaaggtaacatttggtgaaaaaaaaaaaaagtggcaagcaagggaaccatccagatagggggcttgtaggtggtgggagatacgtgggatgaattgggacactttgagttgcatgtttgagaagtaatatgaaggcagagagcggataggagctgcggaacagatggaccaaatggacgggcaagatgccgcaaacacaggcaggggcgggggcagactgagggtgaagtgagtagcaccgcagatcgggtgtgaagccgcactggctggaaggtgccactgttagcagaggagcgggggctgctcgtgggactccagagcccatcttgtctttcatgcccacagatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcaggtaagaagctgactctggggaacaaggccccagggagctgggaggaaggtctcctggaggaggtagtgggagagcagtcatgggacagggccagggtggggagaagtgaaaagtcaccttgtcaagagagatccaaagaccatttcaaatcaggggcttaggggaaattgctagtaacaggcaaagagaagggcatgttgggctaagaatgaggagtgtgaaggtaggtgtggagtgggccgcatcaggacctagaccccagctgggacatgcacaggggaaagcatgtggtctgtgtggagaggacggtgccaggcaggagccctggaaactcgaaatccttcctcctgctgctacccttgaagcccagagggctgttcccaggactgctgccctgcccctgcccccgcccccgcccacccaccgccccctgccgttctctgcagggacccacttccttctctctccgtctccctttaatcccattccctggtgcaggtggacagcctctcagtgactctggggccactgggtcttcctgaactgatggtgtctcagccaggttgtgcgtatgcaattctactgtgtacctggaaaaaggacactgggtcccctcctgcctctgaagggcccacggatggtagtaggtaagggggtacaggccagtggatggtgtgggggtgcatggaagcaggatgggctcccagatgccacatggtagtaa

SEQ ID NO: 68301 - DNA, 1023 bp, Homo sapiens
gtatctgtggtattggcaggatagggaatatgcattacagaaatgcaggatttgactctgggcatgaaagatggcagcagccctagggtgaccgtgaactatagacctcgcagtcttttcggtgaaagaagagacaagttgaccctctgcccatttccttatggacctcacccatcatgccagcagggtcataggaccctggccttgttccaaatcatctgggacatgacccactccccactgtcactgtgttgaaaacagagacttgtttgtgtggccccaacacccataaggaaaccaggctttaggcccaggggagcagtggaggtaagggctccaccccatcttaagctctgtcttccgtggcacaattccaagttcttgacgttagtaattgttaaaggaatggcaaactgttttgttttgaaggatctttctacagtctggtcttacccatgttcctagcaaccctgagatgattttcttccatttaccaaagcagccgggtcagtgctttctcacgttgccgtattcttcaggtattagtcagcttcagaagccctgctcccatttttccacccacccattcccccataaaacagcttattgtctccaagacaatagacatttaaaatgtgatgcgggtttatgatccagaccacaatcagaattatatcttgggtcatttatgtgccgtctgttcttgattctctatgctctaaatcggtgtttttcaaactgtggttgcagtcctttggtggattatggccagcattttttaaataggtagaatagaataaagtaaaatagaaaatagcagagtacattgctctcagtgtaggtaagtattgttttgttagtcatatgtgcatgtgtgtactgagtgccatgtaaaatgtattcctgctgtggtaagctgtggtcgaggagtttgaaagccattgctttcaaattcctctcaattatactgaccctagtcagatgggtcagcctgggcaagggcccacatttacatttcctttc

SEQ ID NO: 68302 - DNA, 1076 bp, Homo sapiens
aacaaaaggaccggaaaagtcgaggggtgcggtggctcacgcctgtaatcccagcactttgggaggccgaggtggatggatcacctgaggtcaggagtttgagaccagcctgaccaacctggagaaaccccatctctactaaaaatacaaaattagccaagtgtggtagtgtgggcctatagtcccagctacttaggaggctgaggcaggagaatcgcttgaacccaggaggcagaggctgcagtgacacaagatcatgccactgcactccagcctgggtgacagagcgagactctgtctcaaaaaaaatttttttttttaaaaaaaggacgtgagtaacatgccttagaggttgggagggaggaaaggctgtttcctactggggaaatcagaaaaggtttcaaggaggaggtaacatctgagctgggcttttgcttgcagaatgcggacccagaatgattggagagcaagaagagcaatccacatagaagaagcacagagcaaagacggtggccgaggaccagtgggaatttattgcgaatgttcaatagtgactgagtggttaagtggttccagagattacagggccaatgccttagaacacatgagttttttccagaattacgttatccatgcacacacaccatttgtctgtgtagagcacactgaggagtacttacttaatttaagtattgtattttgaccaaggaaggggggcagagtaatggtggtgacagatggagttgcaccgaggagacatggcttggggcagggaggaaggaggtagaggatcctggttaggtccaggctagggagagaggtgccctttctccctccctccctctcccatcagggcagagcagaaaggagagcaggtgaagtgagtgcaggcagggttgttaatgaaagtgtgtccctgggaggcctctcaccttgcagttgaccagaagagctggaatctctgtcctgctggtcttcctcctgctctcctggccatgaatcaggtcctgcatccggggaggctccccctgaagccaattcgggtttccctccaccaggcgtctttggatcacact

SEQ ID NO: 68303 - DNA, 1061 bp, Homo sapiens
tagtatgcttgggggaagttttgtctcaaacttacatttttttttaactaggagggttttttttttcttcccctctgacctcatccttcaatgggcttcagatcccagggttgatggtatgatgaaaaacagtaagaaactcaagaactaggccaggcgtggtggctcacatctgtactcccagcactttgggaggccgaggtgggtggatcacttgaggtcaggagttcgagaccagcctggccaacatggtgaaaccctatttctactaaaaatacaaaaattagctagatgtattggcatgtgcctgtagtcccagctactcgggaggctgaagtgtgatagtcacctgaacctagaaggcagaggttgcaatgagccaagatcacaccactgcactccagtctggttgacagagcaagactctgtctcaaaaaaaaaaaccaaacaaaaaaaactcttaagaactaggatgctgggagtcatctttgacctgtccctcatctacaaccactcccattccatccagtcacttcccaaattctataagttttgcctcctgtgtagaatcaatctgtccctcctttccttctctctcttctttcttttctttctttttcttttctttcaagatgggatcttgctatgctgcccagactggactctaattccttggctcaaggcattctctagcctcagcctcctgagcagctgggaccaaaagcatatgccacagtacctggcctccatccttcctttctgttactgcctgtgttccagactccccacagctctctcggatccttggaacaccttcttaagttcataacctgtctccagacctgttacctttcaaatacatctgcttggagcttcagcctggaagctaaaaaccttgctactccaaaatgtggtcctcagatcagcaactttaacatcatttcgaagcctcttaaaaatgcactctcatacctaccgaatcagatgtttcattgtgacaagatccccaggtgattcatgtgcaggttaaagtttgagaagcaccaaagtaaaacatgaaa

SEQ ID NO: 68304 - DNA, 1050 bp, Homo sapiens
caagtgatccctagccaccaattctttcttttttattttttatttttctgagacagagtctcactcaggctggagtgtagtggcgcaatgttggctcactgcagccttcgtctcccgggttcgagcaattctcctgtctcagcctcctgagtagctgggactacaggcgtgtgccaccacacccagctaattttgtatttttagtagagacgaggtttcaccatgttggccaggctggtcttgaactcctgacctcaggagatccacccgcctcgccctcccaaagtgctaggattacaggtgtgagccactgcacccggcctgctagccaccaattctgatggacacacctgggcatctgatgaggcagctaagtggggtgttggattattttccctctagcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggtgaattgttccgtccctcactaaagaaatcagatccagtgtagggaattcctaggtagggaaatggatcaagtggcctgatggaccagaatttccaagttctggtattagctctccacttcatgctattctgcataacttttgagctatttttctgcctgggatcttttctctcccatctgtgaaatttccttgagggcagagtcccttggtcactctgtattccagccagcactgggtttagtattttgtccttagtaggtattcaggaaatgattaagaggtcttcattttgggaatccacctgaactttaaagatgcttcccaacagtatgaacagtatgaattgaatagaatacaacaagttaattttattagaagatataatattaatagcagataaagtcagttatatatatacacgtatatatattttttttttttaagacagcgtcttgctctgttgcccaggctggagcgcaatggtgcagtcatg

SEQ ID NO: 68305 - DNA, 1570 bp, Homo sapiens
cggggaggggccggaggggtccccgccgcgtgggtgggcgagccgagggagagtttggggacgcgcggaagcggcgtgacaggcccgggtccctgggcccgcttttcctgccgcgctggtcacgccaggcgacacgcccccgcttcccctcaggctcctctgctccccttttcaaagctcggctttagttgatttcctcactgggggaaatcgtaccccattttcccacagtgaacgatcgtctgctccccccgattagactaagttcctttgagggctgcgtattatctccgctttcttccatcttgaaaaaaaatgtcggcaccatgaaccctacctcagcgcgaaacctgtcttttgcccctcccgaagccaagccttcggatataatagaccgtagtgctttatttattgacttagtcaaccagtctagttgagcaactgctgtgcgccaggcaccgctaggccctgaagatacaatggcagacaaggttctttccttcccctgggctcacagcccaatcctggaagaggggcacagacattttaatcaaataaacaaatgtgggctgggcatagtggctcacgcctgtaatcccagcactttaggaggccgaggcgggtggatcacttgaggtcacgagttcgagaccagcctggcaacatagcgaaaccgcttctctactaaaaattagccgggcgtggtggtgcgtgcctgtagtcccagctactctggaggctgaggtggaaggatcacctgaggccgagaggtggaggctatggtaagccatgatcacaccactgcactccagcctgggcgacagagggagacaccgtctccaaaacaaacaaatgttgaattattgctgtaaattgaaacattagaggttaatgatactttgagtatttacaataacgagatcttgagaggtaggacaggaaaggcttttgtaatgagagcttggtgtgagatctgatgccttttacaaagaaaggagggaactcctctaagcagagggaatcaggcgtgcaaaggctggatggcaggaggaagcacagtgagtacaaaggctgagaaatatctgaggggtttgagctaatcgacctgaatggagtgtggtgtgagttgaagctggagccggaggaagcagagccttagccataccgagaagttttgtgcttatccaagaattaaaggaaaccagtcataagctttaagcagaagtgaatccaggtcagatttgcattttaaaaggtccctctatagcggggattgctagagtggattagggcagaacagttggatgttgcaatactccaggcaagaactgctggagcttgaaaaagggtggcagggagagagagagaggaagagaaagaaggagacagagagagtaaaaaaggggcattaagaaaacatgtttaagaggtaaagttgacagggcttgatggtgggttggatgggaggtagaagtgtcaagattttcagctgcataactgaaggaataatgacactattccctgaccaagggccctggaagataatcactttggccaagggacgggcggg

SEQ ID NO: 68306 - DNA, 1271 bp, Homo sapiens
tttgtttgtttgtttgagacagagtctagctctgctgcccaggctggagtgcagttgcgcaatctcagctcattgcaacctccatctcctgggttcaagtgatcctcagcctcctgagtagctgggactacaggcatgtgccaccacgcccagctagtttttgtatttttagtagaggtgggattttgccatgttggccaggctggccttgaactcctggcctaaagtgatcagcctgcctcagcctcccaaagtgctgggattagaggcgtgagccaccactcccagcctaacttttgtatttttagtagagacgaggtttcaccatgttggccagcctggtctcaaactcctgacctcaggtgatccgcctgcctcagcctcccaaagtgctgggattacaggcgtaagccccctcacccagccatgtcacctatttttttttttaacctcagcctgacaccatgtttatcctgagttcttgccatttatcttctcatactgtgtccagatacattgaatttgtaattcccagaattcacaatactccgtctcgtctccatgcctttgtgtacactgttcctcaggctggagtgccctccttgcttttttgtttcttctatgcctttcatacctaggtcaggtatctccctttccagaaagcctcctttggaatgaatggaaccatactgtattctcatacagtgttgtaaatgtctgtttccctttgctagactttcagctcctcgaaacagggatgacctctgtatcactacaagtgctttgcactcagttaatgattgttgaataaatggttattcatctttaaattcccagcacccagcatgacacttagcacatactcaataaatgttcgttagatgaatgttgaatatgaatattgtgttttgcttggtggttgtaggtataggaggctgtgctccccaaagccttgaagtttatggtagaattggctggcagaggatcaggaagaactggggaatcatctgaattatttgctcccagcttttgtttcttctctacaggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagccc

SEQ ID NO: 68307 - DNA, 1065 bp, Homo sapiens
acccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttt

SEQ ID NO: 68308 - DNA, 1079 bp, Homo sapiens
atgaccccaataaaggttcctggcagctctagcctgcggagtttatgacattcccagcaagctgctctctattctacagaaacctggtgattaactggcctatttggaggattctttctgtatcataaataggatcccagcactttgggaggccgaggcaggagaatcacttgagcctaggtgtttgagaccagcttgagcaacatagtgagaccctatcttcacaaaaagtaaaatattagccaggcgtggtggcgcttgcctgtagtcccagctactcaggaggctgaggtgggaggatcacttgagcctgggacgggaggtcaaggctgcagtgagctgtggtcattccactaggctccagccagggcgacagagcaaaaccccatctaagaaaaggaagaaaaagaaaaagatttccctgagtgcaaccacattatattctaacatgttgatttctttctgtttctagctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtca

SEQ ID NO: 68309 - DNA, 1634 bp, Homo sapiens
gggaggaggctgggaagcagacctctggctggcctgggaggaggagagggaggggtggatttcttcagcagacacgctgtgtctgtggacccgccacgaaacccaggggagtcggcaggggcgggagtaggaggccaaggcccatcgggaccactgaaatccagaccaccaggacctaccacacagaccactggacccagtgcagggatccggggcggtggcctgcccgaggctgacacctcccctcctctctctcccgcagtgtgaagcctttctctcagcaaacctatgctgtccagcctccgctgcctctgccaggtgggtgggcgctgcgtggccccctttctatcgcagccatgtggctcctgcctctgggtccaggcccccggcagccgaacgcctgcgtgtccctgttagatgctgccccgtcatgcacactgaccacacgtcctagtccctggccacaccccattcctttcccccagcatgcacacctcagccgtgtgccaagccccttcatgcccctcgggttgccttgctcctgtcccctcaaagctgtgctcagggcttgtggggcacgtgcagttccaagggcagtgcccgtgccctggcggctgccccacttggccggccttgttactgcagtgtgcctcacacacctggtcctgggagggccgaggggtgtctagctcaccagcctggagcccctcccgagaagagggacccttgtgggagaagacctggtggaggcagccagcggtgctgacaggagcccccaccccgccctctcactgacaggctctgctctgtcctcgtctctttctcaggaggggccctcaccacctcccactctgtaggacaagaccagctcctcactcttaaactgccctttctggtgtggagtctgcctgcccggccccttggctttccctgccaccaagagcagccctgctgccttctgtcccccaggtcctgaaggctgctttctctcgttcacacatcaaaacaaagtcacagcgtcaggtcccgtccaccctctgtctcatgccagtcttctgtccacactgaccatgtcttcactccaggcctgctggcttttgcctgcgttcctgcagcagcctctccaccggctcgctgtcccgtctcacctcctctcgtcaccctgtcactcaccagagcttcagtctcacggtgttgcttccaggtttatggtgccttcctggccccctggtgccttcaggacacgatctaaactacagtaggactggagtaggttcatctgttagcaacgctggattgaggggctcttctgggccaggccctgttctgggagcgggggagacacatgtgatgcaaacaggaaacgtccccgtctctccgggatgatgccatattgtaatagtggattcatctggttatttccccgactggaacagaagttgcttgagggcaggaacttaacagtgcctgttctggaagcctctcggtcctgcagggccccagctgccctccagaatccagtcttgctcggcggttccatgcagagtgctgagtggcccgagttgtaccaggcgagcccctccccaccagggcagctccaggatgccctggcccaagcctggcactccctccac

SEQ ID NO: 68310 - DNA, 2722 bp, Homo sapiens
ggagtctgtgtgtgggtagcagccatggcatgccccttctggggccttattaacccttgtctttttctctcccacaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcagaggacctggtctggctgtgtgagcctcgggagggactgggggagcaagggggccgtctgggaggcaggccggaagcagtgctcagagacgtaccccgggcagttctgaagccagcgtcccaatggactcagccaggaacatcgccggaccctggaactgaagatgtgacagtccctgtgctacctctcaagcccctgcactgtggtgctggccacgccgtgaggcccgatgaatgcatgggccacgcacccacagccacgtgcgcccctgctgcactcccaggacggttcacacagagaggccccatcccctggggggtgggttttaggtgtggcggtgacagttgttggacggggacactgtcagaactctctggatagtttccgtccatctcaatggatgtggattccatgaccatcttccgtgaccacgttgggggcactggtttcaaatcaaaggaccctgaagcggggagggcaggaggcggcagggctgaggccggcctgaggagtctcggcgggaggttgggtgcaccagtgtcctcttggctgtggccaggaggttgatgagaggtctctggtgctccgctggtccccgagagccattggtgcttgtgaggcttgttcaaactctgtcccagccagggtgcctgttaggtggaggcctcctcagagccagcctgcaccatctaacttcttccctgaggggtagtttctgtgctccccgggggtggaggaggggagtggaccccaccctgagcctagacttagatatgcagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaacctaggggtgtttatgtttaccgtgtgtctggcactcgtggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccggcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtttgtgtaaggctctcctgcccccacccccaggcaccagcacagcctttgccttcactctctcccctcccctgtccctgggggattgaataagggaagctggggttggccgtccttctagcttgattggcagcaccagcgctgtgacggaaggatgtgttgtgccagcagcctcttggccgcaggacaaatgcacatttaaagagataacctttttgtgtcctggctgggaaagaggtcagtgcagatgtttttgggtccaggtgttggctgtgagttttcctttcctctatgaactgacctcagcagcctagtggacagtcacctccttacaggtgtaaaatccaagccagtcaaccatagcaggtggcagacttagctgccttccctgtggtgtggtgcagaccatgacccttgaggcaaatgggtgagctggccccacctcgcctgcagcctcctctga

SEQ ID NO: 68311 - DNA, 1100 bp, Homo sapiens
tgcgggcgcggtgagtgcggcccgggcggcgggcggcgaggcgggtctcgagagcgtgcggagtcgcgcggccttgagccggcgccgggcgggctgggcacccccaggccgagacccgagaagggggagcggccgggggcgcccacgggaggcagtgtgggcagggcggcggtgggacgagaggacgaggaacagagtaggcgccgtgcgggaagcgggccgggaaggggagggtgggtgcggggcccgggcaccgagcgaagtggggtcctccaggggatggctccgaggaagaccgtttcagaaagggagtaacccggggccggcaagggtttccgactgtgtgaccccgtgcaccgcttgggacagtccatacaaggaccccagagagggccagggggccttcgggcagggctgggatatggcctgcagccccccggcacccgcgaccgctccctgggccactgctggaagatcagcactccgagtgacaggactctggcacatcccgaagttggagatctagcccatctgtgcattcaagtttgggacttcaaaaaactttcttgtggtttttaaaaaaagatccaaacaagaaaccggcttgttgttgtaagagcaatatttgtacttgtacatcttggaactggagtcttggatctcctccctctttgaaaaatatacgagtcactgcttcatcttcccccaaatgcctgttttgtctggggaagcttgggctagtatgggatcccctgagctacctttttctcgcatcaccaaaacggggggtaagaaggcaggggcttacctgccttacctggtaactcttagttcagagacccagtctctcattatgtgcgcgtgcccttctgacctgcagctgtccttttccctggggtgactcaggtatttcctcctccaggaagctttcctggactagtggagaaaactgaagactcatgcgaggatccctatatatacctgccagctcccttctctttactgaaaatagccacagagaatgttgaatatatgctttgctatagagatacgcagccagcttgccatcataagtaatggggaggggaggagagggatta

SEQ ID NO: 68312 - DNA, 1053 bp, Homo sapiens
gcctcccaaagtgctgggattacaggcatgaaccaccgtacttagccccttcttctattttttttttttttttttagagacagggtcttgctttgttgcctgggctggagcacagggacacaagcagctcactgcagcctccaactcctgggctcaagtgatcctcccaccttagcctcccgagtagctgggactataggtacaggccccatgctcagataattaaaaaaattttttttttttttttggtagagacagggttgtgctatgttgcccaggctggtctctggtcttgaactcctggcctcaagcaattctcctaccttggcctcccaaagtgttgggattacaggcgtgagccaccacgcccagcccctttcctctatgttgagccttgtcttcacctggcaccacctatttgtgcaaccttgggcaatttacctcctctttccaactctctgttttggtggtatattggattagaaatattctagagtctcttccagcatcagataattaacagtgtaagatattggcagccactcaatcaattaggaagtgtgctttatataaaaaattctaaaattgtggttaaaaaaacactgaatgtaaaatcttttttttgttgttgttgtttttgagatggagtctcactctgtcgcccaggctggagtgcagtggcataatcacagctcactgcaacctccgcctcccgggttcaagcaattctctgcctcagcctccccagtagctgggactacaggcgcccgccatcaccctcggctaaattttgtattttttttagtagagacggggtttcaccatgttggccaggctggtcttgaactcctgacctcatgatccaccctcctcggccccaaaaagtgctgggattacaagcatgagccaccgcgcctggcaaatgtaaaatcttaagtgtacattttaaccattcttaaatgtacagttcagtagcattaagtctatttacattgttgtgcgacagctccagaaattaccttgtaaaactgaagctttaatattcttgaaaca

SEQ ID NO: 68313 - DNA, 1320 bp, Homo sapiens
tcccagctactcaggaggctgaggcaggaggattgcttaagcccagaaagttgaggctgtagtgagccatgatcgtaccactgcactccgggctgggtgacagagtgagaccctgtctcaagaagaaaagggtccgggcatggtgactcacacctgtaatgccagcgctttggaaagccaaggcaggcaaatcatgaggtcgagagttcgagatcagcttggccaacatggtgaaaccccatctctactaaaaatacaaaaattagccgggcttggtggtgcgcacctgtaataccagatactcgggaggctgaggcaggagaattgcttgaatctgggaggcggaggttgcagtgagccaatattggccactgcactccagcctgggcaacagagccaagactccatcttggaaaaaaaaaaatgtcagtatatacctgtgatgtgagtgccttccccttagatggcagggtaaaacctggacacggtacctgggaaccctgctgacggcctctcccctggccacctgccagtgtggagactgaggcttaggggcccaaagctctccgacaagccctgagggtggcagtgccagggacagtaggagaagatcctgcctcagcaagtccccagccccgtctcagggccaggctctacaggagggctcagaggggcagggtgcccagctgagtttgaatgaactgtgtctttccgggtgtgtgaacatgcaggatgacatgttttgttttagagaaaatgaggtagaggtctgggcttgcaattttccacttgtcttaatcctgggagattctaaacagctttgtttaaaaactggacatgcagattgcaaagacctgagtgaggaagagccattgggtcccccaggaaaacaattaggtttgaagccagagtttggatttgttcgaccattttgagtgctgtctgcagcatgtgggacctggaggcgcttacagcatcacccatggtgtgagtcactccaaattagcagccatttcaaattggcttccactgacttgctgctggggatgggtggggctgggggggaagctccaggcctggctgtcacccatcatccaggctgtggccggcagagaggggagggggctggaacaacctgtcttggctcagcctgcccccactgttggccagagaagctggagctggtggtctgtgaaggtctcctggacggagcagttcgtgcccgcagtgcagggagaacactggagaccatgcaattcagggcagggttggtggaactttttcttggcatccatttgagaaactcagaggggatcaggc

SEQ ID NO: 68314 - DNA, 2842 bp, Homo sapiens
tctttctcccttccccagagtcaggcagagaagcccctttcactcagtgcacatgagggagacatgtgagcacctcctccgtggaagttcaggagctcagtgatgccggggtctgtctttgcccctgaggagctagtgtggacgtgtggagacacgcatgtgtagatgtgcaccgatgcaggacgtcggccagagtgcagagtgcagagtgcagccggatgtgacaggcagagcgggtcagtgggaagagctgcccagtaggagtcagggcccccagctggcctggggcaagtcatgtcatttcttggtgcctcagatttttccatctgtcaagtgaggggtttatgatgcctgaagtcctttctggcttaagagttacctgattccaggagttgcagggagaagagccttaaagatgggtagaatgttttcattgcctctgtctttgttccaaattgggtctacccttggacccatctcagctgggttgttcccatgaagagggggcaggctgagggctcaggtgttacactcggatcccagacctcgcttctgttctctggaccctcctgttaggaaaactgccaaatttgcctttaggttcagaaaatcagttgcacctgtctagaacaaggtggttcatccttggcctgcaagggagggctgagtgactgcctgagacccacagagcctgctggggactgacatctgctcccatccagcctcgttctttgcttagagtcactttgtccgtattgtttctgtaatgccaaattacttgtagctctttcttcctttcccagtcatgaggtttcatttttcattgttctcagtgtgatctaccttgcttgaaatgcttcccggatatggcattgtttttttttttctctctctctcttttttttttttgggatggagtctcactctgttgcccagcctggagtgcagtggagtgatcccgcctctctgcaaccgcagcctcctgggttcaagtgattcttgctcctcaacctcctgagtagccatgtgactatgggtgtgcatcaccacgcccggctaatttttgtgtttttagtaaagatggggtttcaccatgttggccaggctggtctcgaactcctgacctcaggtgatccacctgccttggctctccaaagtgctgggtttacaggtgtgagccatggtgcctggcctattttatctcttaactgcattgttttagcaaatttgaaaatttgctcagctgttgtttaagtatttttccatctccacttccctctcctttctttctggtaccccaattatatggatatttgactgtttgatattgtcctgtaggttgctgatgttattttttcagtattttttccttctgtgcttcattttgaatagtttctattgctatgtcttcaagcgcacggatcttctgcagtgggtaatctcatgttcaataattccctctggtgtatttttcatttctgacattgtatttcccatttctagacattccatttgagtgtttgttgtatctttgtctcatcatgttgatgttttcctctgcattcttgagctttggagcgtacttacaatacttgtttatttcatctttatctactagtttcatcatctctgttatttttgggtttgttctgttgactgatttttctgtttatgatttttctcctccatatttttctgcttctttgaatgtctactgatttttaattggatgccagatcctgtaaatttaatgttgatgggtattgggttttgttatatttccttgagtggtattgggctttattctggcattcatttaaattgcttgggctcagtttcatacatttgaggtttgctgttaagctttgttggggtagacccagaccagcctttagtctagggctcacttagcctcactgctaaggcaacacccttcagaggattctaccgaataccctgtgtttttgaggtctgtccactctttttttttttttttttttgggacggagtcttgctctgtcgcccaggctggagtgcagtggcacaatctcagctcactgcaagctctgcctcccgggttcatgccattctcctgcctcagcctcccgagttgctgggactacaggtgcctgccaccatgcctggctaattttttgtatttttagtagagacggggtttcaccatgttagccgggatggtctcgatctcctgacctcatggtgatccgcccgcctcggcctcccaaagtgctgggattacaggcttgagccaccgcgcccggccaaggtctgtccactcttgctggtgggaatgtgaactctgtctggccctgtgtgtgctccacagattgttgggcctgttgctttccagtggttcttttctcagtcttgtggatttcaccccactggtgtgcagatcagccagagagtctgggtactcttctcgaagtctcttcgcactctctgctctcctctcctctctggtattctgccctaagaatcttagctgcatgaactctaattcctgtctcctcaacttggtgagacctctggactccatttggattcctgttgtctgaactgctgcgtggaagctgcctccaggaagtaagctggacaatcagaggacttgcctgttttgttccattcgtctgtcagggattgcagtcctgtgttgcctgttgcccgatgtctgaagtagtttcgtgtgttctgtccaatttttcagttgttttaggtgggacggtaagtccagaccttgtggctttaccagggctgtccccgggagtcctgcattatttgaagactcaccccaggcatcacctcatttcctggtgtcatc

SEQ ID NO: 68315 - DNA, 1071 bp, Homo sapiens
attggaggggggcataataacagttttccaacatgtgtaggattgaggactgaacttaggactcttggtgaaggattctaggccattagatttgggtctaggtccaggaagaactttctgaaaattgaaccatccagcagagaaatgggtaccttgaagatagtgagctccctgttgctgctgggatttaagccaaacccacgtctgttgcttagggatgctgtgtttggagttgtaaagttaaccaagatgttgcatgagatatctcttagatgccactctacacaattttggatcttactcctcctctgagccccatgattcatcctctggcagcctcccatccccagcctacacacacatccagaaaacacacctggaatgtgctccttactactgttttatgaaacaagcaccccttgtttcctgcctaaagtggattcttctcgggcctcacggactggctgctaccacccctgggcggtgtctgtgctcatctccatccttctgacttcggcctgactggcaccccattgatctgggtcagccccttctgtcagcaccttgtcccattgtctcctgtgtctggagacacagtgcctttgagacagaggatggctctgattagcccgttgttttccctgctccctggtggctgggaggctcccagcgaagcctggcggccttgctgcagccattccactgctcaggaatatggctctgaatggatactgtcacccttgatctgttcatccgctcctttctctgggtctcatgtctcttcccctagggtctttcttttcctcggactggaagctcctgaggaggtgtcaccccactgggtcaaggatggtttgctgcacattgtagaggctcagttagtagtggtgctggcagaactcttgagagaatcttgcacgcacctgctctttccccctgcctttttttctttttctttttttttgagttgggacctcattctgttgctcaggctggactactgtagtgtgatcatgactcactgcaacttctgactcctgggttcaagcgatccttctgcctcaccctcct

SEQ ID NO: 68316 - DNA, 1210 bp, Homo sapiens
acagcagtgagaaaaacgaagttaccgccctcataagcttacattctaatgtaagagcccatcaagggaatacatgtctgttgggtagcgggaagtgtggtggagaaagggatggggtaaaggcctaggggctgtaaaagagggcatgtgtggtggggagggagagcatctccagtcagtcacatctgatggaccctgcaaaggatggagagagcatcctggtggatgcctggggaggctcattccaggcactgggaacacaagtgcaattatgtttgagtagtgggacccggctctgatcaggtcctgaggccatgatgagaaattgggcttgtttcttcaacttgctctttcctgttgaagtcaaaagatggcttctttcttattttgtgtcctgtactatattgggtaaataaagtgatgtgtactttgttaagtgatcaatagatacttttttggttgatgaactcttccatcttctatcatcttaggctgcctggtgtggggttgtactaggtgtatccgatggttctcagtccccttcccacattctccagtgacacagacctggagctgtgaaccccgggagaccctcaggggtgtgccagttcgagagtgccagctgccatgcatgccctgcccttcactctgccctgcagcctcagtgtccttttactcttctattgggccttgcgccctccctctttgaggttttgcaaatgtggctccctccatgtccccaggtccagaggcaagtccttctgcagggacgctgtctttgacccttggcctgggcaggtccccttgttccacgtgctcactgggcagtaggttcttcccctcccagcagcatttccccccatttatcattgtgtactcacttgtgtgatcctcagaccctgactgtcatcctcagtgggccataaaccccacgaggacttaatcatcccttctcctctcctgcatctctgacatctagctctgtgatcagccagtttcatctgtcaaggacctgactgtaaacatgttaggctttgcagaccatatggtctctgctgcagcttctcaaccctgtccttgcagcatagaagtggctgcagacactacgtaaatgaatgcagctgtgttccaaaaaatgtatttacggacattgaaatttaaatttcatgtcatttccacaccatgaatattctgcttttgattttttttc

SEQ ID NO: 68317 - DNA, 1016 bp, Homo sapiens
agagtgagactctatctcaaaaaaaaaaaggagatagagtcttgctctgtcacccaggctggtgtgcagtagcacaatcatagctcactgcagcgttgatcggctgagtagctaggacttcaggcacacaccaccatgcttggcaaattaaaattttttttgtttgtatgttgtccaggctggtctcaaactggtctccttctgtcttggcctcctaaagtgctgggattacaggtgtgagataccacacctggccctgagttatttctaaatcctagcagggattttgaatcttttgtctgagcctaggagaccatagataaggaagttggcaagaacccctcttaacagagaggtttgagtccccgcatctgtctgaatgtgctcctgcagggaggtggcgtccacttttggatgttgctcatgttttagtccagagaaaaactgtcctcttgctacacagtatgtcctttctgaattaattaaatgtcattgttttttctctaccacttgttttcctacaccttggtttctatttactggcaggttgaaagcaggtgaccccgcctccttgcccctaggagggctgccaaaatgccaaacagagagcttgcgttttgccccaggcacttggaggcaggaaacagggatgtctgtttggacagtggatgcttcagggttggtcaggggtccctgggggagaggcaggcaggatgctaggcctcccaaacagggaggcggccccacagggagccctggtggagcttgaggcttcctgcatttagtgttggtctgtccagctgtttcctcctgatagagtggctggacaatgccacagtgactcaactccagccccgtcgacgaacaacaggagatttgtccagggttagctcgggagtggcgtctgcatccctcacctgcatccaagctgctagttgggaggaacctgttgctccttgaaccgcttccctgcttactcttggtgccctagagccctgtcccagttggattgattc

SEQ ID NO: 68318 - DNA, 1005 bp, Homo sapiens
gtctcaacccctgccccaacaaaagccccacgaaaggctgaattacccatagccccccaagaaataccttcctggctttatggtgagtcaggcacccctgcactctgcacgaggctgcctgggtaaccactctgttcctcactaaaaggaaagactaaacactttgagattcagcacctcatcacatcaccatcattatattttggaattttttattgtgaaatatacgcaacataaaattgaccatttcaaccatttttaactgacattaagtacatatacattattgtgcaatcatcacactatctcttttcacaactttttcatcatcccacactgacactgtgcacccattagatgataacttcccattctccccctacttccagcccctggttatcatcatccattttctggctatgaattggattattccaggtacctcatgtaagtggaatcatgcaatattgaacctttcgtgactggcttacttcacttagcattgtaccctcaaggttcatccatgctgtagcctgtgtcagatttcctccctttttatggctgagtaatattccattgtgtgtatatgccacatttttttgcccttttacccagtgatggacatttgggtgtttctaccttttggctattgtgcagcatcgtattttaaaatcgagtgcccactcttctcctctccagtcactccagtggctccccactgcctgcacacccacccacaggactttgcacaaccgaaatggatgcacgtgttagtaatgtgacatgtgttttccgaggtagtttttctatgcattggatccgtctatccatcccctttatgaagctgtaaatgctcaaaggttaggagctaagattaatagttccttctactacctcctgagagtctgtttcaggaagtggtaaaggatgttggttaggagtgtgggttgtgaggtcagaccacatgggtttgcatcctaattccaccacacacaagctcgtcat

SEQ ID NO: 68319 - DNA, 1005 bp, Homo sapiens
ttcagttcccgcattcctgttttctcctgacccggtttgagtctctcccactgttctgttcatgcttctcaacatgtggccccatttgtctagatcctgtttaaaacaccaggccccagggcaggcctccagctaggttgggcgaagcctggcgtggacgactcccacttccctggttccagatatttgactttttcctattcagtctcctctgaaaggcgccacccctccccagcccatgaagcttcccaggctcaggttctcccatccctagtggaccggtggctctcagcctcatcgtccccaccgcccgcctgtcaggtaggtcagggtgaggacaggcgccaccctgaggccgccacagagctcctccccgtcacctttggggccattaggaagcggtcaggtcctgcctcctccagattgtctcgagaggcgttgtaagagcctcactccccaacaccagcaagcttgctcccttggagtatgacttgaaggcaccattttatgtcttttgggtgggtttacggtttcaggcctatttctaactggaatcaaagactgtccctcggtgaaggaatttcaggcacgaatgagcagatgcgtgaggtattttgggggcagagagtttgtccctgtgctccagaaaccactccaccatctgcctccgtgcacaggccccacccatcccggaaaaagaggggtcctctcctcccacttcagggctctgtcccgggaggcctggtctgtctcaccaggcacttcctacaagtacacagtttggtcatctgccagcagtctgtctgtctaaagtgtttatttactttaaaataagactcaattattatataatttttttttgctgtaaaaaataaaataacataaaagtatcagtaaaatgtgaggccccattcctatgcccctctcccagccccagggaccctcccaggggaaatcacaggagagccttggtatgtattcagaatccttccaggcctttcattc

SEQ ID NO: 68320 - DNA, 1253 bp, Homo sapiens
ctggtggcatctccaccgacgcgacgggaagtggcctctccctccttcaggatcgcccccaccttccctgcccacttccagattcagtttgagccacctagggcctgttctgcccccgaagagagagaaccagccagcccagtgctgcaacgatggaagtgttctgttctgtaccgcccagtacagtagccaccggctacatgtggccgttgagcattgaaaatgggactgaaaatgccccaaggagctggattttaaattttattcagttttaacttaaaatggaaatgtaggtggccacatgttgctagtggctgccacgtcggacggtactgttctagaccagtagttttcacctgcagtgttggctcacactggtgggtgccctttggtgagaggtgcgttgtgagtgccttgttcttagtaagagattactaagctgtgtgagtggtgtacacatatgtggagtcgggtgggtcggggggcacagcttggcagataaaggatgggctcctgcaagtctaatctgggtacatttggagattgagtggagggtctggataggggagaaggaggagagaagtctcaagcacttcattcatcctggagacaaagcgcaaaactagggaaggaattttgagcagtgattcctttgaaagaaagggaggaagggcatacatcccagggccattggctaaagcactgtatggattctataggggctggaggagacctgaggcactagtgtgtagcctgctcattttacagataaggaaactgaggcccatcatacattggaccagaatctgagaactaccctgtaaagtaaattatctgcctcattttgcagcagataattgcagagaaactggaaatcaaagccattgggcattttagtggaaccaagttttggtcccaagtcagtccagagtcacaagctgaatttctcagactctcaggccaacacccacactgccagctcatggcatcctttccagcagctcgggctgggttcaggatgctggggttcctccttcagcacctgcggcctgtgaggtggccagcggtggggctgtggctggcagggtatggaacgtgggcagggagcgtggccgtggttgtgtggggctgtctgctccagggcctagagcgtgcacatgaccacactgccaagtggccctgctctttgtggaatccagagacgactgcctgaaagggaccaggagggacaagggagcaaggtcagagtggag

SEQ ID NO: 68321 - DNA, 1049 bp, Homo sapiens
caggggtcacaagctggtacccccagaccaaatccagcccacgcacaggttttatttggtccgcatcacgttttaatttttttttaattagctgccaatagttaaaaattaggagattttacccaaaaatcagaagttcaaattttccttgaaaaatggaagatctagggaaccaagagaaccatgtagaatgcttaactgttacagaccactgccctttgagaaattccagttgtctctgtcctagctagatcatgtctgtagggggctggagaagtcgctagaaaaggggctcactgtgatcacgttcaaccactggcaccctaatgccatgtagtgatgactgggcatgcaggcagtcatggaatcatggcaggtccatgtgagaggcagctcagctgctcaggcctggagtgcagatgctcacaggaccgaagtcaggctaagtatttacttaaaacaaaagaatcatgtctcccatttgtacttaagcactagctcctcttttgcacggctgaacatgtgcatcatgttctatgctggtcaacctgctgcaaaacaatgaaagcaggacgctgaggaaaagggagggaaggaagagagggaggaagggaggaacacgctgatgggcccacaaccctgggctgttatcgctcatctgagtttgcaggcttgcataaagttgattgaatataattgaatgggtgagcccacggtcatttcagactgcaagttccctaagggtgcgagcgagacctatttctcttgctttgaatggggtcagatggggagtgcacttaggaattattgaatgagtgaagcaacatacgcaaaatctatgtaccaggccagcgggcttcgaagctggagataggataaaaatgcagagtgaacagcctttaaagcaggacctctgctacctgactgccttcccaagggcagtgtgtgaaaacagacttgggccaagatctcagctaaaccctgtggctgctctcaggcacctgacttccggctggtatttaataacccagaatgagatacctcattgc

SEQ ID NO: 68322 - DNA, 1002 bp, Homo sapiens
ccacctcggcctcccaaagtgctaggattacaggcgtgagccactgcacccagcctgaatgtggtgtattttaagaatgtgggtttttgaagctagacacatgtgggttcaagcttagccctctgaccttgacgaacctcattagcctctgaatctcagtttctccatctgtaaaatggggagaccaatgcttgcctcactgggtattttgtaagggatgaaaacctaaaatagtctttggcatatagtagacattgaatagtgaatagcagctgctactgctgtcagtgtaaactaagaaacagacctacagaggtcatctgtcctgctggaggtcacaagggaaacagccaggactggaaccacggtcccagaccttgtaggccgtgttcttccattcccgggacacttctttccccttccctgatcaggtgggcgctgggcagacgctggcaggcaggcaccaccgctgtccaggacgcatttatgcctgaattgtaagttgtgggctgtgcctggcctcagacatgattatagggtgctgacaaaaacagcaccccctgattaagacgatgagcgaaaacgcacccgggcttttgttcactgagcaactccattgtgtctttctccccttttccacccctccctttatctactaaaaaaaaagaaatggaaaagatgaaggactgtcagcaccagatcacaacacgggctccaggagttggcggcttttcagtgcctgcggggtttcctcttcttgctttcctcgaccaagtctaattgagataaatctgagggctcccctcggagcacagggcttcctgcttccctgtgtcccggaggagcatcccctggggcttgctttgtcagcactctcccctgccccatggatgcctcctacaagatctgtggaagtggctgttcagtctgtctgctgcctgtggatggagctacctttccccagcaccccacaggtcatgtcacactcccttttcctatctc

SEQ ID NO: 68323 - DNA, 1043 bp, Homo sapiens
ttagatgagctttctctttcctaaggtgctttcgtatgagtttttgctttctattatcaaaacagtcctgggaggtggtttatctctgttttcagacatagggtctacaaagcagaaaagaaggtgatgcacagcagaaatgaaagaggagtttgctttacactctgtggtacgtagcattgatcagggagccaccatggctggcatgcagtgggcatttgatatgtgtttgtccaataaatgaatagcaggcactcaacaaatcatccttgatttgaaataaaagtttttctggattttgcttccagctcactctggtcttctttactctctggctgtttcttctcttccctgttgggttagctcctctccctggcccttgcacttgtcccaggcctgcgaggggagattgacacccagaggttgctggatcgtggtgatgcagaggcatcttgcggtgactcctgggagccagcagtgtcgtggtaggttggcaagtgccggctgcaaaaccctcctcctttgctgcaggtggatattgctacttgatcacagcactgttaactctgcaaccagactgagcctgctgagccttctcggtatagcactccaggttgctgccaccaatgggccacagtggcatttcggatggcaaggaggtcctgtcttgggtagagtaaagagcattagggtgagggtcagaggacctagctctgaatcctggcctctccatttctgctttgtgaccttgggataatccctggacatttcagagccttgaacgtgcgggcttctcaggtcccttcaagccctgaaattctaggattctgtggttcctttggttgggaggaaagaggctctcgtctggtggcctggccgtagaggggtaggattaacctctggggtcagcaagcttgcagagctcaggaaatgcctctctgtgatctgtatttggtccagagacaggtggtggagctagaggaggggaagttcactcacagccctaggctgggggaagggaggcctaactcagctgctgtttt

SEQ ID NO: 68324 - DNA, 1065 bp, Homo sapiens
ctaatttgctaattctggttactgatggagggtggggggcttcagggttttggaggtaggaaggctgttgctgcgcccacccgaggctgcctggggcccacagcctcctctgagctgatggccttgttcttggcctaaggtgagggagctcttttctctttctcttcctatgactttcttccctcttcctacctttttttttttcactagataccaccagaaaagttggccgggctgcagttcattcattcgtctgcccattcattcattcaacagtgctattgagcaactggcacacgactaggttgtgggagatgctaaaggtaactcagcaggaatacaactggcaccccattctcttgcagctgacaggtctgtccgcaaagagagacctgcccctcaggctgtcagccaggccatgtgattgagaggcagtgagggggagaaagtgggaggaagttgtgtgttgggaccaccaggcggggatctgtgactgggccatcagcctgagaagcctccatgccaagggaggggaggctaattggagcctagaattggggcaggcagagaggtgagccaggccacgcagccctccctgaggctgcaacagccagtcaggagctgagcacaacacagagtggcggagacagggtcagggccgcatggtcggagacagatgcccgaggcaggttgagagctgtctccgggactgaggctcggaatactggggatctgctctgtcggctttgctggggttagggcgtacctgaaagtgaacagtcaaaggcagagctagcgccattgctgatgacacatgcaagtaggagcacccgcggtggccaagtgctcagagaaggcttctggaggggtgggggccccagggtgccataaagaaaggccactctggagtgatttcatgctgcttcttcctttcctttctcttccactgcatccctctgtgctaggcacatctggaatatgggcttgggctgaacagagggatttaggcagatctgagatctgtcccctctcaaagtggggaggggagattttggccaggatttt

SEQ ID NO: 68325 - DNA, 1161 bp, Homo sapiens
gatggctgattcgagggtgtgagttgtgactattttcacctcaagtaccttgaaatgagaaaagatgcctccaggtttcagacgggctggatgcctttaggaggccccttcagtgggaggcaccttgaatgacagccccatagctatgggccagcctgatggggaggagggaagagagatggagtgagacgacagccagtgctcctgtcttactttacagagcagccgatggcagttcagaggccacaagtgacttaatgcactgcgggccttcgagccataagacagccattagggatgcccaagtctgtccctgccacccatccagacacctctcactctatcagcgagagtggaacatgcacaggctccctcccatgagggctgcagagcagtgtggaatctggggcgctggttcttctccatcttcttcactttacagcacccccaagtgctgctcacacactgccttcttccacattggctctagtaccagccccgtagagggagagtgggccgagggaggcagcaggcagcagctcctgaaatcagcagaagggtcccagctgcacagtcaggctggatgtgaggttgcagagcgccgtcccagctggcaagtcagcaccctctgtggagtggtttaggaatattggatttgctgggtcagtccatttccactggtgcatggtaataagtcgcaggcttcatcacacttccgtgtgcccggcggtctgccttatctcatcctccccgcagccacctgccttccttgataagtactaataacaaatgccttctttctcctgttttccaggagcagtgggctcagtgtgtgcatatgtgtatgggcaggtacatctgtctgtccagcacagtggctcttactccaggcccttttgaggatctgacagggatgctgattggccttaggatgaaagatgggctgctttggaactttcctgcaaaacagggcctgagagcccagagtgggtgactctttgtccaggcagactatcagccccgttcttctagggcccaatctctgctgccccctcttatctggtaaaccttctctaagaggagatgcctgtcctgcaggagtggccattctaactctttttgtaaagcttgccctgctccaagcaaaggctgatttttcta

SEQ ID NO: 68326 - DNA, 1079 bp, Homo sapiens
cacaggctcttttgggtggcagtcagcgctttgtgtctaacctgaaccctggctttgtgggaggctgccttgtttgaggcttaaaggcacagggtgcctcacaagctgtaccttgtgtcaaatgtgggaatattcagcatgggtcagaaaggggctgtgggctggcccattggttctgattgtgtgtgggtgagggagagaccaaagactgagccctgtctcatgctgccagcctgaggaattcacagagaggcagagagagcttggcatttactccaaagcccacatctccccagttgccaaccagcagagatgtggcatgttgatttcatttattcacttttcttcttcccctctgagaatgctgtagttacttcactttttttgttaaaaaaaaaataaaagaaaagtgaagtcaggctgccttgttcacatgctcagagagccccctgaagggcagcctgcacctgccagcttgcctgggtggcaagctgagaatgatcgggagctgccagagggatgatgtctcacagcaccatttctatctgattgttccatctgtacccccaatctaaggaactgaggcagccacagccactggtcttttcatctcttgcctctcctccaccccgatgccagtgccaggcccagcttcctagggcaccggttaatcatgggccccactgcttgggaccctgcaggatgcagcccaggcttttcatatgccatgcaaggcttcacagggtagctcactttgacctctaagcaccttctcttgcttcagtcaggcctgtcccctccctgcctcccgaaggtaccacactcacgcctttctagggtggccacccacttcagagagcccttctgcaagggacagctcggtgcccatcctgccacggtctgtgctctgtgcatcagtctgctttgggcttctctagctgcagtcgtgagtgggggtagaaggtgggtcgcttcagctagatctgagctccttgaggcccacgccttgtcttactcagctcagctttgtgtcttccgtgggtccttgttccgcgtcctcttatcttgaacaaaccagc

SEQ ID NO: 68327 - DNA, 1167 bp, Homo sapiens
taggaggctggcaaagtttggcaccacctccttcccctataagaaaacccaggctggaagtgcctccgactgggcagcctgcagtaatggctgtgggctcagaatttgtaacagctgtgagcctgagttggagataggcacaagtgaggatgtatttctgagtttcttcttgtattcctcctgaatgcacaagaatacaatctgcagcattttatgggagtgggttggaggggggcggggtgtagaggccacatgttcccactcctttcggtgaatcctaggaaaaagaggaggagcccctggctcaagccgatggacctgcttgctagtcctcagatatgctcccgagttggggcctgggtgggaaaggaggggtgtgggggcatgctgccatcgggtggctggctgctgcttttgagggattgcagtggaccgggcagggagctggctggccacgtgcttccaggttctgggagccccagtggccggaagggacaaagggagacaagcagggtgcccctgtccttggtgagaggcacttttgtagagaaggtatgaatgggtagggcagctgggaattgctctctgtcctctgtgtgactctggaggctgtgcgcacatatgtgcacgtgcataagaaatactggttaggaacatttgaaaacttcttaaattcatctcgaatcgttccttcatcccaattgccgtctctgcctttcttcacccaagccccgacgtagcacagatgtttggctcagtcccagagtctgtcctgccctctggaggctgtcagctgcccactgcccgtggtccaggaggagcactgggggcaggagaaagtcattcagagtgaagttgggaagaagcagttgtgccgaagaggcattcagcttttgtgtggagtgatccacattagccgaaacactttttagggtgggggtgtgtgtggaggggtgacttttcccatagaatgacaagcgcaggaagaagactgggctctagtcttggttctgcattagcttcttgtgtgaccttgggcaaatcacttggtccctgaaggactgggcttcctttccagtccaataggggctgtcgtgatggtctccctgcttgtcctcacgtcactagttacatgccatctggggtgggggcaggcatcctcatctt

SEQ ID NO: 68328 - DNA, 1504 bp, Homo sapiens
gcccccctccctgcctggggtgtgggctgcttttccaaggagactggtttgaagtgacttgagttggattcccctagttgtcaccatgggttgggccctccagccaccctagtaggaagttacctgtcatgtgcctagagttttatggaagctggggcagatagtctcattctttttctggtggcaagcaccactggaatgtctctggctgccttgtgggccagtgcctcctggtcctgtgacccatctgccagcatctgtcagccaagtactggtgtgtgcttccctggtgcctttggattcacacgaatgctgtccttttcattgttcacagcttccttctccattcttttttgtagtctcaacttacctttttgttttgtcccaccctgcctatattaagccttattaggaagacagaccctggggcttgtaaccccactcagctgcgctcactcctccccacccccaccctgccacctgctggccggagttggtataactgcctgcggtgcctttcttctccaggatgagcccaacgtggtttggtgacctcctcactggctagtacagtgatctgtaccctgcacgttgtaggccctcattatatgtttgtgaatgaatgcatggagggccagagctgtaaatccacaacatgttgtcatgtggtagtggttcctgagttccacttgatggggaagagaagttagatctcacacttgcctctgataaaggctctccgagcgccatagctatgggatgacaagcaattcttcccatcttcccttaaaaccttggcagaggttaatgagctagttggtggaatatattttcgttacggttgatagcgagagaacttgctgtcgcttcctaattagaaggtactgattacattctctttaccaggcaaggagttgttctctcctggattctgacttttctgattacttaatatttccagaattcccatgacatgctgtaagcagggaaaaattgaatctccaagacccacttcttgtatgctagtagcaaatgagatgattaaataagacatagaccttaggtaagatggggaatttagcagaagacaagttcatgcttgtgtgtaagagtgtttgccactgtgtttatcgggaggtggaggagcaggtgcaggagggtgttggccaggatgtgggggctgtgggtcactgtgctccactcaaatgaaggcttcctgcaggctggtgcttggcctgatactggggaaggagcagaggaaagagcagaatgggaagggaaaacatcaaaggcaggtggggtgttgatgagtcagggtccctgggaggcctctgttgctgtcttgtgcaggggggcagggggagcatgcaggctgggtcaagcccagccctctgggaccgggtgcaattgttaggaattttgtagccttaacttgttgtagtcttgtggctcagatccaaaaaggaggcttttctgaaggattagagttgaacctgagggctgc

SEQ ID NO: 68329 - DNA, 2085 bp, Homo sapiens
tgtcttttcctgaaaattcttccaataagcatttattgaacttttactatgctcaaggcacagggcttggtcctgctggcatgcagaagggggggacgtggccacagctgccctgggaagaggggggcatgtggaggggatccccatttcctatacacagggccctggctccgtcacagatgaggcctggttggtcttgggtccataacttgtactttcagagtcaggaagcagatgctggcaggcttggaaacctcgtccaggttggacggtggtggtagcagagggatgagcagcaagtgcttcctgggcatttatcagcacacgtctccaggcgtaagaccttctgtctgccaggctaatgggccacccctggcaccccatggcactgcatctggatggatttacaggggtcttggctctcagcctcatctctgttccttaaacccggctgcctctctggatgctgcccagaggtgacgctgatcagattgtgtggggaagcctgtgtgatggatggctcattttgtgtcctgggtctgcagcccacattcctgccaagagcatacctgatgcagggccctttctgcagtggtcctcaagaaatattaactggtaatgaggaccagagactgaggttcacccgtgctggcttcttcaggtccttgttctaccatgactaatagccctctccttaaaccaccccccaggtcccaccctgggatgaaagaccagctgaccctgatcctcacagcaggtttgtcctatggcggagatcccgagggggccctaagtcacagctttggccatccagacccggggagccatcactggaaagtgcctatcaggctaaggcagaggggtggggtgtgggcgggctgtgccagcccaccgggcaggtgagggacctgcaggagccgagtgcctgagctgtcctcccctgtctattaactccccattagcatgcatcagtgccgttgcctctatcagtttgatttatgccactgcggttttgcttacaaattagaagccgctattgtgctaggtcggctttaaaatcgatgcagagtaattgcagtacatgggtagttggatgacattaacatgagaaatgtgctgtagtcgtcatccttggaacaaacacgtccaattacagtgaaattctgtgccccttacccggctaatttgaacacagctcaccgccaaggcctcctccagcatggccagccctgggcagagatcgtcacgaatggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacagccccaagaccgtcctgcagtactgcacgtgtgcgtgtctgtgctttggtttgtctgtgtgtctaccttgttttagagtaaaaaagtgaatctgaggccagatcatcagtctgcacctgcctctccagcagtccctgcatttcctcacctataaaatgggaaggggaacactccttatggagctggttcaagtattgagcgagagaccgggactacaagtgttttctaacacaggggcatgaattcagccgtggcggcggcagcttgttaggagagcgatcagcctaggggctgatggggtggccaggcgtcgggatggcatccagtcttctctgtctgcatgctggagtcatgtgagagatttataacagaatagggatgctgggttccatctcctgaaattctgtgtcattggtctgaggagtgtcctgggcatctggacacgggaaagctccccagcagggtctcctgtgcagccaaggttgaagctgcttcctagtccatttcttgctcttcagatggatttgtgcttctttaggtaggactcatcctagtaaaaaaaaaaattttttttctgaattgataagcaggaagttcctccttccatcaagtcagaatccttaccgcctcagacatagcctactccttcttttgttagctgagacatgggtagg

SEQ ID NO: 68330 - DNA, 1034 bp, Homo sapiens
gacagcactccaggctggacctggccccagcccgaacagtcctgcatcagccccgcgtcactacggagagatgccgtcggcagagactgagagggagctagtcagatccagccatcccagcctgaccatcccatgccccatgccagcccaccctaaagaggtcaacctcaaggggcagaggactgagccagcaggggcggggtgggtggaaattcacatggaattggccagtccccatgccagggcaacagatgttcgctttggagcctggatggggttcgctccaggttgtgggcgggcggcgccttcagatgatctcccggctcgggttacttgttggctctgggcagggcctttcactttgggggctgtctggcctccaggattcctcccacctctgccttttcacccgctgtcgcgtgcatgcccagccagcagagctggccaccttgctcctgacgctctgagctccctgtgcctgggcctggctctcagtggggctgtctcaggccagggcagcgtctcccctctccctggaagtaccctgcttatcctgattgcagcagtacggttatttgtgcccttggagggattaagagtctgtagggccttcaccacgggcctcttccagaggtcccttctgtctggttaggaactgcagtcctggatttttctttttggtatgattcttatgggcctgaggatggcaaactttggaatttaagtgggcatagaattcccagctaccaaggtgcccttatgaccaagtacccgttcctcctatatggtaaatcctgagaaatgtgtatagttttctcttaaaaatatctcctctcttgatcgctggcttctgttatgttttttttttttcctacagtgagatatgtttatttttaagaatgcttccaataaccagaggatatgaaaccagtttaattttttaccccactaagagataaggaggagtcagagggagggatatggacacagcaagaaggatttgggtgggatcatcagggtaactgaggaccaaa

SEQ ID NO: 68331 - DNA, 1703 bp, Homo sapiens
gtccagtcttgtcacctctgtctacatactctctattccttctcaggcttttcaggtgcctttgctgatcacaggtgtggggaggaaagccacccaggaatggggacagagaacttgagactttgctggctaggtcaaaccgattttttccctccagggccacctgtcgtctcattcctttctgtctcttttggtagcttcagcttgaagctaccaaagcttgaattctcaagcttccaggattatgtaaattagtaaggttacaagcatgtaaaattattaagtggtatttgataaatacaaaagaatacatgtaagttacaaagttgtaagaaacactgtggaatccaccacctagctgaatgtggattgtcacaacacatcacctctagccctgctccgtccctgtcccatcccctggcggagggcacccttctcctgagggcatttttatcagccttttgcctttttatgtaatgttgcccctcagatgtttccctaaacgatgcattctatagttgcatgtgcttctgagctgtgtaaaatggtattgtgctacatgtagctttctgtagcttgcattgcttctactaaatattgtgtttctaagattcatccatgtaatgtttgtacttgtagttcattcattttccctgctttttaatatttcattgtgtgttcattgttaccagttttttgctgtcacgagcaaagctgctgtgagcatctttgactgtgtacatttctttcatgcacatgaataatagttcctctatggcatacactggtgaaatcctgcatcacggggcaaggagttttcctcttttgagaaatgcatcagatctcaaagaaaagagcagtcctgttggcaggggttgtgggctatagaggtgtgtctgtcctagcctgagtagcagccaggtctctgcagggaatatttcccaagctgagtagcaagagccaggttccttccagcactcccatctcggagcccccacaggctgcagagaatagcagagttactttacacagagcggggatgaatggagcttgtgtaaacgtgggtgtgtagggctgagacgtcctcgaagatctaatttactgccctgctttcccatcctggaacctctgccaagtgcctataaaaaagatgaaatatttagccaagatcagggaaggaagaatcaaggcagactttcacattggccatgctgttgagaaggtggtttgggcagttttcttctacaccatcccagatttaaatcctggccatcctttgattgtctagttgaaattccatggtctgaatgaaatctttttgtcctcacatgcaggcgtcttaccttcctctgaatttctcaggtgcacttaacagctatgttgtagttgagactatggccttgagggcagggcctttgtttcttactctttcatgaccccctccctctgctccggccaccctgcagcactgacatagtagtaggtactcattaaatgcaagcattgattgacctgcctgcaaactgggtgacaggctactttatcatctttcccgttccttacctccaaaagtaacatcccaagagctgtatttctgggaggctgagacacctgttttgaaaaaggctttcaggtgcactgtgcagtgaggggcacattctaggccaggcctgcagtcagagtggaagcgtggagtggtctgt

SEQ ID NO: 68332 - DNA, 1078 bp, Homo sapiens
cttccgcagggctaggggcaggctctgctgttgtttctgttcctttagcgtcctctgcaagcctgtggtgtttggagaagaacagtgcacctgaagtcagaaggccttggtttgaaccccctgctctgcctcctgagcagcagctctgtgactctgagccagttgcttaatgtctctgagcgtcatcttcctcactggtggagagaagacaataatctctaccttgagggaatggtgcaataatttaatgttaattaccatttatctagtactttctgggagtgacaaacacttggtaaacactttacaggcatgatttccacagcaaacctgagaggaaggtgttatgcccttttacagatgaggcagctggagctcagagaggttaggtaacttgccctgggctgtacagctggtaggttgcagagcctgttcacttcagctgcctgcctctgaggcccgtgcccttcgctgccaccaggatgcttcctccagtagataagatgatatgtaaagaacgcccggcatgctgttggccggatctgagtctcacccagcccgtggaatttgctgagagactgcggctttctggggactggaaaaaatggaggcgggggtagagaagagacgagtaagcctgggtctgtgcttcccagcctttgtaggggaatcatctgagagtccaggcggtggggtatttttggtagcaggctcatgactcttctccaggttcagcaggagggagagggtgggtagtgacgtacagggatatagctcattctgcaagttcatgaaaagctctgcaggctcagatcctgtcatcactgggcaccctctgggttcctagtactgtagggcacatttgagcaatgtcatacagatgtggccctgcccttagggagcacctggttgtcagatagaaacgagcacacatgtgaaatgactgcgagcagcagccaaggcagtgagcagtgcggtgtgaggatttgtgggaggggccattgctttgaatgactcatcagggagggcctcctggagtaggtggggcggcagctgaagcatgggtagaatgtgtcca

SEQ ID NO: 68333 - DNA, 1055 bp, Homo sapiens
tttcttccccgacattccgtgagtgcccttatcccagtcatggtcagcatggtgggtgtgggctctgagccgtgacaggcgctgaccttgggtggaggtcccggccttgccagtgtgcccagtggggctggggaggcggctgggcacagcgagcctgggctccggtgtgtgtcactgggctcagtatagaatggaatgctgctcactggggccgtgtcctggccgaagatcagtggagggcaaagtcctctcccctgccccctccccaccgtctctgccatgcagctgcttcggagttggggctccagcacacagggggccactcgccctagagaaagagaagtccactagttctcccaaagaccgagaattcttccttttcctctgagtggggtcagcgaatcgggggagagaacattcttgctccccgcccaccctgccacctctaatgttcctgaggccagcatcaggggtctcccggttagggcttccttggacccctgggggtgacattattcttaactttgttcccagcagggagaagcctgtgtgtgtagttggtccaagcatctagaagctgctctttcaaagtcatgagctgggttgggatggggttgagctgcttcagggcaaggaggcccttgccagcagcctgggagtggctctgccacccgccctgctctaggctggtgtgggtgtggcccaggccctggacatgccttctgcccgatgcctggagccctgggatgccacccagccagccccacctcccacctctagccaacagcaagcacagctcccattctgtagatgaagagcaatagcctggacatgtgacacggccagtccaagctcccacagtgagttctgaacagagcccagagtagaaactgggtcccctggtggccaggtgtttctttcccctttgcctgccagctccccgaggatggggactgtccctgctatcctctgcggagcccagctgacagctcagggctgcgtgtggaggatgtaatggacaagcaaggggctccagcggtcaccgggcgtgactc

SEQ ID NO: 68334 - DNA, 1005 bp, Homo sapiens
gcataaattaaagtcattcacaatgccatcatctagagataaccaccgttctgcttctggtgaatttctagggctgtatgtgtgggaagaggttcttttgttgcaaaggacatctttagttttaagggacagagggacacacaggacggtgggttccagcacctctggctgcctgggcctccttcctctgactgttggcaccagctgtcagcccctggaggaatgggcagcctgtcggcaccggcttgagctcagagctgggataggagtgttatgctggaaaggggacccggctcccagggagcccctagtgtagtggagaaatacggagccagaaggggctgggaccaacagctcacatgacagcccctgcctgaagcagagtcctggcagggggccactgggcttccacccagacttctcatggtggggacctcatggttaagccaccacatcggccagctctgggtccctgcgtgagtgagggtgaggggtcgttttttactttgtagcttctagcacctggtccctgttctgccccactagagtctcatggggcagaccccatgaaccatggagcgccccccgcacttaaaactctgcatacctccatgttcagagttgccgtgtccctcaagttctctaagaccagacgcctctagttcctacccagttcctgtggggaatatgatttccacactccctggtgctggtgtggccagggagaggtgtagcctctggccaggcttcgtggagcaggtgagactggaatggcgtttagagggtatggtgatggcagcgagatggggaagcccattccaggccagggaatggcacgcaggaatgttcatccgtggcaggtgtgtgcacaggcctgtgtgagcgggtgctctctccggggccagggagaaatcccagcccctgggctccccccagccccatgcccttatatagccgtccctgcactcccagagctccgggggtggggacggagccccctcctac

SEQ ID NO: 68335 - DNA, 1042 bp, Homo sapiens
aataagcaaaagcaagagcaaatgtattcctcggatctcatatgaaaatgtgtagtaatcgtttctttttgctattttcaatatatttctgttctgttcattgaactttgttctcggtgcctcttgccagctcactatttatcacataggtcatccctccaccctgccgtttgccctttatgaaatggcatctttccccctccaggtcttggtggtgggaatgcttatccttaccgtgtaggggtgggaggagcggagggagggcctgctgggatctgacttaagagcctcccccagcctgtaattggtcagaggccgcgcacagctccgctcgttccaggtgagtaaagcgcctggactcagacgtaattgattctgactgatatccaggttggggtgtaattagcagtcttgatttaatggcattgtggcctgagactgccatctcctcccttgtatttaaatggccatttccctcggcaggcaggaaattggcatcagacctcgatggtgggaccctgagtaagtcgcatctccgagcctcggtttccttaaccagggcctttgaccatgatgtcgtctcacaagggggcgagcagtaaatggcagcacgtctcaggcccagctcacgtgacacttggacatcacttcctgccactcttagggaggcagatgtgctgggttccagcctcctggctctgtgggcaagtcacttagcctcggaggcctctgcctgctcacctgtgaaatggactcatagcagttgccttacctgtctcatacagccagggagaggactaagcagaagcacagtcataggttcttagggctggagagggctttggatattattagtttcaaccttttgttttataggtgggaaaaccaaggctcagaggagtgagtgacacccaggatgacctggcccgttggcagcacatagtcagtgagccgtgttgtttgggcttcatgacatcgcttcgtctaaaggcttacctgtctgtcagctcataagcatatgcggagaggcgcacctctccac

SEQ ID NO: 68336 - DNA, 1050 bp, Homo sapiens
gtagatgctgctgttcaacatcgggtagaacagcggtgagggaggtgaaggtcacatgacctgtcttcctccctctagttcccagggtgtgttttgagaggggcagtctgtggggaagctgtgtagtggggggcgggggtggcagagtggcctgtgtgtgtggctggtcctgggatgggggagtggaggcacgtggtgtgtttttttgcctctgggtgttacagccctggccctgagtttagctctgccgggaggcggtgggtgcaccagggcctgctgtattctgaaactgggagtgtgtgcctaaccccgcacctctgttgggccagcagaggcccccaccccagtgggcagggccttccagaccagctgccttccctgccttcctcactcctcatctgtcacccaccatcctgggtgacctgaggtgggctggagagacgagctgcgtcctggttccaaccgtctcactgtgtccctccgcctggcaggtgaacgagaacgccaagaaggacctgaaggaaggcctgctgctgtaccacaccgagaacaacgtggggctgaagaacgcctggaacatcatccaggctgaggtgcgggctgggccgccctggtggggccaggcagggaggaggggtggcggccggtacttctagctgccttccccggtgacctggccgggcacctgtgctttctggattttagccgggagtggagtggtacccacgggggcatttgcctgaactgctgagtcagatgtgatacagcaaggtacagccagggagggatgaggatacaggaggggcaggcctgagagagctgtggctgagctttgggatgaatgactgaatttattttagcaacagatttgcctccatgatggggcttggcttaggtgaggaggccctggctctaggaggagaacaagtccatagtcccagatgctcccattttaagccctggggaggggccggcagggggttgggtggcagtcagcttgggacggtttacagaaagagcagaggtgctggtgggcaagcacagggctga

SEQ ID NO: 68337 - DNA, 1050 bp, Homo sapiens
ccgctgctgcatggagaactcccagggctgcgggcgcaacgccaccacgcctttgtggagaacggtgaggctggggatggaccgcttgggtccaagagcccgtgtgtggatgccccggcacggggagccctataggggaggctgggcccgggacactaagaggttggctgaatgtggcggtggggggctcacaaaaataaagccaaaagacaggtggaaaatggggggtggggctggacccacagttgggagagtcagagggcgaggggttgaatggggtctgaggctctgcagctggccttgcgggtggggcggaggctgcgccaagggatggggacagggctgaggccagggagggctgggaggtaagagcgaggacgaggtggaaggagagagtgagctgggggctgggctgcagggagcgcatgcttgggctgggaccctaacctcgtgggcctcgctccccagggctgctatgaaaaggtgaagatgtggttcgatgacaataagcacgtgctgggcacggtggggatgtgcatcctcatcatgcaggtaagaggggcgtccccagcagcctcacccaccctgctggcctcagcctcagagggaaggaagcacagagaagtgaaagcagtgttggtacacggcggagggtctggaattcatcacagctattcaagcttagcagctgtgcctgccaccgtttccgcagagctctgatatgagagcacgtgtctactcagcactgagagtggtgctcagggctgcctgtggccaggcccaggctgggatattgaagctggagtcaacccccgtgggttcccccagttctgcccaaaccttgagctcagagagccatgcaagacacacacggtgtcccccggtcaccatctttacagcctgtgcacatggcacactctctgtggtgaccgtgagaccacaccgggcttccttctgcctcctgcactcctctgggtccccggctcctttgaggattcaggagggaaggggcacaaacgagtagtgacgtggtcctgagcacacatcact

SEQ ID NO: 68338 - DNA, 1051 bp, Homo sapiens
gagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaata

SEQ ID NO: 68339 - DNA, 1055 bp, Homo sapiens
ttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcaga

SEQ ID NO: 68340 - DNA, 1102 bp, Homo sapiens
gaccagctgggatgataggcaggcaccaccacacctggctaattttttaaactttttgtagagatggggtctccctatgttgcccaggctggcctcaaattcctgggctcaagccatcctcccaccctggcctcctatagtactggggttacagatgtgagccacttcgcccagctgaggcatgcctggtttcaaaactatcttcagctcttaatgttggtgggtgtaaaactcatcccagcgtggactaaatcacaggccctgcagagttggagggctgagaaggggcagctctgaatacaggggatctgcccgaacctcacttttcctggggcccctctccccaaccctggggccaccaccgtgttgcttccagagggtctcgctctccttccctttttccgcccgtcccaggctggatagagtcccttcctttggtcctgtcttgcatctgtcttgaattaggcagggagttttcaggaagaactttcccaaatactaagggagaacagagaggaaatcctatgaaatacagagtattcatgctggcagtctcatgaagggtaggtatcaacttttgcgacaaccataggtacccccctaaatggctattacaagtgggcaccttgagcataacacgggaaccccacgcctggcctccatacctcccaggtcctgcacttctccccagaggtgggccctcttccccctaaagcacagcgccttgtgatgcgaaggccgaggctgggagaggtcacacctggtctctccacatgttccagctcccagcctgctgagcacagcccttgctgacctgggctggccctgaggaggggtgtgcttgctcccgtacacaggagtgacctgaaggcccctcactgtggtcacaaacacagccctaaactgtccagaaactgtatcctcagagcgggaagtgcccacgtggacagagagaaagccagcctctcggggcagattgccgcctctactgtgaggattctccaggggctaccgagaggctgggctggtttatctcctctgcctagaaaggcctggggtggccaatgtgaactcattaaaaggaaaaccagctttcccagaa

SEQ ID NO: 68341 - DNA, 1080 bp, Homo sapiens
cctgtctctcacttttcctattgcaagataattggctttttgtgtgtctatttatatgtctattagataatgcacttttttttgaatttgtgggcctgacacacaataagtaataaatgttaataaatgttgactgaattgatgtatgtgattgtgaacaaactcttgagcctaatgggctttagtcactcatggcttcctggaaattgggattcctatctcccaccccacctgtctgctgtacttagttgctgtgaacctttgaaactcaaaatgggtaaatattctgggaatcaaggtgctgaagccagtcaaatcatgggtacattttggttattcatgtacttattcaatattcagtaattatcgactcttactatggagtgctcatctgaatagcagataaatggattaatcacaatgcccaattatgaaccatgggggataatggaccctcctgagctactgcttgctttactgatacttggtgaaagtctgatgcatgatgcattatttatggcgatgactccctgattagggttttatcacctcaaaggagagcccccaggagttgggaaacagttttagcaaagagtcactttggaaactgatatatatatatatattttttttttttttttttttttttttgaatgttctgttgacttgctggcccagggagagggaataattacaggttggaaaaaatcctacaatgtgacaatgagattaggggttgcagtgagttatggggataactgagctgacttcttgcatggtgtatcttggtggttttggctaatagatctttctcctcaggaagttactttcagctgaagaatgtggtcccattattacaggggttagggaattgaggaagaggaggaaccaggcatagttctctgaggatggtcttcatctatgtctgtttctgcagagtgtgtacactaactagtaggctatggagacagacttcctggttttcaatccagttctggacctagtagatgtgttgctacattgagcaagttgcttaatgtctctgggccttttaagattgttgtgaagatgaaaagggtt

SEQ ID NO: 68342 - DNA, 1063 bp, Homo sapiens
tctatgggctgaatcagtcagtcagcgtctctgaaccatggcatcattacctgcagagagggcttgtactacacgggtgcaaagagatggttggaaaatgtctaacaaatacacttagatctgtatttgaagccacttgtagtgtgtggaattatggatgcttaataaatgcattctatgtttgcaagatatgttcttctcctagaaatctccttatctcccaggagataagacacttcttggtaaagacattttgagtaccactgaaccctccaaagagtattgagtattattgagattctgatgattattattcccaattttgcttttcttctgccacctctctgccctctcaagggaagtgaatgctctctgatcacatggtgggaaagggcctccttcactcgactataataataaatttatgaagggcaacattcacccagttgaagtgtaagtgtaccattatcacatctttcttatctagctttatactaagtattaagagggaaacacagacatataaaatctggttactagtctgaaagaatttacttcttgttgtagaagtaacacctacaattgtgagataatcttcaggagacaatttgccagcaaaataaataggaacatagcccatagtttcagataagcagatgccataggaggtcaaaataggagcaggagagacccaagcatcagcggctggagaaaatgactgattttcaatgatggctaccttcctaaagatatcaatcccataatgcccagaaagctcagaggacgaagggcagaaccaaaggcttgagagtgcacaatgtgtaagggaggggccagggccaagcagccagcagaacagggctctacgggcagccaaagccactgtgtcctgtgccacgaaaggcccagagagcatctaaagatagcaccctggcacagagtcatacggcgagagcgggaagcctggtactcctgtaccacacgctcgaatttcctctgaatatttacacgctcagcgtcttccagtcatcaccatagccccacaaaagaggcgggacagaaa

SEQ ID NO: 68343 - DNA, 1123 bp, Homo sapiens
attttaaagcttgggctggtgccagcaggagccatttatagcccaaagggcttaggttcactttggctgcctggtgcagagagtgctggcttccctctcccctctgcaggctgccttcccccttcagatgtccagcaccttcactctccttccttaaagcttctttttcctctcctctaccacctctttcctattctcttggaggttccagttccagatccacctccggacctagattcccctaggtgagcctaaacaaattcctttccttctgtgggcctcagtctctccatctgcaccctgacacctattgtctgctctctttaaactctgtcaccttggagaggtgcctgcctgtgcctacctccactgaagcgctctcctctgtctagttattgcctgttgactctctttctgccctcaacactgggcttcctgcctgggccagctgtgttacccttttctgagcacagggcctggctcctggcagtagctcagttaagcttggttgggccgaactgagctaaccatggcatcagtttcaagagcacaggttttggcataaaacagatactggttgacatcttggctgtgctgcttgctatctctgggccctggcaaatgactggactttgtgagctttagtttcctcatctgtaaatgtcagttactatgaggatttcacgagatggtgtctatctataaagtgcttggcgcagcgcctggggcgcagtgggcccttagtcaatgttaggtctcatcaccatcatcatcctctgccatctacctgcattttcaagggatgtgggttaggtcaaacatgctcccccaaatccccacccctgcttgtggaaatccgacccacccttcaaggacgagctcacaagctcacatgccccttcttcaggaagccagcttcctcctgtctccagctctgctgcgtccataacctttcatctctgcatttagtgggcccgaggcctgttcaccccagtagagtgggtagactaagacaatcgcactttatttattagggagaaaaactgtgctgaagctgccctgggtaaggccagtctgggggcggaacactgtgttgggggagtcctgatcagccgctggcgtg

SEQ ID NO: 68344 - DNA, 1031 bp, Homo sapiens
cagatcagacattggaaaggactttgggcaagtttactttctgcgccttgggctcaggcagctcctttctgccattgacatcctgtgacattgagtcattttcccacattaaagaagcttcttggtgcatagtcctcaattctccaaaaggcctatgaattctctagagaatataattccaaacttacagctagaaaaattatatcccagaaaggacgaccagccacttagccattggtcagtgagatgggaagcaggattccattccctttccaaaagcaccaggaaaactctggtgagaggccagtccctgccatttgtaccctcagctccctgtgttcccaagccccatccttggtcatagtgcccaccctacttctcactatttgcctgaatgtcttctcactgaggctgtatgatcgggggaggaggggacaaagtggtgttcatcccgtttgctgttccccaattctacagccatacccggcctgtggcaggcatcctaagtggaagtctgtggaatggtgaatgaatgcactgcactaggaatgctgcaggcagtactggtcatgctcacttcaaaatgtagaagaaaagctgcctaaagcctagaatcagagagactgtgatggggaagggaactgtgggagggagaaaaggggtatgtggggccagaatgctaagagcagggaggcatcttcagaatggggaaggctgaaagccagttgtacaatctggatggtcatagatggggttggggcaggggaagggaaagctttcctccctgacaaggagaactctagatgttgtccacaaccctttcctgagcgcccacccttgtgcacggtgacattctggatgttttccaagacattctccaccagtagagagaggcggcatatctttgcagaccagagccatagttgatggactaataaaatcatataccactctaatgaccaaagacttgcctgatgcaatggcttagtaagtccctaacatgggcctaatatgttttaggtagggtggcc

SEQ ID NO: 68345 - DNA, 1003 bp, Homo sapiens
ttggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaactggtgggatggctggttcctggtgctgtgaagtgggagggctggggggaagccagaggccatgatggagtggagactcaagggcagcagcacctacgtgggttcacgtttgctccccagcagggaggtcagggctggtctaagagcatctcccccatggactctgaggggtcctaccttagagggtaaggaggtcatggagctggggtgggggacaggagctaaccaagagtgtgccagaatggcaggccatgcatagcctggagactgcttaggataatgtccagccttggtccgggcgtggtaacagcggaatctgtgaaggatggaaatgcaatgt

SEQ ID NO: 68346 - DNA, 1016 bp, Homo sapiens
aactagaaaccaatagtttgtaccttttaataaactgtcttttaaataactctcagatgcattaaattataaaaaccaacattatagattatttagcctacatcctgattgaagatttaaaatgtcaatgaaacttggaaggtcattgaaacactgcatgaccaactgaaacctattagcatagtgacaggctggaaagatggactagaaatagcaaacacaaaatctaacagcattacatttgagatgttgctgtgtgttcaaaacgccaatggcagaagcacaaagtggaggagatatgattcagtagtactatctttaaaacaaaaatgatcacacagacataaaatttagagattttagttgacgaatgggttccacatacgtcaactgtaatgtggctgccaagaaaagttaatgaggttttaggctgtatgaatagatatgcagcatctagaacaagagaggtaatagtcagctctaatctgcacaagtccaactcatacactgggcattcagtttggcactgccgtggcttgagaaagatcattacggcccatctgaagaagcatgaagggaattgtaaagggatttgtaaaaaatccatgtgagacacagttggaggaagtggagaggcttgaccggaacccaaggcaactccttgaagtcttgatgccattctgaaatacatgaaaggcttttatgcagaagaagagtaaggtcatggaaagacagatttctgtgagccagaatatcccaaagatgaaataactgcttagagaaacagcaagttctctgtcactgggggtattctaacctagtctgggtaagtccttgacgtggtattgtcgcaagaattttaacactggaaaaacaggtagttagatcagacaaaccttccaaatctgaagttctttaactcccatggtatctagtattccctcgaaatggtccatgagcttctgagttcggtacccaaaattgtaaattgagtttttacaggtttttggcattaa

SEQ ID NO: 68347 - DNA, 1017 bp, Homo sapiens
agttgtctcttcactggagatccttaaaccattttcaatatgctggcttagttgtgattctccctgtgtgttgggaactagaacaggtgattagtaagtttccctcgcccctccattccctgtctctatgaccacagtaccacctctgtggccaagtcattaatgtgaacagctggtaaatgaaactttctggtttgtcttaaagccggataccaacagtcagtgttcagttagcagtgaagatatcgaaaaaagcttcaaaacaaacccttgtggctccatttcttttactacttccaaattcagctacaagatagactttgcaggtatgtttttttccctaatagttgtgtgtttttagtatattgatatgataaaatctacagctctgaaggtcaggattagttgatatatttgcaaacagtgaagtatatcttttttgttatatacaaaaatacctctataaaaattcaagttttaaaatcttgagcaacattgccttttataaaaggtgtgtttatatgtttgtatatattaatgtatgtgaagattgtcttatatattaagtgcatttaatacttgtcttctaaggaacacaaaacaccgtatcagttgttttattcatcccatcagtcttttgaaatagataagaacatttaagaacatttttactttttttttttttttttttgagacgtctcactgtgttgcccaggctggtgtgcagtggcatgatctcggctcactgcagcctccgcctcccgggttcaagcaattctctgcctcagcctcccgagtagctgggattacaggcacccgcccccacacccggctaatttttttgtatttttagtagagacagcgtttcatcatgttgacaaggctggtcttgaactcctgacctcctgatccacccgcctccacctcccaaagtgctgggattacaggcgtgagccaccttgcctggccagaacttttttactttaaggatcaaacagatgttaagtgagaaagtca

SEQ ID NO: 68348 - DNA, 1045 bp, Homo sapiens
ccaaatttaaaacatgaagaaaaaaatgggaaataatcataaagcattgcttgagtttccaaacatatataaaaaataacaaacccccttcattgaggtcaggcactgttataaatgaacttgtctcgttcatttataacattgtctcattcatttataacaacatcccaatgaggaaggagtctatcatttttcattttgtgaagagccaactgtggcctagacaaggcaattgaaacttattccaggttgctacagcttctaaaaataggatggacattttaaatgatgaaattaaaaggcaaatattttctaaattacccagtagtacatattctttgttaaaaaaatcaatgatacaggaaatcaaatttttaacaaatcatcaataactctatatgtttttatgtgtgtataattatacacacacaaacagagtgagagagagagagagatctgaaagatatgcagtgaaattatagcattggctaaccctggagaagaaaagtgagaaggtaccaggaatggaagtgatggttaaaaaagtctttagctttattttgaaagttctgattttttgcaagaagaatattttttatgtagtagttgtataaacttaataatttaaaaaccctcaaagaatgaggacaggaagccaaattccagattgagtttaattttctttgaccagcctctttgtctcctttctagagacttcttcattacaatacccaaccaagaatgtttaaaacttttcaaagataatgcatatgtgagttaattggtatagctaaaattatgaaatcattgataatgaagtataagacagtatatgacggcggctaagtgcgtagaccctgaagccaggatgttgggtttgaatcttgacttccttgttgtatgacctctctatgccttagtttcctcatttataaatttggggtactgatagtacctgtctctaggttgttgtgagacctaaatgaattttcatctgtgtagtccttagaacagtagctggcacgtagtaagtaatataaaggtt

SEQ ID NO: 68349 - DNA, 1115 bp, Homo sapiens
cgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgtt

SEQ ID NO: 68350 - DNA, 1009 bp, Homo sapiens
tgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattatctggccgtttttgacttatttataaaccagcagtcctcagaatggaatacacttgtctcatgtcagaactgtttcatgccgctgcaacatttggcagtggcataaaagacacattctaacctggaatggaatctacatgtgcctctgtgttatggcggtacaagtcattgttgacattgctaggggacgaggggtgcctatgcagccagcttataagctagaagcctcagtccaccttcagaaggtgggtacatcacagacactatgactggtcctcagaggatcgtccctgattgttgccagctactcattctgggctgtgaggaagcatctcctggcatgagaggtaccagaagcctgcggtgccatctccagagtctagggagtctctgggaaccctgcccctgcagctttcctggctc

SEQ ID NO: 68351 - DNA, 1043 bp, Homo sapiens
atttaaaaaataagtcttaataaatgattatttgccaggcactgttgtaattaaaatctgacagtttagtgagttaaggactgatatcctcatttttcacatgaggcagctgagacagagacgccttgtaacttgcttaaagtcacatggcaagttgaggaagtaggagtttaaccaaagcaactttaccactcaccgtcttttgtttcctacttaatttgttaaaacccggtatttgtagattacttgaacatcaccagccatttttgaggctactttttagtctcttaatataattgtgtggagttatgacaatagtttattttgttctgttttatgtgtaggaagatggagtgagagggctggttcaatgctttccggtctggatcctcctgcttcttgccttcagagttctcaaaaccaaaacctggtgattctttcaggaaaagaagtgatttttaaatttgactcattatcaccatagttaaatgtaatgactttttgaagagttagataattttattggacttacctcttcagataatgcaaaaaaatctttaaagcaatttaagttcaacagaacctgttaggaatcttgtgctgttcctgtatgtggtttatctttcttcatactttgaaatgaaagtaccagtgtgtatcatttctggaacagactgcccaagattccagaattcaagtctatcatcattgtcagactataacttctcatgagcttatggcacagcattgttgaaaactccaacacgtgtaggttggcattaccatcacctatccagcactactgaagggtctggttccttggaatgttgtaggtgtttgcagtgagtccccggcaaaaccatccatttaacttcctttttttttttttttttggaaatatgtgtgcctttattagctgagccactacttgagggggatgaagcgggaggagtgggtggccccgatgccgggccggcagtgcttcaccagcttataggtgatggagaactcgcccaggtagtgactgatcatctccggcttga

SEQ ID NO: 68352 - DNA, 1043 bp, Homo sapiens
ccattcacttctgtagcctcagtcatacctaatatggtatcaagagagatggacaaacatttttttccctactgtagctttataaagttttagttccatcaggaatttttagctattgttaaatcatcatcactaactagtctatctataaaagggtctttggggagtaacaaagtttatgatgaattcctaccacaagaaattcatccaaacattcctgcagctggactcctggttagccagtttataaaaatggttatatgtaggtgggaaacagcctcaaaaacagtgtttccaaaagtcactaagttcagattttcttccagacatctgatactactagcattccctctcccacaatgttacaaaagttacatgttttaaattgggaaggccagctgcagaacattaagtttgtttccaaagtgtccaatttaattcacaaaagtatattgagctatgattctcccatttgttgtatttaaacatccattcaggtcaagaagtttactctataaactcagacaacactacacaggatatagaggtaatattgttttagctttggtgcaagcatcccgaagcattttcaggtgtcattttcctcttctaacagaattgttagacactcagttaccatgttttagtgtgtgcaagaaaatgaagatgactgaaacagcccatgtcctatgtcagataaaagagctatagaaattaattgcagtttaaaaagaataaaggaaaaataacctatcagcaagaagaaagacgtatcagttttatctcaatagatctttgtgatctgaagatactgtcttattggagtcagtcttatggaatgaggagctgcaagccaagaatactgaattctcaacttccttttatttttgctgttaacttgttgaataatttggggcttaccaaattatttagttttgtaactgttggttactaatgaagattttgttgtttgtttttaacttctttattggagtataacacacgtatagaaaggtacacataggtacgcagctcaacttttc

SEQ ID NO: 68353 - DNA, 1070 bp, Homo sapiens
gacattccattatttttcttactatggttgttatattaacatcttcatatttctgtggtccatgataaaaagccaaaaatgtttatacacatttatatacatttaaaaaaaataaaactagccatcttcttactattactaaacaaggtattgccatgaaaacatggaaagggaaatggactatgaactgttctctctcgtttacttaacagagattctatttgttcatactccatgtgaacaagattagagtccttctttattgttccttataatctatgctacgattagacatctattcaaagcctatcaaatcacatggctctatattagaaacgataattcattaaatatggattctagcatcaaagccttctatctctctgactcttgatttataaaatatgtgcatttacaaagtacagtgttataaatcaatttatcaaagtcactggataaaaatattgttacttttattcagatctcttttaaaactataatattttgatatttgctgtttacttgtttgaaggtctgttttcatgtgattttctgatgctaaaggccattccaaaatagattccaaaatagtttttaattggaataaatatgcaatctcttaaagatagctactttgaaggctaatattcagtttgcatttgtgagttctgatggaattcttataaactttagatgtctcttttattaaaatatatatgtaaaataatttgcattcagtctttataatgtatattcaatcataatgtttattttatttattcttctaagaaatagcgtgccttcaaaaaagaagaaaaactgttaaatatctgaaaaaaaagctgtttcatttgaaacagtttcacctatctgttataattgtatatagcgtcaggtaagaaataaattttaggaatggggtgaatatacagtgattcctggtcccactagccatttatttgtagccctgaacaagttatatcaacaacagtgactcagattctaaaaataaagatggccacaccacaactatctaatgaagttattttatatgtggttaacttggtgcc

SEQ ID NO: 68354 - DNA, 1038 bp, Homo sapiens
aaatacacacctttttatgtcatatctttgactgtcttaagtagcatgaagtcagttaaatgaattatttttggttcttttaaaaaaaaatcactgtatccttgaatgactgctttttctatatttatccataacataacattctttctatttaggaaatttacaggaaaaaattttttaatttattgagatgtatttgataattaaagattgtatatatttgaggtatacaatttgacgattcaatgtacacagatattgtaaaataattacttcaaacgaattagcatatttattacctcagatagttaccacttttctgtgtccgtggtgagaacacttaagatctgtcctcttaatgaatttcaagtatacactagaatattgttaaatataatcacattgtcatacattagatttccagaactaaccatctgtgtggctgaaactttgtaccccttgaccaaaatctccccatttccccccgccccagccctggtaagcaccttctactctatcagtgtgagttcaactattttaggttccatgtataagtgagatgatataatatttgtttttctgtgtctggcttacttcacttagcatcctccaggatgcttagtgtcctccaggtcaatccatgttgttacaaatggcaggattttcttgtttaaggctgaataatattcctttgtgtgtctgtttgtgtatgtgtgtacatttaggtgtgtttttagtatcttgattattgtgactaatgccaaaatgaagtctttaagaaactaatttcatttccttcggatatatacactaaagtggagttgccggatcataagatagttctgtttttaattttttaagaaacctccatcctggaaatggtttttaaagctattgaaaaagttaatggcatctttcttcagaagctttctatctacacataggaagaggattaagggaaggcaggtaaaagaaaaatttctggctcaaatcgcagagtaattcagctgttttttaattgaaaaatgaaagtttatt

SEQ ID NO: 68355 - DNA, 1044 bp, Homo sapiens
tcttaaatttgctaggtaaaattctaccttccctcttagtacaattcactttttatgattatttctaaatttgtaaatatataaaatgtagaatatataaaatatatgaaacgtatacttgtttttgaaagaagcttaaatagaatttatttcccctcataaatataagaaccttcttatattttgtagcaccttttggggtggattatgatgaaagtattatttaaagaagacctggaattacattaacaaagaaatgtcaatataattaactcttttgagtgttagagaggttaagtctctaatcaaaacaaaattgctgtgccctaacttaaggcataattatttaaaagacaagtataagaaatcttattaagaaaaataagtattattttctttttctactaaatctcattgtaagtaaatactaaatatttgatagttcgcatttagaagtttgtaaatgttttgggtcccttagattttgccacagtttgccaagaatgcactgacttccatttcccccgaattgaagagcaattagaagttgtccaacaggtggtactttatgctagaacccagcgcaggagtaaattgaaagaatcacttggtgggtaaaactcacttttattatattctgtctataatcactgtaatagtatgtggatcagtattaagatcatatagaaaattatgttggtggaagataggaaattaaaaacaaaattaagatttttttaagttttttctatttagaaagaacatcaaaatgtatttttggttttttggggttttttttccttcaacttttactttaagttccagggtgcatgtacaggatgcgcaggtttgttacataggtaaacgtgtgccatggcggtttgctgcacagatcaacccatcgcctaggtattaagcccatcgtctattacctattcttcctgatgttcttcccttctcctaacaagcccgagtgtgtgttgttccccacaatgcgtccgtgtgttctgatcattcagctcccatttataagtgagagcatgt

SEQ ID NO: 68356 - DNA, 1387 bp, Homo sapiens
acatcaaaagagaattatcatgaattacatttaaaatggaggcactgaaattcatctctctcttttaagacattgtagaatgtataaggggagttccttagaagtattaatattataccatttcttattaaataatgcaccttatagcattggaatttaatagtaccaattattatgtcttaaagtcctcttagaatgctttgggtcattttaaggttattataacgattggagagttcttaacgttagtaaaagcatggatttgcctacacagaattgatagtttattgaccatttcctgtatattaggcacaataataagcaattcctatgtgagatccacatttggtcttctgtaataccactgggtaagacactatttttatctccacattatagatgaggaaattcagtcttaggataagcaacttgcccatggtcatatagccagtttacatggtagagcctgaatttaaacatgttagatttcagagcccagacttctaaccatatgttaacctctctgaataaaattattgtgccagttggagtttgggatcatttatttatatctaaatgctattacattttagtactaattttcctatatctagacattgattaagatatatctgaattttctttcttattccttatatttaggcattgaaaaacatggcagtagtaaaatagaaacaatgaataagtctcctcatatctctaattgcagtgtagccagtgattatttaggtaagttttttatattaataatttttctcatcaacaatgctgtttctctgacttttgtttaaattgctgaaattgtggctagaagcaagttctttaaatttgtcaagactctcttgatgtcatggcctttatttctttgtgttttagtctcattctgtcgtactgcagacacacattcttccctgaagggtcataactacccgtggcttctagttggagcaactgacctttgaagaaaggggctgcatattcccaattctagtttgaaaattttgggggaaagattatctctgtttgggtcttggatttatccctaaaactagaggtgttcccagggcactgatgtaccatggttgacccagattgggctaatagtctattactggaagcatgggagggatgaacctgggcaaataaaaacaatagctgtaatagagtctggtctgcagttcttgaaatatcagttgtcacagaaagttttccattgatttttatgcctctcctgaagatttggataagattactgtggaagatgatgttggtggtgttcaagggaaaagaaaagcagcatctaaagctgcagcacagcagaggaagattcttctggaaggcagtgatggtgatagtgctaatgaca

SEQ ID NO: 68357 - DNA, 1052 bp, Homo sapiens
atatatattaactcatttaatccacgcaacaaccctttgatggaggtttacagttatccccattttctaggtgaggaaactgaggctcagtgaagttagtgacctgtctgaggatgcaaacccaggcacccacaatggcaaccactgcagtgttctgctactggaaacagtgcagcacaaaggtgcataagaatctgaaagctgtggataaagttaaggcaacagaatcctcactttttagagcaaagatgaactatataatcttctgttttaggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttgggtaagcttggtccaaaacacttaattttataaaggaaatgtatgtggtttgtttgccgtatttttcttatttttgcctttgttctctttaacattttcctaacgtccatttcttgttaaaatatgtaaaaggaaggtggggtggggaagggagaaaagcggacaagaatgctgactccactacgtatgctagcacttactgtatatgacctcactttggtactcatggctgccgtctgtggttagctgttgtcacctgcattctacagtgaaaaactgagtgtcagagaggttaaataatttgttggaaatcttacatctaataggtgaagggctagaatttgaacccatgtttgtccattcagagtctaagctgtatcttggaccatattttctccagacaaaacaaggaagtttgcataattctaattttttgcttttgtgctttacttagtctgatttgagagctcttttgccacatgtttagggccctttttttttttttatttccccaaaacaaattccattagaaactacttttatgataaaacgtttaaaatttatggtgactcgaacatggaatacctgtttcttgtgtaaaagaagttaggata

SEQ ID NO: 68358 - DNA, 1516 bp, Homo sapiens
tggattatttcttcatctccattgctgcctcccacctatttttgccaaaacatatctaatgtgctgttttccttctattctccaccttagcaggcccccatttcctcttacctgattaccataataaccttctaagtagcctacttctcctacactaccaccagaaagatgtttttaaaatacaaatcactcctgagaaaaatatgtgcatgactgtgactagccagactcttgtacatggtctgcaaagctcttcataagtgatctacacccagtgtctatctctcacatttcctacccttgagatttctgctccagccgtacactgaaccagtcagtactactgattctggaacttggtgcatcctccatctttgcacactgtactccctctgcctggaaagcttctctcaattcacctttactcttcaatcttgatttggttcagaccatcctcactcacctccttctaactttaaaacacatacccccagattgcagtttccttttctacttggcatacctttagagtctgccatatcccttaccacactgcattttacacatctttactttcctgttcttcccactgaagtctagtgactaaaccttaaagtccttgggagcaggagccatgtttctaaccctagagcctgacacataatctcactgacacatactcacgagacactattgtgtaatggttagttacaaggatgggattttggaggaaaatctggtttctaagcttagatgcttactagctgtcagactacaggcagattgcttaacgtctctgtttccttctctgagagtggggatagtaatatctgtattggagttgttgtaaagagttagaggtaatgtgtgtgatatgcctaccacactgcctggcatattaatgctcataaaagatggctattcttaggctctcaataaatgtttgttgattaataagtttattttttatatgattatgtaactttataatttttacacatatatgctagacttactttttcttcctgcatgacaaacatttttacgtatatttttcaaataagtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactggtaaatttttttcctagttacaaacatcatgtgtgagcatttccccatattattacatattcttcaaaaccaaagttcctggttgctgcatatattcatttatttaaccattccttattattggacatccaggtttattattttttcagtgctataaataagattgcaataagtgcaaatgtccttattttagaaatctctgggcatattactgattattttcctaggataaaatttctagtaggaaaattaca

SEQ ID NO: 68359 - DNA, 1046 bp, Homo sapiens
atatggcaaactgggatttgcattcctgtctgtttgactccaaagccactgtttagactgtgtcttttaacccactttctatcatcagtcctaactggttcttcctgctggggcttcatctttttgttcttgaatctgattttatagtttgttttctctttcctaaattaaacagacatcctagttctctctctttctctttcatccccactttctttctcttttcccttcttgctctgtctccttcctattgcactgactcatgcatgtgcacttattatttggtgctaagaaattcttattacttgttatcttccattgaaatgcttatagaaacctgcccttggctcaccctgaagttttaggtagttctctttgactcttgtttttatgttgttaatggagaaattactagatctggggttataaaagaggaaagaattaaaaagaaataagaaaatagtcatgaatggccccaactaacactagtctttaaaagacactcttcctatcttcagtctgtaagtggttgctgtcaagaagggaaagtctatctccctaatgatccttgcttctttgtctgtatttcaggattggagacttggtttcctgggtttcttttcaaacttagtaaggagtagttgggtggacaaaaactaatatgctccattaaaaatcaatagcctcctttttagctctgtcatttgattacctgagtaaagtgtactgttacctgtttgtctcggaaagagtgagggaatcagcagggagtctgagatgtcatttctgttgtaataaatggagcttggatgaaatggcactatattatgactacagcagatggcccattttgaaacttgcattgaggaggctgcagaagtgttgagtgctgaggtatacccctatgttttcatccgattgctttctgctattataggaatgggacgcgagagataaagattctatccgacgagtagtacaacacagcaatgtggtcatcaatcttattggacgagactgggaaaccaagtaagtctttgactctt

SEQ ID NO: 68360 - DNA, 1028 bp, Homo sapiens
aaaatcactattactattactgtttttgaaaatcaaaatggtagaatattagcaattccatgtggttaagcctaatagcttgtgatggttaataagagagttgggaatggtaagagatgagcttggcaagttgtgggcaaaagcaaatcagaggggcctcaagctatctgaaggtaagtgcattcctactacagaaaatacttggatgagccttggattatgcgtacttggaaaatacttggatagcggtgattatttgagctcttgagaaggctcattcttttaagaagctttctgggaatagataatgccattattttaacttcacattttctttgttgagatcagtgtggccttcctcctttctccttccttccttccttcctttttctcttctttcctttctttctatctctccatctcccattctgtctctttttcaacaattacttagacatatattataatttcttacaggtcgtagatgtatccaaaggaattgttaatgcagttaaggatcctgatgccaatgggaaatcctttgctttcgttgggtaagtgcttagagtttgaattttaaattgtgctattataatgaaggaatcaatatctaaattagttactaacagatttatttgttgcacttttacaatatcaaaatctcctcattgcttgcattaaatcagaatttgagggaacctggaatctactttaatgaatgattcttctgttaccaaggtctgagaaccactgccctagactattacatatacttagtccagtgacccttagggatggttttgtactactccagtgatgtttttaatatataaaaggatattgctgtaaattctaaaacacaaacaaaacacttttagggagtaagtatggttataaaaccacattaattttgatggagtatcacaatgcctccagaggctgaaaaacgggtggtttatagcacaattactagtgctgtgcgagattgattatttcttttatgctctttgctaaaatttgctttcaga

SEQ ID NO: 68361 - DNA, 1049 bp, Homo sapiens
cctctttgtgtgttctgcttttatagtgatttgcatgaatcgaaaattgccacatattctttgaaagcaattaagtctcaataataggactcatgccagcttgaatgtttaagtgcctgctaggatagcactttgttctcagccagttttcagcattgtctgtggtcctttgtttatccaaagatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctaacctgaatgtgtttacactgaaggtgtttttaaaatttattttaataatgtccatatgccttttaaaaatagtagtacatatatagaaaaacattgtccatagattctcaaaccccttgcagtaattccacagtcttcttggatctgagctatctgaggccagcccgatgcccttagtaccacatctggattatttcagacacataggtggagatagattctcttcacatgcaaaggagatgcttcagcttctatgccagcagtgccagcacttaggaattatgaccttctaatgaagt

SEQ ID NO: 68362 - DNA, 1050 bp, Homo sapiens
aggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtataatgttttgtaatgggtttcttatgtaataggagaattcactatcaccagttcatattgataatcaattaaagctaatggagtgcctactggatgctcagcccattgctgggtactggggcat

SEQ ID NO: 68363 - DNA, 1040 bp, Homo sapiens
ttcttgacttatcattaattaaattgtgagaattgggagctagtagaaaaatctggacaaatgcgtggatggagaaggggatacctcaaatggcctaaatatagagggaaatgttctgtacaagtgatacgtttattcttgaatcggagatagcattggaggatatattctgtacaaatattgtgcttcaaatgcttacccctccatcatcatcaatgatattaaaatcattgcttaacctgggatatttgcttaacctgggaagcctccctgcatttccccagagagcctaaggctcccttcccagcctcctgatgccacttagcagcctgtgtttaatttgcattcctagaatgtgacttcacagagaaagggatctgttgttttcatttttgtgtcccccaccttgaatagcgacagccacaggaatgtgttgagtgaatgaatgcgtgaccagccattgtgagctcagaatgtgcagcagcgatttgacagtgccaggaacttggctcagagaggcagtgcaccttgccagggcttcaaaacagtgttacctttatcccccttttggcctgtcccaaggctaaggtcatgaatgctcagcgcttggtggccagaaaaggctgttcttactcccttttagagacctttcttccccacatcttagcctgcttagttctcctgcaaattggggctcttggtcacagggaatcgggtgtcattgcatacgcattaggataactcctcgttagacactcggaaagcaactcaaaacacacgtgtacagattattcattaagcagtctgttggtggtcacgtgctaaatgttggggaagatgcagagatgaatgtagtgctgctggccttggggtctggaaactggtgaaggaggcagtcaggttacaatcatagtgctccagggagaacaagggaagcaaggaagatggaatacagggttcccacttcaggtgttgttttttagtacaaaccatgattgagaatcctcttggttcaggagcaagctggagggtccaggaat

SEQ ID NO: 68364 - DNA, 1116 bp, Homo sapiens
tagaaacactacagcatttttagtagtaaactgaaataaatcttcaaataaacgactttaacattttgcacattggtccaggggcagaagagctcgtctgttgccttttaggagggctctaatctttttctgtttcagctcatcgggtcctcattgtcccctactgtatgtgcccagcacaatgtcagggcacatttctacacaatgttggattccagctgatcctccgtgttaatccattcgttagtgccaaattgcagggttccttgccaagcccgtcagcacaatcagagcttctgaagtcaggtacctcaattacattagttcagttgtctcattagcccccatgcatcatccaaactcatcatcaaacgtgttttccttcattattgttgtcattttcttaataccagtcttgttgaaaaaggattgttttagatacaattttgcctaacttgtttcatctccagaatacaatcctaaatagagccaagatttgccggagagaggagatagcggttgaggctggtgaagcttccctccggttagaattagagagaagtggatgcagaacttgggccagtaatggacccatccatctccctagtcaagaggacattcttgcagccagaggtggttccgctttggaaatgatctactttgtgtaaaccggtgcatcacagatactgttagagtatctcacagatactgatacagcatggtctgcattttgtagatatgagggctctcccttaggtttacagccggataaaggagctccacttacctggtgatcacaggcatgtggtccaccctgctgggctctaggactttgaacatagagaaggctatcttttaggaagactgcaggatcaggagtcgggaagcagggattctgcttgtagttttacatctagcagtaacaacttttagcccatccctcacctactctgtgccctggatttcttggctttaacatagcaaaagcctctctttatagttttcctaactccatctctccccaaaaagctggagatgtaagttttaaattccagtccttggcacatagtaggtgctcaatctctcatccttctgtccctcaagatagccgatggc

SEQ ID NO: 68365 - DNA, 1048 bp, Homo sapiens
acaaaaacattgacttgggcagctattatctgaggtcaaagttattctttaattccagctgtaccttcagctgcctatgtcgctgaagcaacttccccttgtgtgttttcacacttagagattggagtaatccagacacagaaaatgataccaaaattgaaatgtttctgaacgttaaatgattcaataatttgaaaatagtttcaaatttttcaaaattcaaaaatttgaaaatagttcgactagagcccatcctcacctcaggtagttacgtggtgtgtgtgtgtgtgtgtgtgtgtgtgtgtgtgtgtgtgtaggcacacaaacccatgcatgcacacatgtatgcacagtggtggatgagtgtgagttaccaaaacaaataccactaaatgcaggataacaccatgatggctagtagctggattgactcagattttctctgcagatccttcctagtccaccctccttccatgacatgggagtttgtgatatgcaaaggataaagtaaacctgagtttcctggggcttgtgtcggcataccaagctcctttaagatctctctttgccaagatggggctaagccagaggcttccttggcctggggaataactgtcctaccttcctccctggagcggctggcgcacactgttttgacgtgtgccatgccttccatcttttacggcctcggggccagaggagggtatgctttgaacaatgtgaaattcctctcctaacagctgtgcaaaggaaactcacagctttctatctccatctcggtccacttagctttcttttggggtataggtttcttgtctgttcaggggtccctgttcctcactttctggccttcagaaggaccagtttcagtacttcctttcttagggaggcaagtcagtcttctgaggttctctgttttattttattttatcctagagtatgccttcactgttgaccgtgtcttgcctcatttctgctaagaagccagcatcttctgaaaattgagtgtcttgtcctgtttcagatcttgggccgaggattgaccatg

SEQ ID NO: 68366 - DNA, 1006 bp, Homo sapiens
catgctttgccaaggtagagtgaaccatgcgtctttgcaggctcaagggatgtttaaagaagcggtaggacatcgtccacccacaagcagagaccgcaggataaagcagacatccaatgtaaatacaacccgtgcaaaaagcagagtcggcagacctggagtgcattcgcagtatctcccgggggtgggggaaagaaatcacctcttcagaatgtccagaggggagttgccttgcttacctggggggcggtaccctctctcgtgccctcacagggctactcagcctcaggtagctggtgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattga

SEQ ID NO: 68367 - DNA, 1023 bp, Homo sapiens
cgcccagctaatttttgtatttttagtagagtcaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctacatttctccttctacctggacccccttatccttaaattgaccatcagaaca

SEQ ID NO: 68368 - DNA, 1273 bp, Homo sapiens
gttatgatcgcaccactgcactctgacctggccaacagagaaagaccctgtgtgtgtgtgtgtgtgtgtgtgtgtgtgtgtgtgtatacatatatatatatataaagtagatggtcctgttggaagaggagttatgagaaacagtgaaaggaattagcatctatatttcaggagcagtgtaggcatggggaccctagaagtgctactattttgggtccaatgagccaactcatgttttgagttgtagaaatgtcatatgaaagaggagcagagacaacagtaaggacgaaagggacgagcacataatgcagccgttgtgccctccccattcctccagctctgggatgtcttggggagccacaggctaggggctgggacaactgggtctgggtccttactggcaactttcccgtgaggtaccagttatgggaccttgaacccttcacgtaacccctttgcacttcagtttcttccttagcatttgctatttagaaattggggaaagtaatgaggagtgaatgagatgctgcttgtgaatattctttgcttgtccaccagtgttagaaatgatgcattatcagtatgtggcagcatccgcaggatttcttaatttaggacattctcctggaatgctaagggcccactgaaatattctttaatctgtcatgaacagccattcttaacctccactgaacagaacaggggaaatgggctgatgcttcagtagtggggataagattcagttaaagaatgtcttgactcctgaggcattacgatagggtagaaagggtggtaggaaggagctttccctggagactgttaaggacaagaggggtctgtctctgtgggtttatgtgacaagagactgggctgaccagatggccttgggctgtccctttgtacccaaggcagttgggtaagtctcctgggttcttgccccaatcttttcttgacttggagaagagctcaggctcagctgtcccctctacccacttccactttctcttccagagaaatgaacagagctccctaaaccagtgaatctattcgtaagaagaggtcacatcaattggagacactcagggagcacagacttaccatgtagctactttgtgggatggtgtgaggagattgatgagaagcacacacattttttttcctcttgcaaattggttgtgctccctttgggaagacaggaccacaggctttctgaaggcaaggaccagggctggccatctctgcctccctgggcctagcatagcccctggcatgc

SEQ ID NO: 68369 - DNA, 1007 bp, Homo sapiens
gcagtgagccaagatcgcatttctgcactccagcccgggcgacagagcaagaccgtgtctctccaaaaaaaaaaaaaaaaaattccatagtccccgtccttcgaccttcccagtctactgcagcagcagcttacaaactcagcgttagatgattgtaagataaatggacttgggggtgggggtggcatttgcagatttctctgcgtgaccttgcagccctctattagcagcactgggctatttccaggggagtgttgaccgggagggcgtggcccccactcctccccaccacatcccaggctcgctcctctcgccccacagccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtggtgcgtgccctccctgcccgcagccctccgggccgccccccaaatccgtccacgtgtgcttttcgaagccctttctctgcgttgtttcctgtggaaagagggcgtagggcattgtgacaaacacgggtggggaggacggttcatttgcacccacttttcccttccacctcccagcaggacaggcggtggggaccggctgatgattcgggcctgttccaggaagacaggttggctcctcctacctggaggcctagaacgtgggggtccctgcaaagcttgggtttcccgtggccgctgccacctagtgttcgttcagcacagaaggtcaggctgtggagcgaatgggtcccagatcccactgggtctccgcctcccttaagagtccgatgaaggcaagggaaattcacatacaaaccctttgcttgtaactccaggcaaaccaccgatggacaaaacctctggcgttgtat

SEQ ID NO: 68370 - DNA, 1036 bp, Homo sapiens
tgtgattaagatgggccacaattgggcctgcacaccaacccaggcatggtgaggtcatggctggatgggctggggcagctgctctcccgcagctcctggcacggccgacaggagttgaaagaagacaggagtagctgatgcagggccttggagccagggagatgctggaagtgtgcaaattagctggcccttgttttgcatccctgccagaatggtttagcagagaactgaggagccagtaccgattgcaggcaaatgagaatagttataagcatttgatttcctggtgtcatctcatttgatttcattttgcagaaaccatctagggtaggtccaagtactgctgtctgtgtcagttaggagtaggttcagctgtgagtgacaggacttatacaatctaagtttatttatctctcatgtaaagaagtttggggtaggatgtccagggccatgcaagatctcatggtgttgggatccagggtccctctgtcttatttctctgttgtccccagtgggggcttctaccttgtgcaccaaaacgccggctcaagcttcaggcatcacaactacattcccgcagtagaaagagaagggactaaggaagaagcagtcccttattttgaggacacttggtggaggttgcacaagacccctctgcttatagcctactgggtattgcttagtcatatggctgcccccagctgcaagggaggctgagaaatggaatcttattcctagcagctctgtgccccgtgggggtgggaaattgaaaactgaggattctgtgactaagaaggggagaatagctcctggacaactttcaacctcttccacttttcccctctttcacaggtagggaaatgaggatgcagagaggcaagataattttccttttcttttttgttttttgcgacggagtctcgctctcttgcccaggctggagtgccgtggtgcaatcttggctcactgcaacctctgcctcccaggctcaagtgatcctcccacctcagcctctctagtagctgagactacaggc

SEQ ID NO: 68371 - DNA, 3222 bp, Homo sapiens
gccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccacgtaagtccgcggtaaaagtggcagggagtggctgcctgcaaagaccccaagacggcttgaagaaggagtgggtggcgggtgggggttagggcgactaggcggggaaacagggagagggtcgggctccgcggggcagctggggccggggctcgccgacctgggcgggggcggggggcggggggggtgcggcccgggcggggccggtggggcgggaggcgtggccggcggggggagtgggggcggcttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctgggtgagtgagcgcgactgccgcgcgctcctctcagggcccacctgttcgcgggccccggacactggccgcggccgcgagtgccggcagctggcactgcccgcaccgggcaggcaccgggcgggaagagagagcgccctgcggctgccagctggctccaaggccgggtccagagccgggcgggacggccgcgacgggcgcattcgggtgggggctcatcaccgcccagccggcgtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtggtgagcagtatggcttgtgaccgggtggggtctcccaggtagtagggggcgccaggaagggagggtgcgggcacggcgagagctcagccaagagcggctctcacttttacgcaggagcggcaggggtgcctcggccgcgggtccggccccgggacccagtccctgagagtcgggggcccctccacccttgaggaggaacctcgcaggcccccgttccctcagactttgattctgagccaccgtgagagcgccgaactccctggtagctccctgaaagactagcttgtcttgatttctttcaaggacgataagtatcttcactggagagaactcagagttcgggagaggagggggcagatacctatctgcgcctctagtgggatgagtcctgtgtgtgcatttccgggagagatcaggtgccagccagctgcccgcccaggagagccttggccttgccctctcccctccccgccagcccaggcggcccacccaaggccaggcagggcgcagagcggacgttcatctggagaggccagcggggccaggagctccagagacacctgctgcaggccactcagcctctacaaatgggaaggctgagaggcgacagaagcaaggaataggaaacccttgtgtccttgtttctatagccacattccctgcacacacatgacaatacttgccgctctgcaggcaggaagagagtctctatgccactctcaagatagatggatgtagaaacaggtgcatgccaccagagtcttgtaacaaaaaagtgcacttggccaggcacagtggctcatgcctgtaatcccagcactttgggaggctgaggcaggaggatcgctttcatccaggttcaagaccagcctgggtaacatagtgagacccccatctccacaaaaaaataaaaaattagctgggcgtgttggcatgcacctgtgatcgcagctactcaggaggctgagatgagaggatggcatgagcctgggaggtcaaggctgcggtgagtcatgattgcaccactgcacttagcctgggtgacctagtgagccctgtctcaaaaaaagtagaaaagaaacaaatgcacttattccccctggagctggtcactgaggtccccacaagcctccttagggaaatcttctaagattcactcctccccagagctgaaggggtggttgaacagtttttccaatttgcagagactgacttcccccagtgcatcagtcaccataacacacaccccagtgaggacggcatataggtgtgctccttcccaacccttgacttgctttaaaaagaccctgctggccgtgggcacccctcctcctgtgttgccacccaccccagcaaccacccagctgccacgcttagcttctttctttcaccaatccctggcagcagaaaagtatgcgggaaggcagctggcctcacccacccttgaactttgggagttttcctctcccctcccaggtacagtctctcccggctggtgtgttggttagtcctcagctgtctgcctagactgcatccaggtttgggactgcagggaaacacagactgccacagtgtgcctccctacccccatctgccccatggcatatgcaggaagctgatgcgaggctcacagggccactggtatctactctgtctgtggcctgctggcctgcaatctgtccgtactgtcctcagcctgccaccccactcgtattcagaaccccctatgcctggccccagcctaggtgcagctgatgacctatgtagtctgaaacagaaatcactcacactggaaatgtttggaatgacttttgaagatcatgcagtccagctctcttattcatagtgaggcagcagaggaagagagatggggtgatttacccaggatcgcagagacagagccagtattacaattcctggggcccctactttacttctgtcctcttccatcttcatcagaggcaggaagatgggcagtagctatgttttcctgaattactgttcatttgtcctgtatctgggtccctgtggagatgaagccctcatccctaggagatgatgtaatgaaaaggaagactgtggtcggtccacttgtgcagagtgttagtctttagagcctttcttgttctagtcccatgatgtagccaa

SEQ ID NO: 68372 - DNA, 1066 bp, Homo sapiens
ccctggcctgatctcatccctgtgggtcactccctgatggccacagccaaaccagcaaatcagtctgttcttccaccacctccagaaccggccctcctagctctattttgattgtttctacatttccttcagacctccctgcccgcctgcccaccccccaaaaaacagttgagagggaaaacatcttgctgatgtccatgtggtagacacacaagtatttctccagctgaaatggggaaccagggttagggccagtccagtctgacacatgcatgtctgccctctttctggtcagagaaggggaggaactccttagggcaaaagagggaaaggtttggctatactgacagagcccaatcccctccccacctccctcagcccctttgcttactgtctctcatgcctcgctcactgatggaaacagcagtgtggggctgggaggtctctttcccaagaaaccatatcccctagacctaggggaggctggtgcgaaacacagagacctacactgggaattcagagacctggatgtgagcccagctctgtcctcaactcactttgaaaccttgggttggtcacttctgtgctctaagcctcagtttcctcatctgtaaaacaatagcttggaacaaatggtctcaaaaggtcctttcaagctcagtctatgaacccaacacccctacacataccacatacaacaatagaactctcctacacaacccaaaataggaaccaatattgggtacgatgtatactatgttggtgatggtcacattaaaagcccagacttcaccatgtgtaacaaaactacattcgtgtcccctaaatctataaataataatataataaacaaaatacaagccctgaattggaaatgggagatggataccaaggcttgagtcctcagaacttagcttttcttggcctttacctctggagcaagagcccagctggtgcttttctttgctgttgcttctcagttccctctcctcaccctgggtggggtctctctcaggggtgttcattgcccgtataccttagtacttggcctagtgatcaaagcacc

SEQ ID NO: 68373 - DNA, 1470 bp, Homo sapiens
gactttgtgaaaggcattagaaatgataaattccctagtgatcaagtgcagctcagatgggacagctggcctcccacccatccctctgactctcagcttaatcattgcctaaggagtggttttcactcggttaatttaatgagtgctctgtatttctagtacacacgaaaaatgcaactgtatgatcttccagccaggttgggcctcttggcttagcttttcccagagcttggtgcttcatctttgttcaggaagaaaggaggtctgtctctcttctccttccctccaaatgcagacggaaagtctcgtcctctgaggacttgcagaaaggaggaatgtctcaggagggatcatttggggagctgcactcccaaggagttgagaagcagcctggttgagtaactgggaaaggcaaagcagcctgacttggagaggggcccggattaatgtgattccagaggaggtcccggtagagagaagtttggggactactgacttggagaaaaatcagaaacccgggtcttaagagcccttcctcttcaatccttaagccaggcattgtgcctgagggaagaaatagtggctcttatgagctctgctagaaaagtaacccttcaggccaggcgcggtggctcacgcctataatcccagcattttgggaggccgagacaggcggatcacctgaggttgggagtttgagaccagcctggccaacatggaaaaaccccctctctactaaaaatgcaaaattagccagtcatggtggcaggtgcctgtaatcccagctacttgggaggctgaggcaggagaattgcttgaacctgggaggcggcggttgcagtgagctgaaatcgtgccattgcactccagcctgggcgacaagagtgaaactccatctcaaaaaaaaaaaaaaaagaaaagaaaagtaacccttcacagcttacccaatgcacatccaagtttccagtgacacctctgagcaggctaagcagctggtggctcctgccaagccctctcctcggaactgagcttcacagcttcaggtgccagtcccttgctgacactcccagtctaagctgtgtgttagtctccaagttcagaaacaacacaatacatgggtcataggagaagaacctcgactgaggctaaaaataccataaagttaatcaggcagttttattaattatgaatttattaattcaaaacctattcaaggattttagttttttttgtttgtttgtttgtttttgttcttttttttttgaggtggagtttcactcttgttgcccaggctggagtgtaatggtgcgatcgcagctcaccgcaacctccgcctcctgagttcaagccattctcctgcctcagcctcctgagtagttgggattacaggggtgtgccaccatgcccggctaatttttagtagagacggggtttctccatgttgatcaggccggtcttgaactcctgacc

SEQ ID NO: 68374 - DNA, 1941 bp, Homo sapiens
ttcttaaacttgagcgtgatgagagtcacctggggaggtgttggaaaacagagtgccggcccagtcccactccagtttcactgagtgagtctaggagggaactgcgaatttgcatgtccaggttcctgggtcatcctgctgctggtctggggtcatttcgagagctgctggactggcatagagaagagtttcctgggttgcctttgaagataagaatttctgaaggtttgagcactgccttcagacagtggctcggtagaagtcccaagagcagaagttgtctggagaggagagatggcccccaggatgcgcctgaccaaccagtcatacctacaaaagggagttctggttctctagggctgtgatctctggggcttttcaacttggctgtagtaaaactaaagttagtaatatgccctgttgtcatctagaaattccgccatgagctattacagtagtttagttgggacgcttaaggagagcaagtcgtggcaatttcttctgctgattacagcggagttttggttttcttgttcccggtgtttactgtgtggtggagctggataagggagcaccccaaagcctctagtcctgcccaagtggctttgcccttccaaagacaacagccccagccttcatttggaggtgggagaggaggacacagagagggttggaggaggctgtgggcatcgggatcctgtttgttcttgctggcactgcctggcccggcttcctgaggagtgaatcagcccatccaaggcttggcatgcagtagtgagccaagggttgccatggagatgggcgaggcccagagcccacaggtctgggtggcctgacttgtttttaaatgttgaagtctgtgcgaagagggagggcctatctccacttctgtggctttcttaaagcgtgactggtattttggggcctggaaaactgctggtgtgggaaacttgcatccccagtatttggtgtgttgcttacttcctgggtgctatggacaactatgactaatgctctcccaagtttagtagatgacaaaaacaaaaaccagggctgacaagcatcttattgaaggagggtgataaagaggccaaggtttcctctcctgcccaacccaggaaaatcccctctctctctgttatctgctgctgtaataactcctttcagcagggttaatttgcccacggaagcagtttgtgatccaaggaaggacagaagcctaaaatctgagccaacagtctccctttagccttccttccccactttcctttggccattcccatccagtcttagtggagctctggatggcagtttgcaggtgtgaagcagataagtttatccattttcctccactacccagcgctcacacagactcccacacaaaccaggaaacagaaccccagtgtcctaaattcccccgctgccacccagccgccttctccgatcacaggaggacacaacagccgtccacagagggcccatgaattgacccagtgtcacctcacgtctttctcagggtttattattattgtcattttttttccctatggaatccggctggctgtaacacttcacagttttcagaatgttttacatgcatcactttatttaatcctctccttcaacctacgttgaaggcaggacaggtatcatactgttttttttccacaaacgaggactgtaacgttcagagaagctgaggaaagtgtgtagtgtcagagagctcctaggtagcagtgccagaattagagcccaagtttatatccatcacagtccagtcattctcaacagaggcgtgcaatagaatccctgggagcacaaagagtcccctgggattgctgaggcaggtgcatgtttagaaatcccccaggtaggctgggtgccatggctcacacctgtaatcccaagctttgggaggccaaggtgggtggattgcttgag

SEQ ID NO: 68375 - DNA, 1075 bp, Homo sapiens
aagctctctttttttcttgctcctggcccctcccatttagtttctcctattattaaagtagctgaagctgggcgcagtggctcacacctgtaatccaagtgctttgggaggctgaggcaggaggattgcttgaggccaggaatttaagaccagcctgagcaacatagcgagacccctggctctacaaaaaaaaaaaaaaaaaaaagggtttaaaatattagccaggattagcggcatgcacctgtaatcccagctactcaggaggctgaggtggaagaatggcttgagcccaggagtccaaggctacagtgagctatgattgcaccactgcactccagcctgggtgacgagagcaagaccctgtctcaaaaaataaagcagctggggtgaaagccggatggggacaggggagcccctctatgccacaccagaaagtgagttctcctagaaaatacttcagagcgccttagatagcgctgcctgacaaccatgaaaggcattattgggtggcactggttatacaagttttgtgaccctgtgaccccaagccattgtgactcagccaactggagcaatgtctccaacagcgttacagaaaatggggcagctgatggttcacatagcatcccccccggccggtgaactcagtcattctgtcagaaaaggcagcagggttcactcctgatttttgtccaagtgttcccagtcatgcccctggccctcccttttctctgggttacttgaacctttctcctctcttattgtgagttgttaagcctgtgagaccgagacctatggcagcttttcccatttctccagagccagctgcttttccttcctggttgtagtgaaatgttgtagctttgacaaccaagccgcatgatgtaaggtttaaggtggggtccgaatgcgggggactcccgactccgggcttggcctggcccttggccaagataagagacctgagatgcttccttttccctcgtggttccagttctccagcccagcatccttcttaccacctgtgcacagagaccggatcaatgactggacttaacatattggctcagggtcc

SEQ ID NO: 68376 - DNA, 1101 bp, Homo sapiens
cctgagcataatttcctcctccacctaaacatcaccactcacctgataacaatgcttttcctttatcatttataggcacatgtaagcgtctagctctgtgtgcatccctaaacagcatagcgtttttaactacatggaatcatattgtgtgtgtgcctgtggctctggcttcttggtttagcattgtgagatgcactcatggtgttgcgtgtagctagagttactcgttttcactgctgtatagtgttctgttgcctataaaataccccttcagccaatgggcggcaggtaggtcactgtttattcctcgcttgctggtatttttagtacctgcatgaatcaaacacaccccgtaatggcatctacaactaccaggcgtatatgaggggcagagaccaagggtggtcacaaagtcctttgcaagtctcacccttaagcgcgtggggactgtgttgttgctggcagccagaattaatgctgatgtcctgtatgtcttgcagcttgccgggattgctgtccttgccattggactatggctccgattcgactctcagaccaagagcatcttcgagcaagaaactaataataataattccagcttctacacaggtgagggacggggaaggctcagtgaattcagaccctggctccaacaaagttcctgcaactttggaggccccatgttgacccagggacttgggcttgggaaagacttttgctctagccacgctggccagtcgtgtccctttcaagttgtgcagtttttgtgtgtgtcgttgtgcctgggaatttgcgtttaactgatgtggtttcttttcctgatggccaagtcaggcatgttgatggttctctgatgtgatgtagcctctgccaaagttgtactcattcttgagggtttacgaacctctgttctcatctctgatgctctctcctgattgtcttcttatcctgcatcatttccttaattcaaaaagctttgtcctggggatctgcagtgctggaagaagatatagacagctttcctcttcactgttcagatagggactctgagactgggaaaaacatcagcctcctggaaaacacagcaacaataggagagac

SEQ ID NO: 68377 - DNA, 1013 bp, Homo sapiens
tttattgttagctggggttttttggggtgtgtctctctattatcggaaagaaagtgagagaaagcacaatgtatgtttagaaaaaaaactacacatacacacagagtttttggggaacaggtttctatagcgccctgacttgttttggcaacagaccattttttgggagtctgtgacaggcttagaatgctgtcctgcagagcaggagggaggagccgggtgcgggtgctggggaagactctccacactccacgccgtgttccagaagggagccctgtgctgggggagcaggtctgccggcaggagcaggcacagtcaggcctgctttcctaagcaaaagccctgtggccggcgcgtgtgtctccaaagagagactcagtcctcccttgtcctggctgcttctaacaacccactttttcttttctgttacccaaagcctctatggctgattctttatatttttagatgtgggagttaagaatctcatgggtaagaggatggaactgggaggaagacactaacatttttattttttattttttttattttttttttgagacgaagtttcaatcttgttgcccaggctggagtgcaatgacacaatctcggctcaccgcaacctctgcctcccaggttcaagcgattctcctgcctcagcctcctgagtagctgggattacaggcatgtgccaccatgcccagctgattttgtatttttagtacagacggggtttctccatgttggtcaggctcgtctccaactcccgacctcaggtgatcctcccgtcttggcttcccgaagtgatgggatgacaggcgtgagccacctcgcccggctggaagacactaacatttttgagcccccttctttgtgtgtcattcattgtcttgtgtgtattatataatttaatccccttagctctacgaggagtgtggagtgattctcatctcacaagtgcagaaaccgaggcctagagagctgaaataacttgtctaagcttatattccctcaag

SEQ ID NO: 68378 - DNA, 1044 bp, Homo sapiens
taaactgagagccctggtgaacagtgaaaaacactgttccatttcttgtgtaaaggacacgctggcatatgctactgctgctacaccagcctttcttttttttttttttttctgggcctgtaatgtcagcctgaaaaaagcagaataaacaacccttaagcaaattaataccgtaatcctagagaaggctctgtgatggataactttttccatgagtcagacagcaagctaacattcgcttgttttataaaggggaacactttgtcatttatcaacagcagccttggctaacaagcttggggtgtaagcgatgagtagcttctccaaagggaagcactgaatagcccttgtaaaaaccagcccgagccctgcagtggttccgtgacttccatggggcctgcttccagatgagctgtcctgtagcttgccggctgctgctgagtccccgaacacagctgccaggggatcgcttcccttttcccgtgactagagagggctaaagctaggcactgcagatccgtagccatccacgcaagatttaaagcccacaaaacccgtgatcctaaaatcttcctctgctgagccctagcatgaatatttaatattaaccacaagccccattaggagcatgttctctttctctgcgtgggaaatactttctctttagtagctcacttgcagctaatccaattcccttggcctctgccaggaccgccaggttcaagaactgggatctggacttagagaaaacatgtctgcctgttcgttcccactccacggtatttcatgtgtttgtaaatccttttgatctcttaatacctcctgtttattcagcccctgctatggagctcaaaggagtgacctcatccttccttgacttgcccccattagatggggagaaactggggcctttctactgtccccatgtgagagaaccaaaggaggctgccctcttacccagtgctccatgcatggggctgcacagcctccccaagcccagcttgtggcctcaacagcgtttgactgcccaggaagatgcgacct

SEQ ID NO: 68379 - DNA, 3866 bp, Homo sapiens
ccctgggtaggggggtgcctaggtgtgcacggccccttcctgctggaaatctgctctgacagcgtcctctgtaaggcagggtcccagaagttagccagagtgtggaaggtatatgctaactagcttgagtggattcatcttgctggaaagagctgacagactggaccagtttgcattccgaatgtagggattcccgtggatattctctgtcctggattgagggctaatgggcaccttccagaagggctgagggtaaggtaggagcgtgagcttgatgaagcagagtcatgcaagagaggctggtgggaaggagacctggggcagaggtggaagaggaggctgtattttaaggaaagggaacttcttccctgagatgaggggaataaggaggtggggaggcaggagttaggcagagggaaacaggaattgccggagatgcctgggcctctgaactgatgtctccacgcgtgtgtgcttcctctgtcctcccgcaggagtctatattctgatcggagccggcgccctcatgatgctggtgggcttcctgggctgctgcggggctgtgcaggagtcccagtgcatgctgggactggtgagtatcccctcggcatccccacagccaccctgactcccaccaacaaaaacctcagcaggcccagacccagaccacagaacagatggagggggatggggtcaggaaggtacccaaagggcatgagctgtcctcagcctgggcccctccccgatgtgaggcgtcgcccctcttcctttctggagcctgtcttatcgcttcccctaggcaactaaaaggactatgtttcccccttttctcgaggaccacgtttgctttttttccctgaatccacaggtacctttgccttctccttcttgtttcaaaatctgttttggtcttttccgaactccacggagtggattcgctccctttacttgcccaaatctcttgtcttttgtgaacaatagtagttgcctgctcactgactcttaactaacgccttgtaaatgctagttctgggctcagctgtgctcagctctttcctcatgtccgggcaccttgcctcactgtggcctctgtcctgggcttggttaactgcctgttctgtgaacttcttccctgcccctgctaggctattcatttgtgtcaccagatgcctgttcccagggagttgtccttcttccttgtcccaaaataccctttgattttcctggctggttggctgggactgttctcaccccgtcccctcgttgccttccagttcttcggcttcctcttggtgatattcgccattgaaatagctgcggccatctggggatattcccacaaggatgaggtaggtttttcccatgagatctcttgggtttgggagttgggggatgggggacagtgaagcagggggcaagtcctggctgggcactttgttcagctttcagctgttgaccaggcctcttatctcatcgcgtccctgtgtgccagcgaatgtgccctcctcggggcagggaatgtcagtgcgcttactgtcctgtccgagattgtgccagccatggtgttgactcatagtagatgttcagaaactacccattgggcctgtgcgtgtgtctgtctgtccatctcacacctcagcagcccttccccacaacttttagaaagattactcaggaaatacaggctttctgtgggctggacacccttgcctcctcctctgatctataaataacatgttcaagtgctgcccccatgagccaagtgctgcccccaagcctgtgcagggtccacagatgtttgaactatgggccccacatccggagacttggccatctagtatggggaaaagacatgaaattgataagggtcatagaggtgatttatatccaaagtactatgggatttgaaaaggtggggctgggaagggaatctcttttggcttcatagagaagggagccgtgacctaaaccttgaatgagagatgcgttcaggaggaaagttagtggaggcaggggacttccagtcaaaggggctgagcatggctgagcttgggcttacgtggggagccctgcagagttttggaccaggatgggccatatcagagtagtgtttttggaagggctgccttgtcatgttcagcaggaagggggaaggaagagagatgctgagatgctggaggcaggaaccctattgttttgttttgttcttgagactagtcaagcgcggtagtgagaaacagggaagagtagaacaaggacttccatctgtaactgacgtgagcaatccattgagataactcactacttttagcccagccaagggaactctgtttaaaaaaaaaaaaaaaacatgtctgtaagcaataacagctacagccatagaaataggaggggatcattgtgaaaaatgtcagacagatgctgaaggaaaaatgctggctgttggtctgttaactggatgtggtgagcatcaaaggggcagacagacattaaattgggatgcgccaggcgcaggcacataataatacatcccctatattatgatacaatagctggcacgtgctccagatttactctgtactggacatagtggtaaaggcttaacatgcaatatttcatttaaattctcacaaataatctatgagctgtagggacaaatgtggaaactccatacagagaggcttagtaatttgccaaaactcatacctaagtgaagagaaaaacaagatggaagcctgagaaaatagtcaggtcaggagtagtatttcaattattatcatcctctagatcatagagattcaatttaggagccaagttaggagccaagtagagctgaaggactgaccaaagtgtaagggacagggagaaacagcccgagtgggtttctggaggatgtgggaggagatgggaagtgcccaaaggccctgagagaaggcagtgctagcagctgccatctgcccagtgacgttgtccaagcacaggcatctggtggctgagagcttagagagaacaagatggaacgcataacatttgttcgtggaggaagatgtgaaaatgccgtctctgcccctctctcgtctgcccattgtaggtgattaaggaagtccaggagttttacaaggacacctacaacaagctgaaaaccaaggatgagccccagcgggaaacgctgaaagccatccactatgcggtatgtcgccttggcaaagacaccctcctgcgctttctccggattgtgtctgcacacagggtgctgactgcaccagaccagtgcaaacattctaatcgtcttcttacaatttgtttctctcatccccatccctgccttctcgctgtagttgaactgctgtggtttggctgggggcgtggaacagtttatctcagacatctgccccaagaaggacgtactcgaaaccttcaccgtgaaggtaaactcagaccaggatcctggtgtccctgcccccattgctctggacaaaccctgcaagcatgaaagtgacagcagccaagtgctgcttcagcaagacccgttctgcctgtgaaagggccccagggcacccatctctttctctcccactttgggccctctgtttactcaagggcaataaaacaaaggccggaccaggggaatgacaagtgttctggcaccgcccactgctgccagcccggaagctctcaagggcaggcgtgcttctgagtcttggactcccactctgactttgtcagtggctcctgtctgtaagccagagttaatgtccaactccagaatagtaaaaggtgaccttacaaccatgtcagaaatagacccccaagcagggcctgtccctcctccttccctgacgtcctgcccagattttagggatcca

SEQ ID NO: 68380 - DNA, 1376 bp, Homo sapiens
atagaatattaacattttgggaggccgaggcaggcggatcgcaccacagcactctagcctaagcaacagagcaagactccatctcaaaagaaaaaaaaaagagtattaaataacatacacacaaagacaaatgcaaaagtactaacctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggtttttgttttgtttaattattttgagagctatttggtttgcaaatgtctttcaactcctattaactccacctgcatttttttttttttttaagacggagtttcgctcttgttgcccaggctggagtgcaatggcccgatcttggctcaccacagcctccacctcctgggttcaaacaattctcctgcctcagcttcctgagtagctgggattacaggcatgcaccaccacacccggctaattttgtatttttagtagagacggggtttctccgtgttggtcaggctggtctcgaactcccaacctcagttgatccgcccgcctcagcctcccaaagtgctgggattacaggcgtgagccaccgtgcccggccccacctgcatttatatgagaagtagattggg

SEQ ID NO: 68381 - DNA, 1134 bp, Homo sapiens
gtgcgtgggctggatcctgttccgtcggtgcatggactggattctgttccgtcggtgtgtggacgggattctattcccgttggtgtgtggactagatcctcttccgtcggcgcgtggactggatcctgttccgtcggtgtgtggactggattctattcccgtccgtgtgtggactggattctattcccgtccgtgtgtggactggattctgttctgtcggcgtgtggactggatcctcttccgtcggcgcgtggactggatcctgttccgtcggtgtgtggactggatcctcttccgtcggcgtgtggactggatcctgttccgtcggtgtgtggactggatcctgttccgtcggtgtgtggactggattctattcccgtcggtgtgtggactggatcctgtcccgtcggtgtgtggactggattctattcccgtcggtgtgtggactggatcctcttccgtcggtgcgtgggctggatcctgttccgtcggtgcatggactggattctgttccgtcggtgtgtggacgggattctattcccgttggtgtgtggactagatcctcttccgtcggcgcgtggactggatcctgttccgtcggtgtgtggactggattctattcccgtccgtgtgtggactggattctattcccgtccgtgtgtggactggattctgttctgtcggcgtgtggactggatcctcttccgtcggcgcgtggactggatcctgttccgtcggtgtgtggactggatcctcttccgtcggcgtgtggactggatcctgttccgtcggtgtgtggactggatcctgttccgtcggtgtgtggactggattctattcccgtccgtgtgtggactggattctgttctgtcggtgtgtggactggattctattcccgtcggtgcgtggactggatcctgttccgtcggtgcatggactggattctgttccgtcggtgtgtggacgggattctattcccgttggcgtgtggactagatcctcttccgtcggcgcgtggactggatcctgttccgtcggtgtgtggactggatcctgttccgtcggtgtgtggactggattctattcccgtccgtgtgtggactggattctgttctgtcggtgtgtggactggat

SEQ ID NO: 68382 - DNA, 1122 bp, Homo sapiens
ttttttggtttttagtcacagaacaacagccagactctcaccttctccctttcagaatcccaagagctactgaaaattacgggtattttactatgcaaaacaactcagtcccctggtagtctcactccaggctaacaggaaagatctgtcaagatctataaccaagatatgcaccaaggctccctggccttccttagcaaaacaaagaaaactgaaactttgaaatgacttttcctgctattgtctcacaccagattattagggaatcctctctagagccatcagtctttatacactgaagagggcagtagaaactctgttggtccctttcatagagcaatccccagggggcagactattgttttctcaccctggcagaaacgttgacttgcagatttattcctagcgggtctagctgtgatgactcacacttttagagaaagtaagcttctccagggagaagagactgaatcttggggaatgcccagggactgagaagaggaaaaggaacagagacaggaacagaaagagccgtcagagatggcgaccaagaaattaaagcagggagactgaaggaggcagccgaggctaagagccagggtctgaaggagaggcccgagcagctgtcagggagttacttcacctcttggggagttgcagtgcacgcaggacagacagtccgcaagtggccaggcacaaggcccagcactgtatgggcactccataaatgtttgccgttgtcatcattagaagaaaggggtggtctttggggcctgggtagggcctgctgctgactggggaaacgcatccgcatctgttgctcaggaagtcagtgggcacgtttcagagttcggttttagtccggcactggggagttctgggaggagagtgggtgaatctaggagccaccccagagacagcagggaaaggaggcatttcctctccatgggtacaaaggaagaagaatcctgctaggggccctcccttcctcttctcagttttgtaggggggtcacattctggcttaagcgccaatttccttttcctttcccgtcccctctgcccccatgtgtctctcctcttaaccaagccgagaaaattctcccagggttgctggagaggc

SEQ ID NO: 68383 - DNA, 1066 bp, Homo sapiens
gttatctcccttagttgctagatcatggggatgggggaagtggttgaggcccaggcagcagccattcccttaccagcatggaagacttcaatattttaacaaggatatggccataccagcaagtcctgatatcagtgctgcccacagcagccaccagtacctcccttttgccaaggcttgcctccgcctccaacctcagctctgccaccttctcttccctctccctccccctccccctccccaagccaacaaccgaccttctgtaactctttacccttcaaggctgtccttgaaagtgttgcagtgactgaactaggactcaaagagcaaggccctgtcccagctctgcttctccatacctgtggcaccttgagcaagtcacttcacctctctaggtctaggtttcttgtctgtaaaatgggctaacattcatgttctccacaccacagggcaatgatgtgtatcaaatgaccacatgtgcaaaagtgctttgaaaattttttctcaggtggcgctatttccttttgatggtacctgtatgaaatcgctgagggagggagaaggcagataatataatgcgtcctctcctcagccttctaggaactttcctccctctgaaggacagcagagtcctcagcctgggacaaagcccacctctgcccacgttctgccctcctgctcctcccagcttcagggcagaggcccaggtggtaggagagggatgctcttgaaggagcaaccagtaccaattcagaacacttattctaccatcaccaccaaccagggagggcttcctgaaggagggggaagacctgataacaggtctgccaatgggacatgagaagcaggaagacctgtacaggtaggaaaagggccattctgttcaccccactcacccccaacactagctccagagtttggtgccaccaaatcccggcaccaccccactttcttatggtaagaagtaccccctcagacagttacttaaccttagagtctccatgtctcagtagtaaggtggggtaaaaatatctggttcatggggtttttgtaaagattaaataag

SEQ ID NO: 68384 - DNA, 1041 bp, Homo sapiens
aactagatatgtaaacacactataacctacctttatagcaatcacagagttttggccaatgaaaggcagcccacttgtcaaaccttgtccaaataaggcaaacgccgggggtgtaaccaatccgggtgtttctgtaccttacttccgttttctgtgggtcactttccttttcctgtccacgaatattatcgaatcatgcagcagcccccagagtcactgtgaatctattctggttgggggcggggggcactcgattcgaggttcattgtttgctcagtgaaactcaagttaaatttaatttgtttaaagtttttcttttaacaattaaataatgtacattctaataccacagtgcctggctcataataagtgctcgataaacgctagctatgcttgccattcttttaattataaataacgagcaagtctcttagaatgccaaacacaccttcaaccagagctacattttctcctgtgagaagttcaggggctgccagagctgatgcctaaggcccagccagctagacttttctggtagagatggaaatagagctgaatggaagaggaagtgaagatctggactagacggtggttaatgtagctgcacgttaggaccacgtgggggctctttcaaacaaccttgttctggctccagcccagacccattaaatctgaatctggcaagtaagaccctgcactggtatttttttctttaagtgaggcataattgatgtacaataaaatgaacaaatcttgagtgcccactcaggtttgacagtcgagatgttgaacactcccattacccggtgccccctttccatcaattcctcttcctctcccactgtcattttctgaatgctatctctatcaactggttttgtctgttcatagaattcgtataaatgggatcatacagtatgtattttcttgtatgtgtgtctgacttattttgcttaatgtttctggaattcttccctgtgttttttgcacgtatcagttcctttttattgctgagtggttttgatgagcctattctggttg

SEQ ID NO: 68385 - DNA, 1063 bp, Homo sapiens
ctggctcccagcgctccctgtccccgccccgcggccagctcgctccactcccacttcctgagctccgccatgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgaggaaggggcctggtaggagtgggcgagggtgggcaagagggatctgggcagccgtcgctccattccctctgccctcccaagctgacccctgactaattcttctctcctcttctccatctccctttgaaggtgcctccatatgcgtcggagaaccagacctgcagggaccaggaaaaggaatactatgagccccagcaccgcatctgctgctcccgctgcccgccaggtgagaggcaatggcaggacgaacctgggcctcggaagtgggtcacgggggctccagccccctcgcggcctcagagggaaggtgggcactgtcccccaggaaaactggctgctggagacgagcgtgggaaaccctggacatcacgtggaggagatgggactggccctccccactgggcctcctctttccttacctcactgagagggagccggagggccactggcaggatgatggggggccagagagaccgagggaaaggccagggtcacactacaggcagcggaggtgagggtggagcctcgtctcctgaggctctactgctccactcacgttctaggcacctatgtctcagctaaatgtagccgcatccgggacacagtttgtgccacatgtgccgagaattcctacaacgagcactggaactacctgaccatctgccagctgtgccgcccctgtgacccaggtgagtggggatgtgcctgcgggggggctgg

SEQ ID NO: 68386 - DNA, 1086 bp, Homo sapiens
ccagacaggactcaaactcctgggctcaagcaatcctcctgcctcagtctcctgagtagctggactacaggtgtgcaccaccatgccctggactttatagttgagactattatcatatcaattaaaaaatatctaaaagtatgaagatctgtggcatactaggcagtcgtgtggggagatagggacagtctgccctagcagagaggagtattttatcactgataatattcagaattgccagtgtcgggagatggtgagactataaagccatctgacttttagctgattttatttttgttctgaaatattttacagtctgcactcccttattgcctgcgctacgggtagactacttccccactttggtttgtttctgacatgatggctttgtaactatgaaggattacatccttgtccttcattgtaaactaatacatgctatggatgtatttggggtttaaacatgcgtttcggggttcaaacatgcgtttggggttcaagtgttatcttctgcaacttactctcagttcagaggaaaatacacacgtacacatatacacacatgaggagtcgggggagagagaatgtggcaaattgttaacaactggtggatctaggtgtagggtatataggtgttcattatattattatttcacctttttttgtaggtttggaataaaaagagagaaatacctacgcatgccaggagtatggtagacactggacagacatgaagacctttttctaatgggtcaggatagatttaggttggaccacagagaggttagagtgttctggggttttccaaggataggacggttgcccctaattttctctggacttggctgtttcttcttggagactcaaagaagcagggcacagagtattggattaatgggctctggggaaccctgtcatcatgttctcaatttcttgtgccctcgaggatgtgctgagctggagagggcaagtactgggtttactaataagatcatgaacaaatgatgcatccctgagctttacccctgaagcaccagagcagcctagcatttcactgggagaaaaccgggttttggctcgataaga

SEQ ID NO: 68387 - DNA, 4570 bp, Homo sapiens
ttcagcctcttgagtagctgggactacaggtgtgtgctaccacgcccagctcctttcttgtcttggtcactttgtgtactctgcacatgtctttccacaggtctgctccagctcagccacctgctgaagggacagaagggactgccccaggtgggggtccccctggccctcctcctaacatgaccagtaacagacgactacagcaaacccaggcacaagtggaggaggtaggtagatagctgtttctctgaaagtttccaaatctaggagtttggaaacaaaagggaacttcttatcttttctccttttttcgtaggagaatagtcaaaggccctgagaggcaaagcaccctttagagttgcacagggccagacttgtgattctctggttgttgtcctttcctctgtctctggcaggaagcttagctgctttgtttctgtgccctcctcaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaaggtgaattttcttgtcccctcctccatcttttcctgggcttccactggtagaaggcaagaaaaccctcagcttctacatttcttccctctaatggtgcaggatctctctgaccagcataacgcttgggaggaaatctggaaagcctcctcttgagattgcattacccagaattggccaccagggtaggctagagtatttagaaccgctatcagggaaaaagtgataccctgaggagtttggaatggttagttaaggagctttaccccaaaggagttgcctgcaaaaaatttcacctgtctcatcctcagacacacccaacatcagcacaatggctcaggcatatatacatacacacacacacacacacacacacactatatatacacatatgtatatatacatatatatacatttatatatatatatacatatatatacatttatatatatatatacatatatatacatttatatatatatatacttttttctttttcttttaaatcagctttctcagattgaaatatatatttttaaataactgcaacttttgagaatgagctgaacacttcacagtgaaaattgaactaattggttaaatatccagagtctgtatctctattggaatgccttctaaagccccaagacaccaggaactaagcaaaaaggagctcaatgcaggtcctgtgatgaatctgaaaagctacagacatactgtggttatgatcccctgggaagcagaagggtagggcctctctaagaggcctgcaggtctcctgggtgatgggtggttttttccattgtcccaaggatggaaggaattctgtttcccactagagatgtggctcttttcctcattcctgaaatccaagggctcattttttgtccatgtttcctcagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctgaagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaactggcttggttgttgtttgggttggagtagctgtgggggcttggggaagggtgtcgtttctttctagtagtctcatgtcgctttaggtcagctgggctggcttacacgcgctgtgcggtcttcatggagatgggagctctgtgtgtcagcacaggaagtggtctcccagcgttcagcctgaagcagcccaagtcctgtaggtgctggtaagaggaagtgaagacaggaagttgcgtgggcatctcacactggcaaacaagcacaggttccctcaggcctcttccatctgcctcctgtgctccttcctaggtccttggcctgcttgtcctgtcccaggggatgtgcccagataagg

SEQ ID NO: 68388 - DNA, 1710 bp, Homo sapiens
tccggcaggcggaccggaagcactgaggcgggaagggtggtagaggcccctcctgccggaacccggggggcggggctcgtggctgttgcggatggggcgtaggtgggcggtgcgcccacagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtaagtggctgatgtaggcaccccgataactgcttcgtagtataataggcggctcagattaattccctcccttccccatccccaggtgtgcctagattgatcggtataaggctcactctcccgccccccaaagtggttgatcgttggaacgagaaaagggccatgttcggagtgtatgacaacatcgggatcctgggtaagacttgaccttcgacgtggtacacaatttcagaatggcaattaggctgtaacgactatcttttcctcctgtgtagagagtggtactgtgctcaatagtaagagcaaacacttatgtagctgtttacattgtgtttggcactgttctgagtcccctcgtataatttttacttcataagtaaaaataaacagtttttccaaagttaataaatggcagcatcagaattttaaccccaagcagtctggctccagagtctgtgctattgttctgtactgtaatgttccttgtctataggtgctgctcagcaagatgcaaccgtgggttgaaagcttagctggtgtaggatgagttctcttgtcttggatctaatgtgttctctcacattacacaggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtcatacttctgtactactctcataaaatatttattaggcatattctctgagtaggaactataggaaaaacaaaaaagtgtgaggtgtcctttccatttaaatatgaaacattaagtaccatatgaatggtagagatggcggatactaagcctgactggtcatcagttttctgggtgttttaacatttcaaaagcctagtcctaacccctaaagattgatca

SEQ ID NO: 68389 - DNA, 1063 bp, Homo sapiens
ttttggcctcagacgagatcagaccattctctctatacttaaggagctttgcacataaaaatggaaataatagtactttgcacattaatatgccactttatagttctttaaacaccttcgtactgcttgatttgtttgatcatcagagcaactttgtgaagtaatcagagtttagtaaccctgtttttacagataaagcccagaggtttaagtgtcaagaccaagtgccaaagtcactactagaattagtttctagtccagggtcaatctcagatcccgtaagataatgttactagcttgctataaaactaaaaaccattatatatgttgggggtggggaactaacaaaaccagatgatgttactagcttgctataaaactaaaagccattatatatgttggggatgggaaagtaatagaaccagatacgaagacaggtcttgaatatagaccctgactttttcactgtttggtttctagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagaggtaagagtccatagctgtcactgtacctagctctttcaaaggaccatctcacatggaattgctacattgtcatttctgttccactacaccaggaagcatcataagagcaagaaacatgtttttcctattttgctgttttatcctaaaattgcatgggatgcatgacccaaagagtacattcattaacttccttttctggattagtcaaaaacagtcttggtgtatgtgattactctttggggaaaagttattttccatctttaccccttactgtgtgtcaaaattaagtcctggtggatttaagagttataggagtggatcgctttttcagaatgtctcggacttaactcgacctgtttttggtaatacctttttggagtctttttggatgtgcaattatggggacaaaaacccataatatatatgtaccact

SEQ ID NO: 68390 - DNA, 1461 bp, Homo sapiens
caggctgcctttcgagctcaggggcccctggctatgctgcagcactttgatactatctacagcattttgcagtaagtgaaacacccaactggtactttaaaaagaactggtgactgtttgtcctaactgtgcatgttagtcctgaaattccaagttataggttcactgataaatgcctctggatattgatatctctactgatgagcatgtacccagcttgccaccgtatttattcagttgaacaatttcacgtgtatttttaaacattcgattccacgggttagatctgatctgttagaaggggctctgcaggctccttcctgtctcacccccacactttctttccctcatagtcactttcgaagtatagatcctggcctcaaagaagatactctgcaattcctgataaaaggtgtttatgggtcagggggtaggggatggaaggtgtttgttatcgtttgtttgtttgtctgtttgtttgtttttcctacattttgtcagccacatgatgatatcaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaaggtaatttggagttttgggctcacgttatatggggtctggggagataggggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgacagatcttgacccacttttttcccttattttttcctcaatgtatacatgatcctttttagggtaagaaagctcggaccaaggcagcccatggctttgactgggaagaagagaggcaaccaattcttcagcttt

SEQ ID NO: 68391 - DNA, 1894 bp, Homo sapiens
gtgaatacctaggcagttaatggaaaaagttatggccaagcacaagcaagcttcgccttgactaaaggtttgacccctctatgcttctctctcttagaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggtaaccaacttctatgtggcaaaaacatatggtacctctccatataccagtgtaaagaggaatccagtgttgaagataaatatctgccccaaagaggtctagaattcacatttttattatcagtagtaaaagtcttcctctaccaaggacgaggatatctggctccctttaaggactgtaatgtgtcttaccactacaaggagtactcctaatctatattctgtagaaagggtttttagagtgagtgggtagctcagtttagagtatacttaaagatcatcttgaacaaaatggatgatgtgggacttgagcagattcttctcttcctaccctacacaggctctccccctgacacgtttccaggcagtggtggctttagctgtgggacgtctggcagacaagtcagtgctagtatgtaaaaatgccatccagctgctggccagttttctagccaataatcctttctcctgcaaggtaagtagacttggtccaccaaaagagaaggaattaaatggaaacagggatgaaattatgtcatttactgaccctgctattcattttacctgatagcttagtgatgctgaccttgccggaccactgcagaaggagacccagaaattacaagagatgagggcccagaggcgaactgcagcagcttgtaagtagttactgccttggagtcctaatgccagacaggcttctccttgcagtcagaaactctagtgaaagagactaagtgacactctcatttagctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaagtaggcaaaagaatgggatattcttcgtgatctgtttatgtttagagttaacctttgagaaacttacataatgtgtcttttaaattaactgcacacagatatgctgccaccaggtgatggtagatgttttcatgtagtaatggtctgaccataggcctagtccacaattaagcatgtgtttctactttataaatgtttaaaaaaactactgaaacaattaaatgttaacagtattataatcaaacatgagtcctccttcaattgaagaagagcacctataaataagttctagttgtatgatcttgaataagttgcttaactttctgtgcctcggtttcattatctataaaataagaaattgattagatcttatgatctctaaggactttctaattctaaatttcatgaactaataatatcaaacatgcttaatactaccttaatcttcaaacctagtatgaatcctgatcttagagaaaagatttctcctagtgtttttgtgactctagaacttaacaacaaaagcccttacagccgtcaacaagttttttttttttttttttttttttttttttgagatggagtctcactcactctgttgcccaggctgcagtacagtgacacgatcttggctcactgcaacctctgcctcccaggttcaagca

SEQ ID NO: 68392 - DNA, 1230 bp, Homo sapiens
ggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcagtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactggtgagcatagggctggatgagaagtttccacaggactacaggctggcccagcaggtgtgccatgccattgccaacatctcggacaggagaaaggtatgtggggg

SEQ ID NO: 68393 - DNA, 1083 bp, Homo sapiens
cccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacgaaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaaga

SEQ ID NO: 68394 - DNA, 1034 bp, Homo sapiens
gcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatctccccttcctgcagacagctcctctcctacatcaccaaggacaagcagacagagagcctggtggaaaagctgtgtcagcggttccgcacatcccggtatgctgccctccctgagggttctttgtgctgagcggggccctgcaggggagaaaggcccatccctcaccccttcaatgcccccactgtggcatccctgggactggggaggctgatggggaaggttgagcctttactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttca

SEQ ID NO: 68395 - DNA, 1612 bp, Homo sapiens
taaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctg

SEQ ID NO: 68396 - DNA, 1235 bp, Homo sapiens
ctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgca

SEQ ID NO: 68397 - DNA, 1007 bp, Homo sapiens
acacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaata

SEQ ID NO: 68398 - DNA, 1032 bp, Homo sapiens
atcaggccactcagaacagcgtgcaatttaaaacttaggaattgtttatttctggaatatttcatttaatattttcagatcaaggttcaccttgggtacctgaagccgtggaaagtgaaaccagtggataaggagagagtgactttattcttttcatttatttatttatttatttatttttttgagacgtagtctcgctgtgtcgcccaggctggagtgcagtggcgcgatctcagctcactgcaagctccacctcccaggttcacgccattctcctgcctcagcctccagagtagctgggactacaggcgcctgccactacgcccggctaattttttgtattttttagtagagacggggtttcaccatgttagccaggatggtctcgatctcctgacctcgtgatccacccgcctcggccttccaaagtgctgggattacaggcgtgagccaccgcgcccggccttgactttattcttattgctgtcacattggaggtgtttgagaaggaagtcgagaaattattttcctatatactcattctcccaacacacatcaaactgtcctgctcctgcatcaaacctggttttcttggccaggtagatgaggtttcctggatttgtgctgctagctaaagacatggcaagggaaaccagtactccccaccctcccgtctaccgcggctcactgtttcctcctcctgcctgacctgattcttgtctccctcttttggatggtggatttaaggtttgtgttttcactgtgccttcaaccaactaggggcctttgtgcggccatcttcgtgagaagagatctcgggctgccatctctccctagtcttccctggacctcaagtgcccagtgtaaaacatgatctgaaagaacgaaaataatatcttaaatggaatcatgccttttaagctatttttggctgggcgtggtggctctcgcctgtaatcccagcactttgggaggccaacgcgggcagatcacttgaggtcaggagtgtgagaccagcctggccaccaacat

SEQ ID NO: 68399 - DNA, 1526 bp, Homo sapiens
gtctgcttcctctcctctcttcctctcatcttctctcttgcttcctccacagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgtgagtccgcaggccgtgctcccgcagcaccgacgccacagcagcccaggaggccggagctccccagtcccccgccaggacgaggccccgcccgccctgacacccgggttccctgtctctaggagggagtatgattttgaggacgactgtgacagcctgacttgggaggagactgaggagaccctgctgctttgggaggatttctcaggctatgccatggcagctgcagaggcccagggagaggtaacctctgctcccggcctcagggccctctggctctgcctctccagcctgaagcccactcccccgctcctctccttgctctgtccccccatgtggctgtcatcctctacctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagaggtaagggcaggagcggaagccaggggcgtggtgtcccagagggttttgagtggg

SEQ ID NO: 68400 - DNA, 1058 bp, Homo sapiens
gggaggggcagtcgaggtgatgtggaggagttattattaggaatactgcagtgcggctgtgaatgaggagatgggacccagaggctgacacaggaaggaagatggagggaaggggaagaaagggcttcacccaaggcttcagaagctgcccactcagattttaattttcttgctgtcttcttggccccttcctaaccacctttcttgtgttgaagtttctctcttggtgcagttcccctcccttctcgggttgacagaagtgatgagctcacaggaacaggatttgagatgtgctgctacgccagctagactgcagggccctggaatgccgggcgggtcctaagcagcacgttgccctggcttccatctctgtgatggaatagaatatgcactgcctgccatggctgatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctgggtgggtagtttctggagctagtggggaaggactttgagtgtctcctaccaggctcttgacccactctgttgatacactatgtgtcctgcagatgcttttacagggttaaatgataccacaagaggcagggcagcgggctcgacgagctctgttctggtgcgggcaggaggcgggagcccggatctgtgcgactgaaggtgggagactgggccgggtggacctggtggtctggtgtgggcaggaggtgggcaatgaggccagccggacagctggctgagctggggcctgagcagggatgggcatcacggaggaccggagcctcagcacttgcccaaacagagctcct

SEQ ID NO: 68401 - DNA, 1696 bp, Homo sapiens
tttttttttttttttttttgagacggtgtcttgctttgtcgctcaggctggactgcagtggtgcaatctcagctcattgcaacctccaccttccaggttcaagcgattcttgtgcctcagactcccaagtagctaggattacaggtgtgtaccaccatccctggctaatttttgtatttttagtagagatggtttcaccatgtgggctaggctggtcttgaactcctggcctcaagcaatccacttgccttggcctcccaaagtgctggaattacaggtgtgagccaccacgcctggcctataggcagtgatcttttaatacaaggttcaactaggacttgagtaaaggccaagttatattaagtaatgggaatttaggtaatctgctcttaggcactgacctaattgtgtggagctcctgcccaggaaatggcaattctcatattttaatatgagaatattaaaatatggtgataaggcccattttctgacaccatctgtttaattttaaccccaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactgagtatttttgagggaactgggtgctgcctttgccgctttaagggtaaagatgggaggtgggactgggatcttctgaggagagggaatggttgggtgctactgagaaataaggtcagttttaggctcctgcatccttgggttttcccaggaagggaaagccctggagtcagagctaggggtgattgaactccggggagaggagggcaatagaagtgtaggggaaggcggggcacactagctcatgcctgtaatcccagcactttctgggaggccaaggcgggtggatcacctgaggtcaggtgttcgagaccagcctggctaacatggcgaaacctcgtctctactaaaaatacaaaaaatcagccgggtgtggtggcgggtgcctgtaatcccagctact

SEQ ID NO: 68402 - DNA, 3319 bp, Homo sapiens
ataggatggagtgggagagagaaactgctcaatgactccatgatgactgtgtttggagtaagcactataggagttgtggggtatgggccatgtttttatgaagcatgtgtttaatgtcttcatctgtcttctgggtagagtagcctatgaggttattaaaatcttcatccctaccgggcgcggtgactcaacgcctgtaatcccagcactttgggaggccgaggcgggcagatcacctgaggtcaggagttagagaccagcctggccaacatggtgaaaccccatcctatgaaaaatacaaaaattagccaggcatggtggtacatgcccgttgtcccagctactcaggaggctgaggcacgagagaatcgcttgaatctgggaggtggaggttgctgtgagccgagattgcgccacctcactctagcctgggcaacagagtgagactccatctcaaaaaaaaaaaaaaaaaatcttcatcccttttcaggctctaatcaatcgtggggttaacctggatcccctgggcaagtggtcaaagactggactagtggtgtatgattcttctgtgcccattggtaagtctcccccacccaagagcccttctacctctgtccctgtccctaccgcatgtcacagggtggtccttctccacaggtgctacccccgagtacctggctgggcactacatgctgcagggagcctccagcatgttgcccgtcatggccttggcaccccaggaacatgagcggatcctggacatgtgttgtgcccctggaggaaagaccagctacatgggtatgagaggggcaggcaggtgggattcatcgggctgtcttgcttttgaaagtagatggggttgctggggttgctgactcactagtgctcatggaacacaatgtgcaggtagctagcagggtggtgaggaccagtttctggagtcggcctgggttccagtgtgccacttactacccatctgactatggattctcttttgtcatccataaaatgggatggtaattgtgcttgggttggcccttgtattacgcttggattgtgagggttaaaatgatgcgtttagaagtccttggcagtgttcagcacatagtcagcagccataacttttattaagctgctgtcacttaaaagaagtaatttagtatgtaggaccacataggtgtttggtaaaaatgggaaaaccacatcggtagacttgccgatcaccaggggctagtgcagagtggatcagcctatacagtaggcaggcttgttgggagcgaagttgccttgaggtgatgacacttctcatgtggattcctggacaggagggtgggagcaagtgtggagacagtggaactggctgatcagcactgttactgccctctctttagcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtgagactcgagctgtgtgtcttctgaggcttcttccggttgaccttctcccttcctgacctcaatgtttagactcgaccctagtaaatattgccctgctggttgcagaagagacatatgattcatctgtatcttttctccaggtggtggggggctttgaccgagtactgctggatgctccctgcagtggcactggggtcatctccaaggatccagccgtgaagactaacaaggtgaggagtcaggtggtgggcccctgagaggccttggctgggtctcgtagagctggaaactgagatggggacaccctctgggctcccctctcctcctgaggctgcctttgggtctctttttgggacaggatgagaaggacatcctgcgctgtgctcacctccagaaggagttgctcctgagtgctattgactctgtcaatgcgacctccaagacaggaggctacctggtttactgcacctgttctatcacagtgagacctctgccatggcagagcaggggaggctgggctggggggctctttgccccttagagctcccttcagctccagctctgctttttcctccgttctttgtcttccccccacatccaggtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggtaagtaatctttttcttcccttcgtcaccacctttgctctttccacctttcaggaggctttatggtgtgacaagaggaagggaaaggaaagattcatgcatcccttactccagcctttgcatgcttggctgagagaaccctctcattccagctagaattgcttttgagtgctggaccccatgtgaacaggctaaagtgttcatatggatggaggcctgttcctttattctgccaagtggctgcagttgttcagcactaaatgcattccaaatgcaggttgtggtttcttttccttcttggcacagggtggacttactggtactggacctctgctggtccagcaatctcagcactgggttggaacagagctccacagagctttgtcagcagttctctgagcccttcacactcattgcagattgttttctcagccatcttgaggagtctggcctggatctcaagggaagggtggggttttctgaaacagccttgagagcactgcttactgggatataaccctgggtttagttggaagagggagagaagtgctactttagaaatagtagaatttgtctgggcgtggtggctcatgcctgtaatcccagcactcacctgaggtcaggaattcgacacggtgaaaccctgtctctactaaaaatataagaattagctgggtgtggccaggcacggtggctcacgcctgtaatcccagcactttgggaggccaagacgggtggatcacgaggtcaggagatcgagaccatcctggctaacacagtgaaacccccatctctactaaaaatataaaaaattagctgagcttggtggtgggcgcctgtagtcccagctactcgggaggctgaggcaggagaatggcatgaacccgggaggcggagcttgcagtgagctgagattgtgccactgcactccagcctgggcgacagagtgagactc

SEQ ID NO: 68403 - DNA, 1052 bp, Homo sapiens
ttcaacagtgagcaatgctgcgcccatcttattttcatttctttgctcctctatttccttctgagagcaagtgttggatttttatttagcgaaaaaataagatatagagatagaactgctacaagggctgatggaagggcaggcctgtattaatagcccttgtctctcttcagttgctgcccattgaaagagctgctcggaagcagaaggcccgggaagctgctgctgggtgagttttggaagctattgggatggagcataggaagccactggggtggggaagctgtgaggaaggaggaggtatctgttttggtctgtgaatcactctgttcctggacctgtttctaggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatatccttgcagggcagagtgaagagttaggaggaaggtggttgggagagggatttccaggccttaggacatcatgacacagttccttaacaggcccacatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgaggtactggattgccagaatgcctcttttgcttttcttttctcgcctccttacgctgtgtaaggaagatgttcggcccccttgctcccctcttctgactgagctccttagccagcctcacttattccctgctgtcttgccccgcagctggtggagttcttagaagctaatgaggtgcctcggcccgtcaccctccggaccaataccttgaaaacccgacgccgagaccttgcacaggtgaggggtggcc

SEQ ID NO: 68404 - DNA, 1560 bp, Homo sapiens
ctggccaacatggtgaaaccctgtctttactaaaaatacaacaattagctgggtgtggtgatgggaggctgaggcaatagaatcgcttgaatctgggagaaggaggttgcagtgagttgagatcacgccattgcactccagcctggaagacaagagtgaaactccatttcaaaaaaaaaaaagaaacttgtatacagttattaaataataacagggctgagatttaaatggactccttttaattagtgtactaattctcttaccatgtttatttccgttcccatttatttttaatgtcccctgtaacttgttctgcctcgtttttcttttttaaacagtaagtgacgaaaattccaagaggctgtctagtcgtgctcgaaagaggtaagtgtgggtgtcaaaacttaagtaggttaaattggtactgctcatctttgaccacagagttaattctagactctcacatttccctatggtggaaatggcagagcctggaagtatcttcccatttcttcactccttgaatctcttgtgtcttttcagggcagccaagaggagattgggctctgttgaagcccctaagacaaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggtgagattcatctttttgggcattcatagaaggatccttgctatttagtttctttcccagattcttgagactgtttcttagtggcaaggataagcctgactagaggaaaggggtttttgtgctccatcactgtttccctactgccttatatcctcccagtgcactacaagtttgaaagagctgtaggatagagcatttaaaaaaatctagaaggctgtcttggtgtaggtatgggaaggtggacaatggtgtgctccactgatgggcacagaaatgcactttttataaagcagttatctcagaactttgaaaaatttgttccttttggctgggtatggtgcctcacatctgtaatcccagcactttgggaggctgaggcaggaggattgcttgagcccaggaattggagaccagcttgggcaacatagggagatcccgtatctacaaaaaattaaaaaattggcctggcacagtggctcatgcctataatcctagcactt

SEQ ID NO: 68405 - DNA, 2110 bp, Homo sapiens
ctcaggtgatccaccgcctctgcctcccaaagtgctgggattataggcatgagccactgcgccccagctaattttgtatttttagtagagatggggtttctccatgttggttagcctagtcttgtactcccgacctcaggtgacccgcctgccttggcctcccaaagtgctgggattacaggtgtgagccactgcacccggccacctcttttaactttaaacatattcaggttcttgagatggaaagcaaagcagaataatacagtgtcatttgcgatactttagaggtaacttcaggtgataaaagatcccttcaaattctagacccctttcaacattttgtttctaattaaagtaaaaggttatgaggaggcggagggtgaaataaggaaaagaatgctgttataatggaggtggggagacagattctgaaggtagagaagagaaaaaacgaataagctcaagaagaggaaatacaataatagtaagggatagtgaaggtttaggtgactttaaaaagcacaaaatcatggacagttggaactggaatatgaggagtaggaatttgaacatggtggaggtcaggtcagatgacagaagacaatacatcacagttacttggtcactgagaagtgatggggggctggtccactagggtagagggagctcagtctgggccaccacagctcaccacctctttttctccctatgcagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtaggaccattttcttcttgacaccacctcttcctgcagaaccattctggagcttgtaactttgctgtatgtccctagctttacatactgggtgggtggcctatcagtgaattcccttgagattgggtggattcctatcatctggaattctgactcctcgggtctccttctctaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtattttagtgctctggttcagtgtgggtgtaggtgcaggtggatgagtgtgtgcggcaggagcctggcacctgtatagttgaaaattaagggctacgtggtgtcctgataccccactgagtaactgggttctgtgtgtgggtgcagtatgtgccttgccaacgttgacttccacctgtggaaaatgagaggctgcaaaactgcgggcaccgccgcttaatggctctgtgaccttgagcaagttgtttaactttggtgggatgcagatatctcatgtatacctcatacggttgtcaagttaaaccagtgaagtacatggaacggttttaacacctaaccactaccttaatgttagtttctaggaaggctgaggggggttttcttgctaagttgtgcaaaattgggatgcaatttgtggaagaacacagcctcaatcccacacccccggaggcc

SEQ ID NO: 68406 - DNA, 1096 bp, Homo sapiens
tacaggtgtgagccaccgtgcccagccaaaacatgtttttgaagagtagttgataaagagtagatgataaaaaggaagatgcttaactgtgtaactaaatgaaaacataatatgggtatgtatatagtatgatctcagttatgtaaaaaactatgcacaaaaaaacctaaaaagaaaaatatcaggatgtatttctagaaggtgggattatctgttgttaaaaatttttgatattctattttctaaattgagtttttatcgcttttgtataagagaacctaaagggtaaagagttttaaaaatgaggacattgaaaaagggaaagaaaaaagttacaaggcaaagttaaactacttgggtgtgggaatgagctgtccatgaagttcttcataggttcttattaccatctgaaacaatgagaggtgagctgagaggccagtcagaagtgagtaaagtgagttatcagtcgaactcccgtttcctcttatcccttgtccagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaaggtagccagtggctcccctgcctcctgccgattcggcctccctgatctgactgcatcctaatgtacatatatttgttttcaaactttcagagctcctttgtctgggagtttaggaggtgctagggatctttgccatccttgggaggttagtatcttagaggcaatcaaggacagtagttctttgcctttttttttttttaaagagatggactcctggccgggcgcggtggctcacgcctctaatcccagcactttgggaggccaaggcaggtggatcacgaggtcaggagttcgagaccagcctggccaacatggtgaaaccccgtctctactaaaaatagaaaaattagctgggcatgtggcgcaacgcacgcttataatcctagctactcaggaggctga

SEQ ID NO: 68407 - DNA, 1739 bp, Homo sapiens
ccaccatgcccagctgacattactgtaattgcagacatttagatgtgggtctatccaattggataatagtgtgcaacagaggagaatgttcttcctttaggtatagtctcaataacatttcttcccctaggtgctgctgatgtagagaaggtggaggaaaagtcagcaatagatctgacccctattgtggtagaagacaaaggtgggtgtttggagaagttgattgtggttcagaagaactctaaaaccagaagcaaggactgtatctgccctgcctccctgtccatactcatctagccattttatcccaagataaaagactgtacctgtccccacatttagttgtcagtgggccaatggcaccattttctgggtctgagagacacccaggtggagaaggggtgtaggtggatggattcttgtagcatacagtgttctgggtaagggcgatggtgctgggctttggctggagctgacatttttcttccccatattctgtagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactggtatggaaatgaggggcccaccagggttagaaggatctgatgtgaaattggggttcttgtcagaaaccacggtacagggactttacctctttacctctgtttgatgagggaatgccaaactgatagtgggttctgtggagaaagccagaagcaaattatatgaaatggatccaggggtaggggatggtgggggacaagaataagtagctttttcaattctcacagatgtttgcttccccccacccccaaccttccctaaattcctcctcagagttgcactccctttggcagaatgaagagcgggcagccacagttaccaagaagacttatgagatctggcatcgacggcatgactactggctgctagccggcattataaagtatcctttgcctgaatctgtactgaggcttttggtgaaaggttctgaaggtcttttagtttgaggttcttactttccttgttttgtttttcctgagcacttttccaatagccatggctatgcccggtggcaagacatccagaatgacccacgctatgccatcctcaatgagcctttcaagggtgaaatgaaccgtggcaatttcttagagatcaagaataaatttctagctcgaaggtttaaggtgagcggttggggaggaatatattgcttaagtgacaaacttgaaagtgcgtaacgtcctgcagcagagggagtctgtccatccagcgcactgttctcactttcttcattctatggaaggctttgctcccaagtaacttacacattagggttgaagacacacagaattgaaagttaactaactgtacatgagctgtaggtgactatgtgtccaatcagtgacacactagtgcagaggggtttgtttggggaacactgcagattggagtattcaggaaagatatagaggtgggattgaattgcatctctgaagatgtagagctattagtcagtgggctgctggttgttttttttttttttttttttttgaggcagaatctctgtcgcccaggctggaatgcagtgatgcagcctctgctcactacaacctctgtgtcctgggtttaagtgattctcccgcctcagcctcctgagtag

SEQ ID NO: 68408 - DNA, 3098 bp, Homo sapiens
tatcaacgtttttgggacataagaggctatatagaattcttttcgttctgcagacagttggtaagcttttatgaagtttatgaagaatagaaaggcttatagtcatcctctccttccttctctcttatgaaaatcttttacagtacttcagaagtttctccattctgccttgctaaggctctgacctcttttctttttgctatctttcaattgtatatgcatcagtgcaaggggttagaagaaagcattctgtctcttcatccttacctgtgataatagctctatcccatgtttttcttgagttatgctgactgctaatctatatgtaattatgaggagctgtgtactctcaatcaaatttcttctaagttcttaggtccaaacaggcacaccaagtatttaagagtccagtcatgaaaaggagctagcagagtgggaactgtgaggaccaggggtagctggtggtgctgacttcagcactcctgagtcctggccctccctctgtcccaggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccccgctcatctgccctctctccctccagattggcaggacgaccagtccgacaaccagtccgattactcagtggcttcagaggaaggtgatgaagactttgatgaacgttcagaaggtgagggctgtgctttttttgttgcttttctaaatgttgctttgtttaatatcctacctgtgtcactcattcatctttttcttcttgcagctccccgtaggcccagtcgtaagggcctgcggaatgataaagataagccattgcctcctctgttggcccgtgttggtgggaatattgaagtaagtgccatacgattctaaggaggggtgagtgtcagatattgcatctttggtggaatgcgacctgctgcctctcacctgggtttcttcttcccctaggtacttggttttaatgctcgtcagcgaaaagcctttcttaatgcaattatgcgatatggtatgccacctcaggatgcttttactacccagtggcttgtaagagacctgcgaggcaaatcagagaaagagttcaagtgagttgagggctggagtggactgatctagagcaagggcttctgctatctatctggtcattccatggttctaggcctagccgtgcagggaagtgggctattttctctgttgaagttggcaggtgaagctgttagtaatgtgttcctagcttccctggaagagaacctgggtcttcttgtggggtctagagatcagccttcccgtgcagtggtgggctttacctcaaggtggagccatagttattgcctgtgataatgcctcacgaagggatggaaaagaatctaagagtcagcatgatccctatttaactctttctctacttctttacacagggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggtgagccctgagcctcttgccattgtttctagggggccaggcgcagtggctcacacctgtaatcccagcactttgggaggctgaggcgggtggatcacttgaggtcaggagttagagactagcctggtcaacatggcgaaaccccatctctactaaaaatacaaaaattagctgcacgtggtggcgggcacctgtattcccagctactcagaaggctgaggcaggagaattgcttgaacccgggaggcggagactggaaggccaataggaaaggagcctgtagctggaattgggtcttcaacttcttgtcccattgctacaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctggtaagtctgcctgtcctatcattttctgtccctctctttttgtcctggcctatttttctgctcccctgtgctcagttctaacagggtagtctggcaggacacacagcaattccctctcagtttaggagggccgtcctaagaatagggctggctcttaaaggcacgagaggacaatttaagatgagacaaactgggaagaaatgaccttctctctgatctagtaccttcttcctaattgattgtcttttattgttctgcagaagatgggataaaaatagaggaaaatagcctcaaagaagaagagagcatagaaggagaaaaggaggttaaatctacagcccctgagactgccattgaggtaagagatggggtgactgaatgccatactaaagacaaatgtgtaagtccagtcttccttttagttgctggcctgtctgcttcatctgttttgtttttgtttttttttcctttgaagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtaaaggtatccacattttttttgtttgtttgtttgttttgagacagtgtagtgctgccgccaggctggagtgctgtggcgcgatcttggcttactgcaacctccacctcccaggttcgagcgattctcctgcctcaccctcccgaggagctgggattacagacagacgccatcatgcccagctaatttttgtatttttagtagagacagggtttcaccatgttggccaggctggtctaaatctcctgacctc

SEQ ID NO: 68409 - DNA, 2985 bp, Homo sapiens
gcctggtcaatatagatacttttgataagcactgttcagttattttgtagaatgtctcttaagtttgggtttgtgtgatgttttctcttgattagattagacattctgggcaagaatgccacagaggtgatgatgtgtccttttcttttttttttttttgagacaaagtcttgctctgtcaccaggctggagtgcagtggcctgattttggctgactgcaacctctgcctcccgggttcaagccattctgctgcctcagcctcccgagtagctgggattacaggcacccgccaccacgcccggctaatttttgtactgttagtagagacagggtttcaccatgttggccaggatggtctcgatctcctgaccttgtgaaccacccgcctcagcttcccaaagtgctgggattacaggcgtgagccaccacgcccagtcgatgatgtgtccttttcagttcatcatactgggggacggacatgatgttcatatgtccccttactggtaatgacttgatcactggttaaggtggtgcctgctgagtttctgcagtgtaaagtttctattgttcccattgtgattgataaatagcttgagggagatatttgagactatgtcagtgtcctgtttctccttaaactttcacaccgatattagtattcgtcagtggaccttgattacaatgattattactgtggtgtttgcctaatgaggttttatattctgacattctttcttttttacttctgcctcccgggttcaagctattctcttgcctcagcctcccgagtagctgggattacaggtgcctgccaccacacctggctaattttgtatttttagtaggcagggtttcaccacgttggccagcttagtctcgaactcctgaccacaggtgatctgcccacctcagcctcgcaaagtgttggggttacaggtgtgagtcactgcacctggcctattctgacatttttctataagagttagggtcttgctctgttgcccaggctggagtgcagtagcacagtcagagctcattataaccttgaactcttgggctcaagtgattctcctgcctcagcttcctgagtagctgggactacaggcgtgtgccaccattcccagctaaatttttttttttttttgagatggagtttcttgctctgttgcccaggctaaagtgcagtggtgcaatctctgctcactgcaacctctgcctaccaggttcaagcggttctcctgcctcagtctcctgagtagctgggattacaggtgtataccaccacgcctggctaatttttgtatttttagtagagacagggtttcaccgtgttggccaggctggtctcgaactcctgatgtcaaatgatccacctgtctctgcctcccaaagtgctgagattacaggcatgagccactgcccccggcttaattttttaaactacatttatgaattggaatttaggagacacttctaatggtgtttttggttcttttattagcaccgggtgctcagcagttctgcttcttgctttccactcgagctgggggccttggaatcaatctggccactgctgacacagttattatctatgactctgactggaacccccataatgacattcaggtgagcagaggcagcaggcagccttaataagtaacatgttatgctagaaaggcatagtggcctctatgagggctccaccatctggaattaggtttttaagtgagaaacaacagattctttttgtgttgtttaccttattgtaagccagagtttggttagctgtgatcctattttgggtaacatgataatagagggtggtgtctggaggcaggggtgcaaaaggaagtttcctatgaatgtaggctgtggaccttgccttgtactgaatttagaatattatgtggaagtcaggataagagtggcaccaggaaaatacaatttctggctttatttcctgttcaactccaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggtgaggtagtcaggaacttacgttttggtgtggggcttggcctctctaaaggttagggagaatctttgataccaagggtcttgtgggacttgctttttccactgcagctgctgaaactgactttggggatgtgggcccttgattttttataggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggtgagtatgaatccaaggcaatcctgtgcttggtaattggtctgaaaattggcattgagaccaaggtggtatttgagacaagtggaaaatatctgtaggcaaattcttatgttgatgaattgatcctcttcctttgaaaacaaagctgataacatgactaatcagattttcatctttgccttggttgtcagaaaacttacaaccaaatatcatgctcacaacagttattttggctctttaccagaatgtcattttctcctatgtgttttattaaaccttacaaatgaaattttgaatgctacctcatctctctagagaaaaggcagaagatcctaggtaatctatctctttgtgttttctggtttttatttaagagacagggtctctaccaggtgcagtggctcacatctgtaatcccagcactttgggaggccgaggcaggca

SEQ ID NO: 68410 - DNA, 3151 bp, Homo sapiens
ttcgagaccagcctgaccaacatggcgaaaccccgtctctactaaaaatacaaaattagccggatgtggtggtgcacgcctgtaatcccagctacttgggaggctgaggcaggagaatcgcttgaacccgggaggtggaggttgcagtgagctgagattgcgccattgcactccagcctgggcaacaagagtgaaactccgtctcagaaaaaaagtatataaagacttaatgggagaggtaagacttgtagttatggtgggaccttgggtttttggaaaggagtgggctgggcacttgtatagaggaaggtgagagcaggagcagcagcgcaggtgtgtcagtccttggctcagcttgagggggcagcagggtggtgggtgttcgctggggttgcagtgtgctggggccctcagtcctgactctcctcttttttctcaaagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaaggtatctcaggggagggaagccaccctagagaaagagttgtggcttctggcttagtttacctccttgtgatctggtccctggtgaggcaaaagggtaaccctgggaggaggaaaacattccatcagtctcctggttgtgcttacacagaggaactgactagtagtgaccaagttgccttcatgtgcagaaagaggcatctgtgaaattccatgtgctgctgacatcctatgaattgatcaccattgacatggctattttgggctctattgattgggcctgcctcatcgtggatgaagcccatcggctgaagaacaatcagtctaaggtgagggctgagggagggatgttggagcccccactttgggttttttctagtactaccaattcattaaggggaaaacttgtagatggagaggagaggggaaaattgtctctgccttccttccttgtatgtgacagcccttggtggccaggcctttaaaaagaatgtgaggagtgggatgcttaactattgggcagtgaaaaacttgaaattttgtagagatttgctagagctctgttttcattggatttcacctttctccatctgcttcaccagttcttccgggtattgaatggttactcactccagcacaagctgttgctgactgggacaccattacaaaacaatctggaagagttgtttcatctgctcaactttctcacccccgagaggttccagtaagtatgtgtttatctgtaatcggctcataattgtgcctctcattcttcctgttgcccatttcctgtatcacttttctttcttcctttctccttctccaataacttttttcctttttctttctgaagcaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagtgagttgggagggacagaagcagactccatttagacatctgccagtctgcagagtgtttcctattcctcccccactcagcttcaaggcatctggtgacaggagcaagcaaggcctgaagaaacctgatgctagggcgctggagcgcatagttcttacttattttaggttatacctttccttatttaaaatggtggtggtggtagtgcttgtgcgttaggtgtccttagttccaaagtgggatgtgttggaagaaagatctcagttgttggcactgcattattagtcattgaaaggctctcaagtctaacctgtctttctaccttgcccatgtaggaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggtatgtagtgccatctcctgttcctccctgggttgggtcttctccatgtgggctttcttttaatacttttttctttgcatttgttctcaggaagctcctaagatgcctaatggcatgtatgatggcagtgccctaatcagagcatctgggaaattattgctgctgcagaaaatgctcaagaaccttaaggagggtgggcatcgtgtactcatcttttcccaggtatcatgtggactgggagctttagggaacagtcatagacaacccttagtgacctaaggaaagggattaccatctgactcttccataattaaaccgtgcttcttttgcagatgaccaagatgctagacctgctagaggatttcttggaacatgaaggttataaatacgaacgcatcgatggtggaatcactgggaacatgcggcaagaggccattgaccgcttcaatggtgagagagaaggagttgtttagtttcaggaatcctcatttgcttatatctttggactgtaacttcttgtgcatctccttttctgtgtagttcttttgggactttgtcatttgagatggagtaaagcttttgaatgtctcaattggacgaatgtattggactattcctaggagattttttcttttggggtatttgttctttctgctagaaagaagaaagcattgtatctcgagggcaagcaaagggtcaggacttgttcaagctcaaatagcaagttactagcagacttgtctgcctcagtagacgctactaggtttttttttttttttttttttttttttttgagatggagtcttgctctgtcgcccaggctggagtgcagcggcacgatcttggctcactgcaacctccgcctcccgggttcaagcagttctcctgcctcagcctcccaagtagctgggacaacaggcgtgtgccaccacgcccagctaatttttgtatttttagtagagatgtggtttcaccatgttggccaagatggtctcgatctcctgacctc

SEQ ID NO: 68411 - DNA, 1050 bp, Homo sapiens
tcatcagaaaaaaaaaaaggaggtatattttgaatgattgaagaagtgttgtctggggggaggggccacatagcctagcttttatgcacttacataggaatctggcttaattcaggctcagttcctctgggttttgtttgtacagtgtaatttgagggtgattaaagttaaaaagatgaatctaagagggacataacgattatttacctggtggatcctgactagtagaattattgtattggtagggagtctgtgacgtgcttttcctcagtgatctgtaggatcaaaatcaggtctggttaagccctgtttcctggaggaccctaaactgaacatgaaattgcagtaatcataggggatctcttccctccgaattttccggagctcttccccaagaggatccgtgaagactagtgaggaggaagcagctgctctattaggggaggaggggagttccttgccagctcttgacttctctgtttcatccttcagccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggaggtaaggaaatctggggtggatagttttttgtgtgggtgttttgtgtttgaagccttaacttacactgagtagagagataagggaataaaaaaattggtctctgaccttcaagaacactgtggataatagataaacacatgtacacatgtgtttagtagatagtagataaatgtgatagtggataaacacatgtacacagcggaagatttgagggcatggagccctgggtaggattagcagtggatccatagagtatcagttctaggggaatgattgtgtgttgagggaagtagaattatgagtagaattagtatggaaaggcttggctggacgcagtggctcatacctgtaatcccagcactttgg

SEQ ID NO: 68412 - DNA, 1070 bp, Homo sapiens
caaagtgctgggattataggcgtgagccaccgcgcccggcctgatgcctggctaatttttttttttttttttagtagagacgggtttcgccatgttggcctggctggtcttgagctcctggcctcaagcgatctgcctgcctcagcttcccaaagtgctgggattacaggcgtgagccactgcacccggccaacactctatgttaattattaactgactgaattctggtgtttgagctctaggaaagtataaattagagataatttttggtcagagactggtacagtagaggctctgaaaacgtgtgatctgtggcatacctagaggtctggtgtgaaacaaacggtattgccagtttttgagaggaagtgaggagggttgccttttctggctctgagggttttctctcctggacttgcagtgtggacaagaagggccacgtccactacttgatcaagtggcgggacttaccttacgatcaggcttcttgggagagtgaggatgtggagatccaggattacgacctgttcaagcagagctattggaatcacaggtgagtgattttgggtgaggcatagagttgtttctttttttttttttttgagatggagtcttgctctgtcaccaagctgtagtgcagtggcgtgatcttgactcactgcaacctccgacttcctggttcaaacgattctcctgccttagcctcctgagtagctgggattatttgcatacgccaccacacctagctgattttttttttttttttttttgagacgaagtcttgctcttgtcccccaggctggagtgcaatggtgcgatcttggctcgctgcagcctccgcctcctgggttcaagcaattctcctgcctcagtctcccgagtagctgagattacaggcgtctgccaccatgcccagctaatttttgtatttttagtagagacggggtttcaccatgttgaccaggctggtctcgatctcctgacctcaggtgatccgcccgtctcagcctcccaaagtgctggcctcccaaaatgctgggattacaggtgtgagccactgtgcctggcca

SEQ ID NO: 68413 - DNA, 1101 bp, Homo sapiens
ggatttcaggcatgagccactgctccaggtctgaaatgagatctgaatcgtcctttgatgaagttgagactgtgggctgtcccttctcctcccatggttatgatttgagattaagttgtctctttttctctcagtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcaggtaagtttaggatagtctggagatgtaggggctacgatgaagaggatagtgacaaaagagccttgtggatagaaggaatgaacacagcttcttggtggctgattttctctttccgctcaaagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacaggtaccagctgagcacacgggagacgggcagtctccgtgggagagtcctgctaaagagattgggaaaatggctgtcaccagtaacttagacttggaagacactggttttttttgtttgttttttgtttttgagacagagtctcactctgtgcccaggctggagtgcagtggcgtgatctcggctcactgcaacctctgcctcccagattcaagtgattatcctgcctcagcctcctgagaagctgggactacaggcgcaagccaccatgcccagctaattttttgtatttttagtagagacagggttttcattctgctggccaggctggtcttgaactcctgacctcaggtgatctgcctgccttggcctccctaagtgctaggattaacaggcgtgagccaccacgctcagccttatatatttattttgagacaa

SEQ ID NO: 68414 - DNA, 2388 bp, Homo sapiens
cctgaggtcagcatgtgtgtagcatgtgtgtgtctgtctccctcttccccccttgccctgctccagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggtgcctggacctccatcctcttctttgtactgttaaacttttgtctttttgtttcctagacaccttactgccctttagaacactttctcttcttttcctcttaactctgttactctgatttttccacacaaatttgcttagcaagtgtgggcactaggtggcaggtacttacttgactttgctctttctgcaggagcctaaatcatctgctcagctcctggaagactggggcatggaagacattgaccacgtgttctcagaggaggattatcgaaccctcaccaactacaaggccttcagccagtttgtcaggtaaaacagaaggggtttggggaagggggaggagaatctttctgttctctcttcttacttctctttctttttttattcttaaacctttccctctgctcttgtgcatttctccaccagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtgaaatggggttcaaatgggagtgggggtgtctagtgtgggcttaagatgtcaaagacagcatgggaatgctggtctgtcagccctaaggtaggagataggagggaggaatgagtcttggattttggagggaaatttgggaatctgaatgtggggaagcaagcttaggtggagaagattttattttccccatctttggtcttgtggtatatatttggatatatcctgattttaggtcccaatgctcggaggaagcccaagggcagccctcgtgtacctgatgccaagaagcctaaacccaagaaagtagctcccctgaaaatcaagctgggaggttttggttccaagcgtaagagatcctcggtgagagcccagcccatcgctttagggagggtgccatgtctaatagaaaggatgtgaccttctatcagaacctgtccttcatagtaggcacgtaagaatgtggggcgtttcccacagaacaagatgagactaggctccctgtataacggtgcttgctgggattctggtgtccccagtgagagagtactcccctctctgccactctgtccttccccttggcttgaacgtctaaccttattctttttcatcctgccagagtgaggatgatgacttagatgtggaatctgacttcgatgatgccagtatcaatagctattctgtttctgatggttccaccagccgtagtagccgcagccgcaagaaactccgaaccactaaaaagaaaaagaaaggtgtgtttctcttctgtatatttgtgatgggatgaggtgggagtgattggggaagaatctccctaaggagataggggtcggggggtggggggaggtagtttttttccaataactgggctttccctcttccttgcccaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgtgagtgtctggccattgtggccccttggaacccatgagaagaagggtgggacagtaaagctcttcggggcctggatggaaatggaaatgctggtgctgcgggttgtgagctttgggaagcattcaaaggaatgatgggcactggcttcagactgcggtgggcgggtgggggtaataatctgaatctgtggtcctttactgcaggagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgt

SEQ ID NO: 68415 - DNA, 1581 bp, Homo sapiens
ccctccccgggcgcagggaggcgcccccccacccccaagtgaccttgtgtccccgagcgcctcgccgcctgcggcctcccctggcccccccgcgccgctgccactcggaccccctcccccgtcacaccccgctcggtccagccccgcgtctcccctccccgcgcttgcaccagcctgccctcggaggcgtcgctccctcgctccgtgggggcgcctgccggggagccggcttccgggctgcccccgaggagtgtggaactaagttcagcctgagcggttcgggtgccctgctagggtggctggggtggggggcggaaagagcgggtgggtgtgggggagggggacagtgcgcgtcactgactgttctgtgtttctcccccctcccccgcacagtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccaggtaacatcttccccaagggcccatggcgggaaggagacatctggggctctcccgagtgactcctctggtgaggcagggctgtgttgctccgctgtctctgtgcagagccggaggtggagggtatccgaagggagtggttcccttctgcggagctctggtgtgaggggggtggaagccatgtgcctcctgggcacggagatgccagcttgctgcactctgtcttgaggaatgctctgcagttcccagttgagggagctctctgggctggcaggcattacctggtatgtgggtcctcggaggaatgcaggtagctgggacccctggaggcttgtggtggtggtggtggaggggggcgttgaggattctgtttgaaagaccagccgggcatctgtgctagtaggatcctgtggttgctgctgtggaaaggaaagagggagtgctggttacactctatctgattatttttagcttctgatcggttaccggttttctgtgctgtctgaactgtgtgaagtttgaatcgcgctcctcagcaggatctggagtgcttaaagcagccaggcagattgctggaatgttttgagtggggaagtgatgggggctcggggaggatgtaatagcctagtgaagaggggcaaaagaagggagggcactcctcctcctggtgagtggacatagttttggcttttttcctagtggcttctgtctctatgaggtagcctgcggtttaggctggcagtgtgaagtgtctgtgtaggtgtgctaggggttacgctatctgtgttttggggtggcttcatgaactggccaaacccgtatggttgtaaccaccctgtctgattgggggaactgttgtctatcctcaaatgatggttgatgtcatgcccctaagcagatgtctttctcttctgtgtcctttttcagagcccctagctgtgtcacctactcatctccttgaccttcatgttttctagtttaatttttttttctacatgtcatttcttcattcc

SEQ ID NO: 68416 - DNA, 1413 bp, Homo sapiens
agtgttccattgagtggttccattttgcctgtgtggggctgacaaccaagcctcgggggaaatggtaagtggcaggagttggagggtccctaagttgagtggtcaagggcattctccctttcactcacttttctctccccttctctgtttcaggttttgcccacgctgctcccaagaacggaagaagaaatagataagggccttggattccaacacagtttcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcaatgtgagaggatggcatgccagaattaggacacgacatgaaaccagagtggtgcctctgtccgagaacttgtaagttctcaacttgggaaagacagaggtgctggagggtaggcctcagaccagggggtctccaaaactttgtaaatcatgcatcttttctccataaaacatctttcacttaatttccaataaatgatgtatttgtgctatacatacgtactgctatactatacattagcttgacttctttttttttttcctttgaggcgaagtctcactctgttgccaggctggagtgcagtggcgtgatcttggctcactgcagtctccgcctccgggttcaagtgattctcctgcctcagtcttacaagtagctgggactacaggcacatgctaccacgcccagctaattttgtatttttagtagagacagggtttcaccgtgttggccaggatggtctccatctcttgacctcatgatctgcctgccttggcctcccaaagtgctgggattacaggcgtgagccacagcaccca

SEQ ID NO: 68417 - DNA, 1028 bp, Homo sapiens
agtgagaccctgtgtcaaaaagaaaaaatactaataattttgaaatgtatgatattgatgtacagacttggaaaccagcaacagcagatgactcagcctgatttgcggcagacaactgctgtgggatgtttttgagaaggaaacaatggcttttgagacaaaattcaagaagcagcaagcccttcaaagaagcatcttcaaacatggacaaaaatacacttcatattaatgtggtgtgcaaaggatcccttgctgtgtttcagtaatttaaattccaactatgatagcaatgttttcagcaccttgaaaggacctttaaagcaaatattgtcagtatgttccattacttgagtgcatggcacagtacctctgaacattcagtactttttagttggaaggttatgctaatcaatggaaaaggtccaaagaacaaaaggaagaaatgtgtttcacctagccactcaggggccattgtgaccaggcctctgtctctgttgtagacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtatggccctgttcatggctccccacctacttcccatctaatcctcagggtcttagacccctccttcaactgtgttgggatctgtttggggtctgtgagatccataaactctgccttaacctattttctttaattggagatagttttgtacctctcctttctccttcctttccacccaggtggacaaacacattcggcggctggacacagacctggcccgttttgaggctgatctcaaggagaaacagattgagtcaagtgactatgacagctcttccagcaaaggcaaaaagagtgaggagggggcggggctgtgagaggtggggcgaggactgaaagggagaagaagtcagctcttcat

SEQ ID NO: 68418 - DNA, 1124 bp, Homo sapiens
atctcctgacctcgtgatctgctctcctcggcctcccaaagtgctgggattacaggtgtgagccaccatgcctggccatttgtttgtttttgagacagggacttgctctattgcccaggctggagtgcagtggctcaatcacggctcactgcaacctctgcctcctggattcaagtgattctcatgcctcagcctcccaagtagctgggattagagatgcccaccgtcacactaggctaattttcatatttttaatagagatggaggtctcgccatgttggccaggctggtcttgaactcctggccttgagtgatccacccccttggcctcccaaagtgctgggattgcaggcgtgagccaccatgtccggcctgaactgcactttaaaaggagctgtaaggcctatgcatagtcagtcctgtgattgtttctctctcttccctaggtattgaaaaccttccctttgaattacagagaaactttcagctcatgagggacctagaccaaagaacagagggtatgtatagagtaaaaagtttttgtatctaatgagtgtgtgtaatcatttatttttctacttgatgttaccgtatcatctggtatgatctggagaactgtggcttctctcgctccttttttacgctcttggaattcttaaaacaggataatgatcctcatttctgtgtcagctttttcataacaaatagagtattgtgaaaacgcctcaagaattcaaagatgctgtgttctttatgtcttcctggagaataattagccaggctggctcacacctgtaatcccagcactttgggaggcctaggcgggcaggtaacttgaggccaggagtttgagatcagcctggccacatggtgaaaccccatctctactaaaaatacaaaaactagccaggtgtggtggcacgcaccagtaatcccagctacttgggaggctgagacgtgagaatcgtttgaacctgggaggtggaggttgtagtgagcccaaatcatgccacatgtcactgcactccagcctaggcaacagagcaagactctgtctcaaaaaaaaaaaaaaagaagaattaaagaaagtcaactcgagtcatttctgctctccacgtttgata

SEQ ID NO: 68419 - DNA, 1101 bp, Homo sapiens
aggagtagagaacaaaagaaaacacgtactaaatgttcagagagaatcagcaaacagaaaatgaaaacgcttatgcttcataaagatgcccagtgtttatcccgtgaatctggagtgactaggaagaagggaacctgccaactagaagtgatgatctttggtgctatctcaagttgaactggagtccagacttacaggccatagaccgtctcacccggcttcttgtggatgtgatgatctcaccttaaagtgatcagacatcttgctttgagaagaggaggagtcaggctttcctcacaaataagagacacgtcctgtgatgtttttgagattttataccagaggtcccgaaaagcacctggtcatagagatggttctgaagtcgctgatgaggagcaggtgtcactgcaccctcaagtccttggctcatcttagcagagggccctgtggtgttggggagagaggtcacattggtactaaactaggcatttcctgtcattagggggctgggctgcaaaaagcacttagttttcatgagtttccattaatatcactactactctccacaatcagtgtaactgcttttctttgttaccataacattctctggaagtgatgctcaaggctgaggggactgtttctggccataaggtggggccaaggaagacgcgttctgcttttctttttccttgccattgtgtttatcttgtgttcttgaatgttcgttaggacagttactgtaggagctgacttgaatgccaaattgtgggctgcctgttccttgggtgccaagtcctcagtctctcctcccccagcagagaggagcctcagcttgagctgagtgatgcaggcattgaccagaagcaaatcatcagtacctgatccacatcagagaggaaggctggtgcctcttggaggcccatctgatgtgcctccttaggagagcaggatgggcctggagaagatttgttgagccagttcctaaatggtcttgctgacattctttcccttttttctcttatcctgtgcagaatccacactggtgatagaccatacaaatgtgcacacccaggctgtgagaaagccttcacacaactctcc

SEQ ID NO: 68420 - DNA, 1035 bp, Homo sapiens
aatttttgtggtttctctctgtgtctgtgtttggaaatcttctgcagagcaggcctgcttttactatatgcttcagttcagagccaaggtgtgcattcaacttcaggtccatggggaacaggcggtattggtctttgttcagattactatttggaagcagggtgtctgtggtgagtgtgttaaccttaggagaaagcggagggttgatgagattgactactttaaggttaccaggagccatgggttgcagctcttcatcatctcactgccattctagccaccgacttacgatcagcaacaacctagatctgggtgtcctcttcatttgcctatccaggctggagtgtttttgggaggagggaggaagggggtgctctcatccgtcaagcaacgtcatttcacccagcagagagctgagcccctggtgtcgaactgcttcctcctccccccttccctcctctcctctccggcaggatccactccaagatgcacacggagaccatcaagccccacaagtgcccgcactgctccaagaccttcgccaacacctcctacctggcccagcacctccgtatccactcgggggccaagccctacaactgttcctactgccagaaggccttccgccagctctcccacctccagcagcacacacggtaagggagagtggcgggctactgaccccgccccgctggcatgccctccccacccccgccccggacacacacaacaacccgcatgcggggggcgggggagagacctggctggaggagagacctggctggcatctgggagaaggaagaccaaacaacactggagattcaagtggacacagagcttctctggggcaagagctacgtcggggagctgcagtgactatatgatattcactgatccatgggagacagacacgtacctggagtagaaacaacttttctctaattttcctccctgaaaatactcatgtacccatcttggaagatttgccccttgatgccaaaacagaggcatttgagtggagaagaccatacctct

SEQ ID NO: 68421 - DNA, 1341 bp, Homo sapiens
tgccttttctaccagctcccattttacactggtgaattgtttacgaaaatgaaagatagcttttactcagtaaagtctgaatagttgtggcttaacttgctcagaggcctccttattgatatttggtggacaataccagagtggaaaggattaccagcttgggatgagtgaaagtacgatcaggtgctactgatgtcaacccagagtgctgacactggctccatgtgctagggaagaggaaaggtttagcgtggaagataggtgttttgtaatcatttttctcccaaatgcttgagggatggcaccttcccctagcagctacgttggtcattgcaaaagtggttttcacttgattgtcaaggggctgtgggcaaggggtgggtagatgatggatgcaacatcagataagagggtggagagcagacatacctggtttgaaaaagcccctccaaataattctgatacttcctcacccccatccctctaggaatcgctgccaaaaaggaagtaggggaaaatctgagggaagaaaattatctatggagacaggagaggatccagttagttgttcctcattatcatctcggggtcttgaggaatacagaggcatgtgcttcatacataggaacatcagagcaaggaattccttaaatgtttgaaatcaagctgtaagcagaaggcaaacaagttaactgatattcctggcccattgaaattcgcatctgcccagagttcatactgtttctgttttatctggttgaaatacatttttgcacatggaggcagtccagtcattcagcaaacatttattgaatatttataatgtgctgggcaccatgttagaagcttaggccataaagatgaatatatagagctctactctcaagttggagtaggagagacctcagataggtgggcttctcttggaagtagaggggagggttcagccacaccttcttgatgggaagggttctaaccattgccctcacttggctcaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccggtaaggctgctcttggtttaccccaccacctggccgtgaaccctaagaccatgttgcctgcacctactcctctctccacatgtattattctttccctttcacctttgcccattggtag

SEQ ID NO: 68422 - DNA, 1254 bp, Homo sapiens
ctagcaatgtgctaggcattgtgggggatacaaagaagtagaagatgcggtccctgcctttgaggaggtgacattctttccttctctgaatcaaggagtctcctgttctcagaggtggagaagagaagggagtcaatcaaggggtaaatctcactgttaccaggggggtggggacaagggttaggagaccattatttttctacagggtttgggatttcctgtgtactctgggttgggtcggcgggggggtgaggggttaattagacaatgatctgggggaaatgaaataggattaggatcaggactgaacaacatgacgccatctcctttttctcccaatcctaggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtaagactcagagccaggggcaggatggggcgaggatccctggcttggtgattctccctgtaccctcattgtgttctgccccggtcaggcgctacactctgacagcttcccagctctgagccacttgcatgtcaggtgtcccatcataggataggaggcagagctgctagcatcgtgttaggatgcaaagacccatttcaccctttcctttttttaacccttgttttgggggtcgttaacactgactaattttttagtaacagagtagaatttctctcttgtaataaggctttatgctgggtttgagactcttggctgcagctcctttttgctttctacatattccattcctatttttctaagaaacctttctagtaagcacctaacctatgtgccatccaccagttcctgggtcgcatttgaacactgagcctgccttaccctgcatggttgggatgatgggaggggccttcataagaaggtaggaggaataggatgcctccccctttggaatatgtacttaaagaatgactttgctcactttctaatttatgaaagtcattttgattctccac

SEQ ID NO: 68423 - DNA, 1050 bp, Homo sapiens
taggattgggagaaaaaggagatggcgtcatgttgttcagtcctgatcctaatcctatttcatttcccccagatcattgtctaattaacccctcacccccccgccgacccaacccagagtacacaggaaatcccaaaccctgtagaaaaataatggtctcctaacccttgtccccacccccctggtaacagtgagatttaccccttgattgactcccttctcttctccacctctgagaacaggagactccttgattcagagaaggaaagaatgtcacctcctcaaaggcagggaccgcatcttctacttctttgtatcccccacaatgcctagcacattgctaggcacacagtaggcacttaataaaaatttgattgaataatcaaacacatatcccactccccatgtccttggagccctccagcctggggtactgatcatggaagatcaacacctcagattggagaagagcagagttgctcaccagcagtcatcagtcctgtagacggcacagggaccaccgtgatattctgggtaacggacgcttggctgtgtggggtcagctggtctgacttggactctgtgtccatactgatgcctgagggcagggacactgaggcaggcactgtcagcaaggtggggtagtgaggtggggccagaccacagcccttctctggcaacagctgatccttcatcttgttgatgaacattgtgttctcgatctaagagaaaaggaaggggacgggagcaccctcttcagcctgagaggctgattctgcttgctcgtgagcacacttcagtgtctgtcctccttagggatcaaggatgagcacttcatacctctggccttctagagagaagcccaggcagaaacactagataattctcaggggtgggggacccagtaaaacagcatgtggtgtaccttcagtctccatagtaacagaacttactactgagacttggagagagcaagaaagcaacaccacttacctgacctgagactgtggggatagaaggccagaagtacgggttagaattgaagtgaga

SEQ ID NO: 68424 - DNA, 1052 bp, Homo sapiens
ctgcagtgagctatgattgtgccactgcagtgtagcctgggtgacagagtaagaccctgtctcaaaaacagaaaaactaaaatttctatttcaaggaatatagttttgaagaataagagaaagaggagtcatgctaggtactggcacctggccgttttcaagtcagtcagtgatttgttttttgtgaccttagctacatcatctcccctctcgtgagctcagtttctttttgccagcaaaggaaagtaataccagtttttctttagggggcatgaataacattgtgtgagtaaatgtgatacgtataagttctttcacagtcatgaagtaggatagcctctgttggatggggatacagtgacaaggggctctgaccaagggactaatgtgctagacactaagtcttgactgccagtccccagccatgtgatcaggtgccagaggagaccaggaactcttcagttccccttctccattgcttagctttttctgagtaattcctgagtgtgacatgttctctcattttttcttcaggtagaatggaagaatctcacttcaattctaacccgtacttctggccttctatccccacagtctcaggtcaggtaagtggtgttgctttcttgctctctccaagtctcagtagtaagttctgttactatggagactgaaggtacaccacatgctgttttactgggtcccccacccctgagaattatctagtgtttctgcctgggcttctctctagaaggccagaggtatgaagtgctcatccttgatccctaaggaggacagacactgaagtgtgctcacgagcaagcagaatcagcctctcaggctgaagagggtgctcccgtccccttccttttctcttagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagcca

SEQ ID NO: 68425 - DNA, 1680 bp, Homo sapiens
cgtcccaaggaagggtctttgagaaaggggtaggggacgacatcaggagaaggctcccaggaactgtctcaggggagcgaaggttttgaggggacagctggggtctccagtagatagaccacggtgcaggctgagggaggtacttcttggcacaaggcctcgggtaggcagggggcgaagtcctcgaagaagtggggggaaggctagaggaagtggctgggcctgaactggcactgtgcctgccacaaggtcttgtgcatcccccagccctcagctttgccttctgaagccactcctcaggggcacagaccctcctcctcctccatctctaatgttctctgacccctggttacctgtggcctgggaacgaacaaggaccagtctctgagcctaggagtgaaacccaaacgctggtgatagaattcgtcttagtttctgggaattggatttatttctcttgtatccacgtagagggtagcactagactgctgttattatatccacccgtctttggattgctggctggggggtctgcctgccttccagactgactgctgacaaataattcctgaggttctccacagttctctggtggctgcaccctgcctggcccctgtaacctagacaatttgtttacagaaagttcaggagccctggaaaggagaaggaataagacggcaggaggaagagagagagagggtaagatgatttttgggttaatggcttttctggttttgggggagaaggggtcacaaccaaatggggcgtgtgtgtgtttcacaatgtgatagaatacttaaagtaatagcaattgtaatgctgagattgttgtggagagaaatcagtttttttctattatctcttgagggtcaggaagtttttgtgtaaaaagttggcgctatcccccatcactttccattcctactaatgctcatcaggaatgaaatatgaaatgctcaggtgaagccactgaatagtgttgccttgtgtccaaaggggaaatctttattctgctttgggacacaaagaccctaaatgccaatatagtccttatggaattgctttcctgtgtctggaacaagcagagctgagtttagaatggagttcctatcccaaatagtccagtggagtgttagaagtgggtctgtggagtgattagaatctgtgacacagggttatttgaatttggtatggcaagatgaaattttcaggggaaaaaaaaaactgcttcatggttagtctggagtgaagtggataaaactgtacggagtagactccagaagtaggtctggaagagtttcgggtagcctgaaaatgacagtgagtggacctaaagagtttgagttcagaacttatgatcccagaggttggtttataaaatgccctgtgggtttctgagccaagttgttgattaaatattgggtacatatctcttcttctccagtcttatttatttattttggcctcacattccccagatccatcatttatagtggaacagacagggcaaggagaaccaccgtgccgtccctcccacaggatgcagggtaaagtggtccggtggtgcccaggctagaagctgttggcccaggttgccagctgtgtggtggtagcagtcctgtttagtttgtttgtgtatggtgtgatgatgtttcccagtaacattggggtgcatttgtt

SEQ ID NO: 68426 - DNA, 1124 bp, Homo sapiens
caccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagatactcgagtcccctggttctgccttctgacccccgtagagaggaggagaggggtgggcagctaggaggaggcacaggatgaggtggggaccccctctagacctaagtcacctgccctcctctgacctggagctgggggccaact

SEQ ID NO: 68427 - DNA, 1022 bp, Homo sapiens
cgctccagcgccctgccgcgggccaaacctccccaccatgccccgcaccccgcccgctcctgcgaccccccagccccgctcagtcccgagcgcccgcagtcgtcgcgccgccgcgccaagcatgcaggtgagtgagagggacccccacgcccccacccgcggggagcccggccctgcccttcccggctccgcgccctgcgcctcctgcccctcccgacgcggtccctcgcccgggacaaggcctccagcctcccagcgccccttccccgaagggctctccatccctccgcggtcctggctcgctcccgccctccctggcgcagccgtccccgtccccgcggctgcctccatcccgcctcggctcggcgggcggctccgcgcagtctcctgcttcgggtccccagtccgctctcggcactccctgcctcggggtcccttcgccgacctccttttcctcgtctccccccactctcgccgctctccagccctgtgcggggagtgcgggcctgcgggatgggtgggatgggggccacgctggggctggggcccggctcccgcaccccgaggctcctgccccacccccagctcgtctcctgcgcacaacaggtcggtgagaagctgggagaggggtgggggtggcgcgccagcccggggactgcgggcttcctggagggggcggctgaagctgtgcggggcccagggactgggttggcgctggctgggggtggggatgcacaggcggaggggcgatagtcctagagtcagctggccacagatgcgccctgggagcccttctccgcttcactggttcgctctacacgcctcgctccctccctctagctttcttcctttcccctctctctcccttcttcccaccatgcccccatccctatgtctttcggtatctccacatccctttacatttgggggagcaattccgaactcctccatctttgctgctcccgcctctgcttcccagcccgttcctcgtgtcatttttccttaagcatttatgttctctc

SEQ ID NO: 68428 - DNA, 1048 bp, Homo sapiens
agttaatagctggcgctcttccactaataaagttttattgaaataaagcatttaaaaaggcgcccgtcattcttcccccagcgaccaatcgaagagtagaatgcctgcgtccctcactggagcttcagcggtcggaacgcgggggtggggcatgtcctgccgaaatttgcgtccttagagcggaagtacggccggaagcccgccatagagtttagtggccagagcgactcttcagggaggtggcaggaaaggcttggaacagctgccggaggtgacggagcggcggccccgcccggtgcgctggaggtcgaagcttccaggtagcggcccgcagagcctgacccagggtacgacgaagcagtcggcgggagcccacggtcgctgggcggtgtctttaagggagggggcggagccacgtgtaagcttcaatgggggtgaggtcacgtggttgtgggcgcgtgcggggcagcaatggagagctgagggagcgtcgtcagggtggacaccatgcgacacccatttctcctttgcatcctgtgtcttggggttcaatggggtgcacgtgatggggcttggggttaggcccaggggagggggtgggtgtggcagccttgcgaagtggctgactttaggattcctagatcagaattttagaccgctccatgtctgattcctcaccgcagaaccgacttagtgcctttacaatccagtccctcagccttgtgcttcccatccgaccagccatcggggacctctagcttcacatcctctttccttgcagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagaggtgggttgctggcttgaatagccctcagagaagcgtgggcaaaggtttgaatttgagaatgg

SEQ ID NO: 68429 - DNA, 2012 bp, Homo sapiens
tcgatctcctgacctcgtgatccgcccgccttgacctcccaaggtgctgggattacaggcttgagccaccgcacctagccaactttctcttttaaaaatggagacaatactgcccctctctgttgtgggaataaagtgagattatgggaaagtgtgaagtctggtacaagtggagagtgaacatgttaaattagcatgcccttttcttccctatgtgcagcatatgctaatctattcaagttagctaagggagaacgtgtctttttcccagagacacatggcaaactgctaggaacacagcagagagaaccgttcacacaaaagtggcagagttaatttacaatcagaggaggcagcctgagtcctgacatgctgacagtggtatgtgggtaaactgagctaagttatttggggcctgtggtttaaccttttggatcactctgtgatatggagaaaactggctgacttttccctgctttcatctgcagtggaactaaagagtatcaatcaaagtgatgaaaaagaagcacttggctgggtgcggtggctcatgcctgtaatcccagcactttggaaggccaaggcaggtggatcacctgagggcaggaggtgaaaccgatatggcagaatcctgtctctgttaaaaatacaaacagggctgggcacggtggctcatgcctgtaatcccagcactttgggaggctgaggtgggcggatcatgaggtcaggagatggagaccatcctggctaacatggtgaaaccccgtctctactaaaaatacaaaaaattagccgggtgtggtggcgggcgcctgtagtcccagctgcttggaagggtgaggctgaggttgcagtgagttgagttcgagccactgcattccagtctgggcgacagagcgagactccatctcaaaaaacaagacaaaaacgaaaaacagggccagtcatggtggctcatgcctctcatgcctgttctcagcactttgggaggccgaggtgggtggatcatgaggtcaggagttcaagaccagcctggccaagatggcaaaaccccgtctctgctaaaaatacaaaaattagccgggcgcggtggcaggcgcctgtaatcccagctactcgggaggctgaggcaggagaatcacttgaacctgggaggcaggaggttgcagtgagccgagattgcaccactgcattccagcctgggcaacagagtgagactctgtctcaaaaaaaaaaataaataaataaataaaacaaacaaaagctcatgtatcccagaacttaaagtataatttaaaaaaaaaaaaaagggaggcggaggttgcagtgagccgaggtcgcgccactgcactccagcctgggtgacagtgtgagacaccatctcaaagaaaaagaaaaagaagcacttattaagtggctctttactacccttcttatggtctgggaatacaagaaaagcaccaggcatggagcttacccttctgaagcttgcattccagttgaagagagaagatgaatggatagaaatctgaattatttatttatttagcaagtatttcttgcgaggcaattactgcatagctctgtgggatacctgagactgggtctataatcttgttgaaagatattcttaggtagcaaccttctgcaaggattgattgattaagtgccagaatgaagctgagcacagtggctcacgcctataatcccagcactttgggaggccaaggcaggtggatcacctgaggtcaggagttcgagaccagcctggccaatgtggcgaaaccctgtttctactaaaaatacaaaaattagcctggtgtggtggtgcacgcctgtaatcccacctgcttgggaggctgaggcaggagaattgcctgaacctgggaggcggaggttgcagtgagccaagatcgcgccactgcactccagcctgggtaacagagggagactctgtctcaaaaaaaaaaaaaaaaaaaagtgccagaatgagtgatccatgataggaggag

SEQ ID NO: 68430 - DNA, 2135 bp, Homo sapiens
ggtgaattggggagtactggagactgtctagacatattccaatttagaaacatcaaacactctgagggcaggcaacacaatttgcagtgtctggtgtgtatgtctgtttgactctgaaaactgaatgtcttcaactctgaatttagggtaggaattggatgacgtatggagcaagagggcattgtggtttgggagaatagtgtaaacaaaagcctgaaggtggaaatgagcccttcctatgtgaagagtgatcagagaggcagagaactccttttggtgagccaggagagttaacattggccgggaaagatggggccaaaaagtggagttccaaacagggtaaggctgggagggtggagagggaagacttcccgtcacctcctttttcctcattctcgcagctggctgagagtgactttgcctctaccttccggctgctcacagtgtttgcttatgggacatacgctgactacttaggtaaccagaggggttggtgctctggagtaatggagatgggagaagggcaatttctggagggactcagaagaaattcctgggatatcccacttagatccctggatgcatagggtcagggtcaagacctgaattggcattgaaagtgggagggaagggaaggaggctagggcttcccagaaaactgaaatcaggattccttacactttgtcgtttttccctagctgaagcccggaatcttcctccactaacagaggctcagaagaataagcttcgacacctctcagttgtcaccctggctgctaaagtaaaggtgagtggcagtcccccagtcctacggtctagagcatccttttgtatgtccttgggagtccacactaggacagcccttgtctagaccgtggctgcttcctgccctcccctcctccaaggtctgtatataaactccattagcaactgtttaggctgatagtattcttagttttctgtgttgtttttattttttaatcaacttaagttctaaataaacatcttctgtggttttggtcaaaatagcaactaggatgttgttcaggtgtcgttcaacaataccttcttccccactgctggaaacagggctctcctgatgaagtgctaggcttctctttgttaggataaaacatatatattctagaagtatctctgtattcctgttaggctgttttttgtctaatatcaccacccacctccccagcctgcccagtctgcaacctcgcaatagttacttgactctcagttgtccttgggatttaatttaaaccaggctctctattgagagatacctccaaaggaatgcccgttgcaggtaggcagagtataaatgataaacagtaactccacacctctcccacttctgcttactcccctgtatcaagctgatcttgactaaggactgggtgataccctgagctgtggctaaaggagtgacacccaggcagatgtcattttctccttctgtggtgtgtcaggggtgagggtgttaggggagcattttgtattttatttaagattgtccttctaatgatgctgtttttgaagtgggaatacttttatttattttgctttagaaccagcctcttagaggaagtgatttaggaatgggagtggagggcaggtgggctagggcagggggaaaaggagggaagatttttggaagcccttctctactacggagcgtcacaaatcctggcctgatctccgcggccccagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgagaaccgtatcctggcactgtccccttctcaccctgagaaagagaaaggcgcttcagggtgagagagggcaggagctgggctggtccgcagaggtggaacccaagaggatgaagggaaatgagttcatccctccaaaggcttctggggaatgcaggagtaggggaggccctgggaggcggcagaagtcagtgtccttgatatagtag

SEQ ID NO: 68431 - DNA, 1082 bp, Homo sapiens
cctttcatcctggtaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggtgagccagggtagcaggaactgctcacttgcagggtgccctgcttttaccccagggacctcactgtcctcatttccttcagttatttgcatgggagtagggagtgggggagcctccaggggttaggggattccctgcattctctctctctctctctttctctctcttctccttgccaggctccgagggagcgccaagatttggtccaagtcgaattgaaaggactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggaggcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggt

SEQ ID NO: 68432 - DNA, 1030 bp, Homo sapiens
gtggaggcggactttcaccattttggccaatctgttcttgaactcctgacctcgtgatccacccgcctcggcctcccaaagtgctgggattataggcaagagtcactacactgggccggcaaactttttctgtaaagggccagatacaataaatatgatgagctttgtcagccatacaatgtgtgttgcaacacccaaatctgatgctgtagtgcaaaagcaaccatacatgatatgcaatgaatgaggtgtaactacagtccaacaaaactgtatttacaaaaacaggcagtgggctggatttggcctgtggaatatggtttactaacccttactatggggattacaaaatacatacttttcacaatcagagtttttttctaccacttcaagttaaatgtagaaattttaccacaacatagctccctttactgtctcatctcgtagttctcatatgtgttactataaatgacaaacaccacatactacaaatactgaaactccacatactaaacgctaaaaatgcttagttctaggtgaatttatctattgatttttaatttttgagacagggtttcactcctgttgcccagactagaatgcaatggcacaatcttggctcactgcaacctctacctcccaggctcaagcaattctcctgccttagcctcccaagtagctgggactacaggcacaggccaccatgccccactaattttttttgtattttttatagcggcgaagtttcaccatgttgcctaggctagtctagaactcctaggctgaagagatctgcccatctcagcctcccaaagtgctgagattataggtgtgagtcaccacacctagccttctaggtgaatttatttatttcttgagacggagtttcactcttcttgcccaggctggagtgcaatggcgcgatctcagctcactgcaacctctacctccaggttcaaacagttctcctgcctcagcctcccaagtagctgggattacaggcatgcaccaccacgcccggctaattttt

SEQ ID NO: 68433 - DNA, 1674 bp, Homo sapiens
ctccctggacctgagttatgtggggcccttctagccacaaaatatcaggcccagcctctcaacccggattttagttccagtgcccacacgcgcatgtgtagtcttgagtgtgactgcggcagagtaaggctgccctgacctcagtccaggtgagtcagtccagtgtttcagggactcccctgttcaggtcccagcctttagacatgtgaactgatttgtactcctgctccctgctgtagggtttggaccacccttcagcccagcacttactcctggggcctgtgactagttctcagcagggatatgttgtgggaagtgaggtgttagcatcagtagagtgagatgctcaagaaccagccccctagcacgtcctgacctgtctgccactggggtaagggccacgggagaggaagaggaaaggaactttcccgagggacacagatactctacttccggtcagctctccatctgggcccagcctcacacaacagccacccctcagccaccggcccagcgagtatccagaggacatgggcaaacgcctcaggttattttctccaccccagaacattacaggttggaagaggctgacactaggtgtgtgactaagcagaataacacagaggagggagacaggatgcacacgcacaagcaagacctggctccaccactcagctgcactgtgggaaagacttcctctctcgcaacatcagttccccattttgtaaaatgaacctttctaggcactggtgactatggagtcatacctcagaactgagacctgagtgagtgcagagagtctgacatgcacatgggatacaaatgaccattccatgctagtatttctccctgatcactctctccctgccttgctccttcagggttctctggtggtccctcatcccccactccatcctcaggacccctaaaatacttccagacacgatctggatctcatcctactgatcttgaacagctcccagccgttcaccctcccagctcctggctgtcatctttcactctctccagaccttagccccacaggtcagcaaagagaaacaaatgtctgaggccactctccccctgccctgtttgtggtttgggatttttccccctttctattgtaatggcctcaggccctagtaataataccctttttcctccaccctctacctcatgtccaagtcacatgaacaggtgacccagagaaccagaagctggcccacagaacccagcagtctggtcttgctgcctgcatattccaagtccatttaactcacataccttcctgcctttatgttcccaatgctgggactgtcattccaggggctgagggaacagcaggggtcaaagatgctttctctcagcccattctggttgggctagggataagaagaaagcagtcttaacctctctcactcttagacatcactggagtcttcagagaggagaggcaggaaacgggtggtgctgcaccaggatggggagataaagatgggacggtgaggcatgggaggcactgggaggtgaaagaaatcactgaggagctggggcatggggaagagaccttggtagctggctctcataagaagcctctgtccagcctcatcccttggagagcctgtgttgggggcacagagctgacatagcctgagggagaggagcctgggacgc

SEQ ID NO: 68434 - DNA, 2981 bp, Homo sapiens
gacatgtttgggatgatgaatgacatgattggaaacatggtgagacttgccccatacccttccccggccttgctctcagtgatggctgacaacaccttgcatcctctaaggcaagagggaaacagtatgctagtgaagggtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcagttcttgcattttgtgagaaagatacaggctagaacaggcagctgaagggtgaaatcccttcaccaggggtgatgcctccccattcagccctcccctacctaccctgtcctcaggaacacatgacagctggaggcaattgccagaccttctcatcttccactgtcatctcctactccaatacgggtgatggtgcccccaaggtctaccaagagacatcagagatgcgctcggcaccaggcggggtgagttggggagccctcctgtcccagagaaggtaggattgagcggcaccgccagaaaccctggctgcttttttccggattgggttgtgtgtggtgtgtttatcctgagatggtataggcagggctttggaaggggcggctgagtgtgccacgttctgcctcatcccagatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgagccttccctcccgcttcctggctggcagcccctaacccggttcccgtggacatccctaacacatagacacttctggggcaaagctctgggtcagccccatattcctttttttttttttttgagatggagtctcgctcttgttgcccaggtgcccaggctggagtgcagtggcgcgatctcagctcactgcaacctccgcctcccgggtttaagcaattctcctgcctcagcctcccgtgtagctggaactacaggcatgtgccaccacgcccagctaatttctgtatttttagtagagacagggtttcaccatgttgggcaggccgttctcgaactcctgaccttgtgatccacccaccgaccgttggcctcccaaagtgccgggattacaggcatgagccactgcacccaactgtcagtcccatattcttaccgcacttggagcctcctccgctcgggcggagtcaggtgctggcggtgtctttgtgaggggcctactttgtccctgaagttccgtattgatagtgttacacccttctccaccttgatccgtttctttctcccctctttatctttttcaaatccgcaattattaagtacctagtgtgcacataggactgtgaacctgaactgaagaataatcccattctgatttcttcctccagtaggccaccttacgcctaccggtggcttcctgggaccgtgcagaaaccaaaagagctaagggaattgccaccccacccatccctgcacgcacactcagccttcgccgctttggcccgaaaagctgtggctcgctcgcacatcggcctccaggagccaggccgcacacaggcctcatgtccgctctgtcctttccaggtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtaagtatcaggagtaaggagggtggggtgcacctgcggacggtcctcggctgcaaggcaggctcagttcaggctcccgcaggagctgcctttggtagtacaagttgacatggaaagagaacaatgttctcactgacataggggattaaaccccaactcctggctcttaacgtaagttttttcttccttttgacttgtgctcctctctctttccccctccaggtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaccaagtgggattctggctgtacttttgatcttttcctgttcaattcaaccctgctgtctcctctgaagttaccttctcacttttcctcgtctccacctgtagtcttcgtacctcagagttcaagcccacatctccttggtacggacagaccatcagcactgccaggtgcaggccgtgagcacttggctgggctaggctggggcgtgagaacatgagcacctctct

SEQ ID NO: 68435 - DNA, 1028 bp, Homo sapiens
ggtagaccttgggggcaccatcacccgtattggagtaggagatgacagtggaagatgagaaggtctggcaattgcctccagctgtcatgtgttcctgaggacagggtaggtaggggagggctgaatggggaggcatcacccctggtgaagggatttcacccttcagctgcctgttctagcctgtatctttctcacaaaatgcaagaactgaaaaaacatcaggcctcatcattaccctcccaaattcctctgagtccaaccacgagcaagaaggacctgaagagacagggccttaattgtatgctacgtaagagagctgctgccggctgcttcaggcaggcatgacagcaggtacagggtcccaaggctctctggttcaattactttatccagtactttacccttcactagcatactgtttccctcttgccttagaggatgcaaggtgttgtcagccatcactgagagcaaggccggggaagggtatggggcaagtctcaccatgtttccaatcatgtcattcatcatcccaaacatgtccatgaaaccacccgactggaggaaagagatggaaaacagagtcaggaaagcaaagtcagtgttcagagttgatcctgtttaggaacccacaacccacatggctgcacatttcctttctcttcttccttcacatctagcaagttctctttctcattctgttaaaataaccagaatactcatatttctcctcctgtgaactgctgaccccttcctcagtctctgtgactgctgtgatccaattttccttctcctgcttgctatattccccccatctttaggaagcaagccaaagtaatggattctaaactctaaagaggtaaggcatgaaattgttaaaacctaccaaaaaatcatctctagttggccctttaactgcacttccctcctcaaaagaacaaattttgctagacaattacatcttcctaatgcgtatgaacttctaggagtacaacagttaataacatcttttcttttttttttttttgaga

SEQ ID NO: 68436 - DNA, 1022 bp, Homo sapiens
ctctgagcagttcaggcagacatcggggttcccattgctaggaatggttggaactggctggatacctagctcctacctagcaggaagtaggcatcggtgccactgttgctctgtgcgtatttttttgcagggtggtggagggattgacagtttggcgcttctgccatccatactatgtgctcactccacagggatccctttgctattcaccgtcagcatatgagccgtatgttgtcaggtggctttggatatagccccttcctcagcatcacagatggcaacatgccagggaccaggcctgccagccgccggatgcagcaggtaatgatgctgagacacacctgagacccaaagaaaggttggaggttagttaggaaagcacttaattttcttgcactacagccaactgagcaagtgaaatgctctaggagttggggaaagggtcaggaaaaagggctttgtgactcccttttgagaggatggaaaaaaattgaggccatgggcctggtttgggattgtaaagagataggatgtggtctctaatttctgttcctcatgtgttcctgtaggctggagctgtctccccctttgggatgctgggaatggtgagtctttatctccctgtgtccttccatctcagacacactctctacccttagatattattcccaaatgtgcctcttaggaatagtttcatgagtaaccccagaatcttctctttttatggcattcacaaagctctgagcctgttgggtactaggagccctgtgggttaaaggtgttaaactcttgttgggaggccgagatgggtgatcacttgcagtcagaagttcgagaccagactggccaacatggtgaaaccccgtctctactaaaaataccaaaaaagccaggcatggtggcacacacctgtagtcccagctactcttgaatccgggaggtggagattgcagtgagccgagactgcgccactgccctccagcctgggcaacagagccagactccatctcaaaaaaaaaaaa

SEQ ID NO: 68437 - DNA, 3826 bp, Homo sapiens
cctaaaaattagaagcggggcaggactagccttcgaaaaagccgaggctgggcattgcatggcattgcgtcgagctgtcctcgccctcatcagctcccttccccggccccatccgttcgcccttgcctctcttccagccttcctctaatttccccagggaacctgcggagtgtcgctttgggaaattaacgcggccggggtttgggggctgggagccctatcttgtgtgtgtatgtgtatggcggggggggggggcgcggtggttgctgaggggccgtcacacaggtctcccggaggcccgcggagtgaaacggggggagccaatgggattaacggcggtgggagaggggctgtgtgcgatctgccaaggtgcgcccgtgtggccctccggcgggctgtgcggtggcatgtgacttcactgagtaggtgtctttgtatgtctgaaatccagcgagtgtgtgggactgcccgtgtcagttacatgtgtgcatgtggagacgtagatgttctggagccatgttgtcgctttgtgagtgctgagtggctccgctgtgctcccgtgctgtctcaagagtgtggaccagaatggcccaacgctgggccatgtgtctcccatcgcgtgggtgctcctctctaactgtgtctgtgcatggctgtcggccggtgtcggtgtgtgtgcctgtgttgagtaaatgaggccagagggctgcttagcagaagacctagggcccaggtcacatattctcctggaaaagggatcatggaaggacagtgaccagaaggacagaacaggggaggagagggcccggccccttgaactttggtctctggtattctccctccctgcatcagcccagatgggaaagtcaggccagggccatacagacttttggtgctggggcccccagagagaagctgaccagctctttgctctcctggcccaggacgtagggaagagccccctaggtagtggaaatgccatactgaccttgtggcacagaaatgaagacctcacggtggggtggaagggcaccctctctggagtgagagtgaagagttctgagctacccttaaagggagaagggaattgagtgccccccagggcagccgttctgcaccaggctcctctcctatcccctatcctgttccagaaaggacccccccgcccagggtgatctcacacaggagacttccattcacatggaatcagatacacagcgtggcacaccaacaccagatcagatcacacaaggacacctaccgtgttacactgtgcctgccaaggagtgggtggggagagcactggaatctgaattgggaggctagtgtagtgtccagaagggactcagatgtgccatatcagcacaggacgtcaacctatgcctgctaggatcttggggtgaaggagaggggctggctggtgggagggtctcctagactggtccctccctcttctccattcctatcccaccccagtcacagaccttgtttgttgctctctccttgtttcccacgcctgctactcttcccctccttgttttctcttctacttcacctacatttccaccgtaaatggctacttccactacacccatgcatacaccatgggaggcagggatagaggaaactacttgaactgttttggggcggggagggcagaaagtgggaggggtgctgggaatgtgctaaggtgtagtgtttggccaagtaggggcctgaggattagggagacacagatggagagaaacaaagaccttagaagctgaaggggaagctgggagggatgcccaggagagagagtcctcaggaaaaggccccagaggtagacaaaaggcagagctgggcgggcagtggcggggcaggcaagggaggcggagggacacaggagggggcggggcactgaggctgcaagcagatggagaggatttgctttgctgagctgaactcttcagccagtgaggtttgggagaacttgatgggggtggggatcattaccctggttgcccgctcctgcttcttcatccctttcccacctcaccttgggtcttggggaaggaggtgtttggtctcaaccccttcatggccctaatgtaaggaccctagggcccctattctgtctctaagctgtggccaccttattcagttcacacacctctaagctcactacagagggagaactggggctgcagggacttaggggctgcaagccatttgtggtgagaaaggtgacctctttctcctttgcaggacctgaaggagaagaaggagaaggtggaggagaaggcaagccggaaagagcgaaagaaagaagtggtggaggtgtggaggggtgggggagaggaccacatctgccctaccatcttccctcccaatcatctcatccttcctctgctttccttccgagggtgctgggtcctgccgttcccctgagccctgtcacccttgctgccccaccctgtggcccatcccaagcccttttatcacccaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaaggtggggaggggcaggggaggctgggctggcaaagtctgggctcaaaggagagcagagtcagggtgggtttgaagacctgaagcagggctgagggcgaccacgggggctctgccagagcttcctgcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaacctgtctcctgctttcccgggggctccagtcagtgcgacaaaagggtagagagggaggagggtggctgacctcccattctgccaggacccttccctttgatacaaaagcagcagcacactcctaccacccacgactcaagaagacaagatcagccctccaggggtggcctggagcccagctcttctgagagctgacttatgtcctgttttggattctcagggatgctcc

SEQ ID NO: 68438 - DNA, 1084 bp, Homo sapiens
agaatttttccctctccagggaaacttcatctccttcctggggcacgcccagcaacctctcctctgggtccgaccccaaagaccagaagattcctggtccccagagaaggggtctctctctctctctctctctcacacacacacacacacacacacacacacacacacacacacgaagagcatctttatagtaagtttattgtatttttatttcagctcaggggagcaggggtggagagtgggcacaaatgcaaagtaagcaaatggggagccccagcagcaataggggggtcttcctggaagaggcaggctttaaagacaggaggagaaggaaatagggaaaaggagttgggactgagggaagtggtgaggaagggtaggaagagaggggatcctgagagaagtggatcaagaagatttgtaaccctgatttccctgtgtcctgaatggtctggaggagggtaagggagggtgtggggcaggcgcagagcctggcacaatcacctttgaggtcccttagagggttccctctcaggctagctaccccctctcccagcaaagctcgcttccaggaggttctgcacagggtcagtgactggtcactgggcattctctcctgcagtgcctgtgctcccagcttgcgctctgattagaagagccaaaggctttgtcctctggtaacagattctgccaccagcgggggatgaaggagggattttagacagggaggccttcatccctgctcgtaaattctctgagatggacccttcccatgggtgctgtgcttctgtgaacccaaaagtacacattgagtacccaccactagccactggtgagagccgtgtggcatttgtccctgcattcaagaggcagcagtggaacttgggacaagggacctgggttagtcccgactccagcacttgctagtccggcacttggtaatcaatcatctagcctctctgagctctggttctggtctataaactggagatgatcatcttagttctgtcactgccagccttgtaggatttttctaagtctcaaatagacagaggatgtgagacatcccttgaggccgtgtaca

SEQ ID NO: 68439 - DNA, 1100 bp, Homo sapiens
cccacctgaaccccatatcctagtgcagctggtgggcaagacgtcagaagtaatgcctgatccctgtgctccaacagaggcgaagcggaggtggagatggagtgaacagagggaagggactgactcagaggaaggtcggggagagtgctggagacaaagccctgcggtcaggagggagaggaacagaggtggaccaggaaccgtagagacagacaggaacccaggaacagtgactagatggggtggtggggtgagccctgtgggatttccagccaagagtgctcagagaccatgtggcagcccgagggaaggagggaatggagagtggagcccagcggctggatgagaggtctgcggctgaaccgtggagctgcaggatggatgacggagctggaggacaggtcgtggaactgaaggacggtgatggagctgaggagtgggaactgaagcagatgctggagctggggtaaacagggtagtgggaactaaaagacagatgatcaagatgggggccacaaatggagtgggggatggacagaggagaggaagatggatgatggaactggaggagagatgacggagctgctgtatggctgatgaagttggaggtcaggtgatgatgctggggcctggatattggggagaacaggtggggaggaccccgatctcaccaagatgggcacccctgtgagtgagtcatagagaaagacgatggcgctgaccaagttggtgacctgcagggatgtcttggcagactccgagccatccagcgaggaccgccgcttccctcgggcatcctccaccacaatggctggtacctcaaaagctggccgggtacccaaggcccctggcccacccgctttggtccccccaccaccccccactctccgggcctgccgagccctccggggccgggcccacagtgtctggtagaaggtgatggccacacagaccagacccatgacaattcccccaagtagcaagaggctgaagcaaacgccaaagccgaggccgatcttggagactatgaactggcagccgcgggcatagtagcgctcgccgttgttgtgccagccaatggagggcagtgtggagaggat

SEQ ID NO: 68440 - DNA, 1032 bp, Homo sapiens
gatcctccccaagcccttgcactttcttcaccccccgtcagggagcagcgtctccctgcgcttagtcccaaaggaagtccaacggctctgctctcaggggacccaagggagagtcggcggggtgagaggcccagtggccggggccgacgaggagagtgccctggtgaggcagtcggagaaggcagaggtgtctcatcgatgaaggtggtgatctcctcccggaagaagccaggaccccgtgggggtcccccacctgaccccagaaccccactctccaagaattggcgaaggctggccagccccccaccttcagcctcttcctcgtcctcctcgtcctccaacctgtgtctttgtcccaggtactcaggaggacccccgagggcccggctctgggctgggaggacccggatgtcatcagaggatgaccacttgtgcaggaaggagcctggttcccgaggggtagagaagatgtttgtctcatcatgggacagacgccgggatagggggacctgggaagaggagcgggtaagacctgaaggtgctgcagggacagaggcagaggcaggaaccaagtggggactccggaagatggtgccaccttcttaaccttcaaaacgtttgctccggtgggcaaacctggccccacgaggtctgaagggatgcctctcttgctatagctttctttcacccagctctatggtgccctgaaagccagggctagggaagaggggattggggtgcctaacagacactggagaaaagtgatgagcggcaccaagggtaggagatgtatcccccagttccatacctgtaagtagtggactctctcaagaggagggaagagcatgtgccttccaggcagcagcttcacctgggcggggtcccggctccctggtcctgtggctccgttagcatcaaagcgaactttgcaaactcggccctctgcatagtcgtcacagcccccatctaggagagaaaatgggcagagtggttacaggtagggaatgcctaccgcggcctcccaccactgcc

SEQ ID NO: 68441 - DNA, 1050 bp, Homo sapiens
tcatttgtagctgtgtgatcttgagcatgttactttacttctctgtgtctcagggctctcaattacaaaatgagcactttaatattctgtttcatgagactgttgtgaactttaaaggataaattccatttccatgaataaagctcttagaatagcccctagcagatagtaagtgctatatgagttatagttgtacttgttgttacagtttgatccactgcccagggctcctgacattgagtcccgggcttttcctacctccgtcttcctctctggaaacagaagaaacttaatgagatatttcagctctaatgtcagggattccaggggctgaccttggtgggtgatgatgcttttctggactgtcgcaggacccctggacccctgcagctctcatccctgaggcacttagagaaaagctcaggtaggatatgccccatggtgggaggggcttggcccgagctgggaggctgggtctggactgtcctgggcacccactgagcgcatctctcacccctgagagaggatcaagagaagaggccttgggaccatgagcccgtgaagccaaagcccttgacctactggaagggtgagttcctgggagggagaaggcaggagcctggagggtctgggggctgccagctactgctctgcctgcccttaggggatgctcagccccctctgctctgtcttttccctggcagatgtccttctcctggagggtgtgaccttgacccaggattccaggcagctgaatgggtcggagcgggcggtgttggatgggctgctcaccccagccgagtgtggggtgctgctgcagctggctaaggtaggaagacctgcaagctcatcagctcgttcaagactcttggatacaatcacctgttcccttgctcttggcctgcccccttcattctgcctgtcctgattatccaaccgggactgtgcttaccactgcctctcagctgtggataagttccgtctcgtcttaatttagctgacataggtggatgttctttacaaatgaattttgctagaaattgataggaa

SEQ ID NO: 68442 - DNA, 2810 bp, Homo sapiens
cagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagagataagggctgagacctgagtcacttctcacaggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtactctgggccagcgtgggaaaggcagagaatgtctgaattcttgggtctcttcctaacctgattttgagagagccgtcatgaccccacccttatcctagccttattttctgcaatctcaatctgtgtggggtaggctggatatctgagggccttggcaattccttcctggaatatggggaggagaggagagaagagtcagggcccagacttgttctagcctatggtcttgacaggtggagagctctccacagccaggcctaccagcaggggagcaactggagggtcttaaacatgcccaggactcagatccccgctctcctactcttggtattgcacggacacctatgaagaccagcagtggaggtaagcgttgggcccagggaatgctgatgaagctgtcatctattattcttgggtagggtccatgaagccattctctcagggttccttaaaggggcctctatcctcctgcttcggacccatctcactcttatctcaatattttgttcccagcctgggtgcggtggctcatgcctgtaatcccagcacgttggaaggccggggtggtcagatcgcttgagcccaggagttcaagaccagcctaggcaacatggcaaaaccccatctctagaaaaaatacacacacataacacacacacacacacacaaaagcacggtggcatgggcctgtgatcccagctactcaggaggctgaagtgggaggattgcttgagcccacaaggtcaaggctgcagtgaactgtgatcacgccactgcactccagcctgggggacagagcaagccccatctcaaaaaaaaaaaaaattgctccctttcaccttgatttccttgatttctctcttcccacttgctcaccctcctgggcatgagtcctgggtttctgtatgttttgctccttgctgaatgttgtgtatcagaaggtcactgttcacttcactttcttcctctagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggtacagaatctaaggcaagatgcagggaagataaactaggataatgttttgggataaggtccatgggtgagtgtgggaggaataaactgtaagtcctagttttgggtccttgctttaacgccttacccaccccaggttctatgcgcaatagatggaaaccaaacagcagcaaggtactagggagatcccccctcaccatcctgcaggatgacaactcccctggcaccctgacactacgacaggtaaaggaagagaaagtgcaagctgttactaggatatccaacgtagagggtgggagacccttttacccagatcttccctcttctgaacagcaactccccccaactcatacactgccgttttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtatatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctct

SEQ ID NO: 68443 - DNA, 1680 bp, Homo sapiens
ttctttttttcacctacttttgtgtcattaaagcttggcacagatgttttttagctttattccgttctgagatgaagcactacctccttccgtccctcctcccgacttgttccttcgctcgtgctcattgctgatccagcccttcctgcttctttacagaaagaggaggaccctgctacaggcactggagacccaccccggaagaagcccacgcggctggctattggtgagcaccgctgcagtcctattcttctccctgagctggtctttctggctctcagcagcaccaggaaagccccaaagagtgggcctgattgatggccctagaactctggatggggcaagtgaggtgctggctcggaggagggacattgacctgttgtcattgctctactctccctcttcttccctatccttccaggtgttgaaggcggatttgaccttagcgaggagaagtttgaattagacgaggatgtgaagattgtcattttgccagattacctggagattgcccgggatggactggggggactgcctgacattgtcagagatcgggtatgactgccccctatgctacccaagattctagagcaagatgggccagggtagtggtgtcttaggcaagcactgacaaagctgaaggccaaggggaagaggggcatgtggggcagggggttgggtattgcctctgaccctctgcttcccccaggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctggtgaggcctggcccctctgcctcgggcaccacccccagagcaaggacaaggagcccacttttctgggggatctggtgggagagagggtagggagcaggacaggaagggaagcttggaaatgaacacgacatggggatggccagaggagaagagagagagaccttggattggcggggggcctgcagagccctctctctctgccactccctcaaatccccgacccacatttctgctgattctcttctctgtgggttagtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctggtacagcctcccctcctccagccactctcatgcttaaatatatttcatttgttagtaatttcgtgtgacatgtataatacatgaatgcattatcttgataagaaaggaaagtagtcaggtgcggtggctcatgtttgcaatcccaacactttgggaggccaaggcaggagaattgcttgagcctaggagttcgagaccagcctgggcaacatagtgagacctcatctctccaaaaaagaaaaaaaaagaaaaattggctgggtgtggtagctcctgcctgtagtctcacctactcaggaggctgaggcaggaggattgtttgagcacccgggaggttgaggctgcagtgagctatgattgcaccactggactccagcctgggct

SEQ ID NO: 68444 - DNA, 1254 bp, Homo sapiens
tcttagagtagttcctatcggctgggtgtgttggcccacacccgtaatcccagtacttcgggaggccaagatgggagaattgcttgagcccaggaggttgagaccagcctgggcaacatagcgagaccctgtcttctcttaaaaaaaaaaaagaataattcctgtcacactctggctgacatgctgtgaggggagcaagttagggagctgcaccaccagcaccccaacacacaaaccccactgatagtgcagagtgccaagtcccagggctctgtggccttctgacagactcaagggttagcaggtggtctttattttagggcagtgacatcagatgagcacctaacatggacatgtagcacttggggaggaggggggcttggcacactaagaataaaggcaggttctcagcagaaatgagtttactttcgaatttggggaacaattagaatgtgaatgctcagaacatgtcaacaggttctgtccaatagaacgtgaactgcacttatcctaatcccaggctaccttccccctccccggctcctctgccgccgagcgtgcttgcacattggacatagctgagaaggggagaacaggcaggttgctggagagaagcgactccaaggttcacccacagcaactccccactcttgaggggagcccgttcacagagttagtaaatgtttgcttccttcccttttcctcggcgctcaggccagagcccctccaactgtccttcccttgacttttaggtatgtggataagctggagaagatcttccagaatgccccgacggaccctacccaggatttcagcacccaggtgtatgtaaccaggtcctatgtaggaaagctgttgacagtcatggccgtataccttcctcctccctgaccgcctggggggcacagcactttaacccctggcctttttttgttttgttttgttttgttttttgagacggagtcttgttctgttgccaggctggagtgcagtggcgcgatctcggctcactacaacctctgcctcctgggttcaagtgattctcctgcctcagtctcctgagtagctaggactacaggcacatgccaccacgcccagctaaattttttttgtatttttagtagagacggggtttcatcatgttggccaggatggtctcgatctcctgacctcgtggtctgcccacctcggcctcccaaagtgctgggattacaggcgtgagccaccgtgcacggccaccactggcctattagg

SEQ ID NO: 68445 - DNA, 1039 bp, Homo sapiens
tgtcaggggtgctttggaagggtagaggaactgaaatacggacacagagccagtagggagaggctaaggaggcaaagaagcagcaccctccgaaggatccaccaacccattctgtcaccagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagtaagtcctctggtcggggcctgaggctgtgggtctatggcagagctatcccagaggatacttctgtctcttccctgttctttcatccctttgtggttggaacctcagggttgaatcagttgggctggtaatctggccctgatggaaccaaggggccctggtaggggggacacgggtactgactctatctgtcaccttgtcctgccccaaccactccctcttctgtggcacagggtctctttgtagtgtagcctctcttcattgcccctcagtcatggctgagcacaggcacttaggatcagctgtgggcagaatttggatttccagcaaatagccacactttgagcctagccattggcacctggcatgggtgtgagacctgaaaaagggctttggtctcggggagtcagctacccagccctttgctgctcctgccagtgaaacagctcttcctctctgtgtgggttttttttttttttctatgtgtgggtcttgctatgtttttttccctacgtgtgggtcttgctatgttgcccaggttggtctcttaactcctgggctcaagcagtcgtcctgccttggcctcccaaagtgctggaattacagatatgagccaccatgcctgggcttttttctttttcttttttttgttgacagccttccttctggcctctactgctcctcgttggccgaggacaggcatcagacacctgcccaggggaagagaagaatatggaggatct

SEQ ID NO: 68446 - DNA, 1057 bp, Homo sapiens
ggccagtggggaagaagggggtgggaatgaggggccatccttcttgagcaagaccaaagacaacaggtgtggtctggccgaggttgggcaccactcttttgtggctgcgatgaaggagctgaagcctgcgttcactgctgggttttttgccccagaacttgttaaaaatgtaatgcttctgtttggccgggcgcggtggctcacgcctgtaatcccagcactttgggagggtgaggtgggcggatcacgcggtcagcagatcaagaccatcctggctaacacggtgaaaccccgtctctacgaaaaatacaaaaaattaaccaagcgtggtggtgggcgtctgtagtcccagctacttgggaggctgaggcaggagaaaggcgtgaacccgggaggcggagcttgcagtgagccgagatcgcgccactgcactccagcctgggcgacagagcaagactccgtctcaagaaaaaaagtaatgcttccttcctctccaagaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaagtgagtatccccaggaagcaggacaggcctggtggaatctggtcagtctactacaccagatccctcattcaggcagctctgccctcctcaggagtcaggggcttctttccacctcaacgtggcatctgagggtggggttctctgacatggagacaggctctggcccagtacctgcctcacattccctgaaactcctgtcctgagtctgagctgttgtctggatctttgggccatcactcaagcattcctcttctgtttccttctctgaccccctctctcctttcctagagtatcagctctttgccttcattagtcacatgggcacctctaccatgtgtggtcactacgtctgccacatcaagaaagaaggcaggtgagtgctggccacatgcgttttgaatggag

SEQ ID NO: 68447 - DNA, 2672 bp, Homo sapiens
ctcaagtgatccttctgcctcggcctcccaaagtgctaggattacaggcatgagctaccgtgcctggccaggccccctgcctttgtaaataaattttcactggaacctggacacacttgtttatgtgttgtttgtgcctgttttcacgctgcggcaggaaagttgagtcgttgtgtcagagaccagagagagagcctgcagaacctcaaatactatctggcccttgccagaaaaagtttaccaaccccctgcctccctggaatgggtggagggtggttgtaaaggtactggaggatctgaagacataatagggtccgtgacccttgtgaggttgtgaagctcccttaaggcacatggtggctgggctgtggatttggggtatgggcagagagtgtggagagcacttccaggggccatgtctgagagactacatgatgccactttgaatgcccagtttgttcatccttttctgttttccccacttccccagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaattgtgtcctgtttgataccttgggggagaggcttaccttcctggggttagcaggagggcgcttaagaaaactcctaactctggccgcctccctgccaaagtcaagtctccacttttcactggttctagagctctaggaaaattggggttgggtggggaggtggagtagagtgactaaatgccgacacaaagccaaggaaagatggagtgaagaacccttccctctctttattcacacaggagtggaggatttcccaaatgtccctaactggctagctggcttcaggctgggactcagtccctgcagttcctgccaggccttgccagccggggcgagggttgggatgatcctggcggcctatgcctgtgtgggctgcccctcccgctgtgaaccctgcatttgtcccgcaagttttcactcaggtagactccctgggtacaagggtgcctgctcagcagtcgggcatgagctgctccgatgggcgaaggaggttgtctatcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccttcctcgccggcgtccgcgtccccgcgccgagctgctcgggctccctgagcccca

SEQ ID NO: 68448 - DNA, 1063 bp, Homo sapiens
gagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcaggtgagatcgaggtggagaggggtgtgtgggacccttccctcactttcctcgttgaggggaaagccacagggtgggctccctgctgaaccttggcttcatctcttcctttagccctggcatgatcaaagactgcggagccacgtgggtggtcctggggcactcagagagaaggcatgtctttggggagtcagatgaggttagtagccaagagagaagataagggatgtctttttccaagaaggatgtctcaccaagtctgtttctcaacagctgattgggcagaaagtggcccatgctc

SEQ ID NO: 68449 - DNA, 1492 bp, Homo sapiens
gatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggtaaccgggcccaggagccctgccctcatcccagcctgcctcaataggtttggacagacacagcccacatggggcaaccccttatttcaaagacacagagaccttgaacccagagacagtgacttgtccaagggcatccagtccagggcctggcttggatcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttactatttttacttgaaaaaatgttttgcgtagcagactgtcatagccttgaacgccggctccctttcttcctccctccaagtggctctggggctgtt

SEQ ID NO: 68450 - DNA, 1050 bp, Homo sapiens
atcctagagcgtcccttttggtttgcatttggggaaatgtcttctctcaccgttcctcacctcccccagacttcccttggactcccctctctcctgctcttccccacggcgcccctctccgttcgcgcttcctcccctctgctgcacgggggagagatggaagaagtggggatctgtcgaggcgcagaggggaggacaggcccagctcgcctccactccccaccggctcttatcctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtaatgggtgtggcatgggccttcctacagccctagcttttccacggccaggctgggttcggccaggggttcggaggccttttttgatacccaggggtatggggt

SEQ ID NO: 68451 - DNA, 1049 bp, Homo sapiens
tgtgtctctggccgtgtgtaaggcaggggcagctgagcgggaactgcccctgtatcgccacattgctcagctggccgggaactcagacctcatcctgcctgtgccggtgagcaataagccagcctgcggctctcccaggggcgggtgggggagggagcatgcaactcatgaggaatgatgggaggaaagtgaattgagggaggtaaagaggaaggatggggacgtgagacttagtccggaaagctgggggaagtttgggatcttgggttaacactcctggggcgggcagggaggggctctttgacccttctgtctttctgtggctccccaggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaaggtgaggccaggagccccactcccagctctaagtcttaccctattgtgggacatcagaaagggtgacacagttcaccaagtcctgagtaggcgtggagggtcctaggactctgcaaactccaaaaggtaccagttcttagagtggattgcagagagcctgccaaattcacatgcagacctagggggacagtatttttttttttttttgagacggagtcttgctctgtcacccaggctggagtgcagtggctcgatctcagctcactgcaagctccgcctcccgggttcacgccattctcctgcctcagcctcccgagtagctgggactacaggcgcccgccaccacgcccggctaattttttgtattttttagtagagacagggtttcactgtggtctcgaactcctgaccttgtgatcggcccgcctcggcctcccaaagtgctgggattacaagcgtgagccaccacgcctggccaggggacagtcttttacct

SEQ ID NO: 68452 - DNA, 1099 bp, Homo sapiens
atataggtagtggttaagagttaaggttctggggccaaataacctggatttatttgaaccttgacttgtggagttactgctggtgaactttcttacttctctctggaaataataacagaatctagctcatggtagtgtgaggcttaaatgaaatatatataaaatgcttagatgacatgataccaatgaaagtatagtaagtattattaagagaattccattcctctgtgttcctagaagatggcctctcctcccagacctggggataaccccaacagcatccccgccacacttccctcaggaacagccctccacctctgccctgaatgtcttttctttccctcctcctccttgcccatccctcctgcttgtactataatctcactgtattctgtccccagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctggtgagaggaagtggtgtgagggggaggtctgggggcaggcagggacgtgtcccagcaactctggaccttatggggtgctgactcaggcaccaggtgggggtgtcctaagaagaacctgagaaccagggagagggtgcaggagccacctgcaaagactgggctttgtatgtagtgtaaaaatgcaggtacccgtgaccaatctgttctgtctcagatcctgattaaagtcatgggttctgaaaactactgggtcatggggaaggctctggaaggaaccagggatgatatgagtgtgactggatctagcagagaactagaacatttcagtatctttgattgatgaaattgtggatgctgaatggagctgggactgatgtgtgagtagaaagaaggctgagggggactgaattagcttctgcaagtctgcccagggcctttatctcaggatggaggcagttggtcgccatcttcctgacacagagcgaaagaaaatcaacata

SEQ ID NO: 68453 - DNA, 1048 bp, Homo sapiens
ccagcctaattctacccaggggtgccaaagagagcggggaacctggaatcatcctcacagttctctcacctctgcccctccacccctgattctctgctcccctcccagatagctttcccctagatgtttcctgacatagaccaaggttggggctgggaagagagtgcccagtgtgagagctggagaatcagtgctgtgtgtggatacaggtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgaggtgagggtccctggggtgggagcccctggcccagatggctaaaggccccatttgcctgccagaccatctgtagcaccaagggcctggataacagtccatttcctggataacagtccaacagataatattggtttttgcttcctgggtttattgatggcctgattgacaaatcccagagatcacatgggaaagccagggaatgctaagccttggggcaggacacaaaagcaggtggtgtgggggtggttggagtctgggggacccctagagagagaagcaggatcctcctgcatccctgaccacttcctttgtggttcatctctctcagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctg

SEQ ID NO: 68454 - DNA, 1048 bp, Homo sapiens
aggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcactgttgtgtctaaggagtcttactctagtccctatgaggggagagaagatggagcacctggaagctggtgaaactggatagcagagctgggggggcacaaaaagaggaagacaaactgaacaaatatggccgagatgatggcactgcctaccccattctggctaggtggggtgcatgtggcccctgctttcttagcagaaggcttggctcccagacgcaggtgaattaaggggttcaagagcccctaaaagcataaaatattttgtgtgtgtgtgtgtgtgcacgcgcattttgggggaaagggggtctaaggtgttttcatatccaaagggcttgtggactggagcagctcctgtactgggcctctgccaacaaaaccctggctggttctcgaatggaacaggacttcatggccatcacccactgcaagatggggaaatgggaaggaagaatggttccgggggtagtatacggaaggacctaaggaaaca

SEQ ID NO: 68455 - DNA, 1030 bp, Homo sapiens
cggcggcgactgaggccgagaagaggagaggggggcgggggagctgccgccgccgccccccagaggcgccggagcccggaatcccgctcggagccagccagccgtcccgagctaccagcaggtaaggtctgcggccgcctgggccccgggcccgcggggttctgtcccgcccgggctccggcctgcggctccccacccccacccctcccagttccccctcctgccgccgccgcctccatttgttattttcccaatcccgtccccccactgcgggctctgcctggcctgagggccgggggctcagggggtggggcccgccgaggagagtcgggggccagggtttcgggaggatcgggaaggtggggaaggagggagggtctccggaggaggcctgtggggccagagggtatccgggacccgcagactcaaaagaggaggaacatcgaggccggggttggcggaggaaaacgggggatgctgtgagtggggttccgggcgaaggcagaatggataggagagatggcagcgaggtggggcatgaagcctccaggaaaaagctccaaaggaccagaacacgggttccggagcctggggttgggggctttaggaatagacgggaagtgggaaacgggaaaggggtgtggtaggtggaaagagggattgtggctgatgaacctgggggagacggaggcttgggcaaagagaggtccatttttgagaagagccggaggttttccagcgtggaagagggaaggccatgtctttgtgacggttttcattcccctactgcaggtcacctctgaccctgttttccctatcccagacatagttatttcttggagagggcactggggcccagtagtgtgggttatcccaaaactagtgaggaggaaaacaggaacacagaagggggagttgggaagaaaggggttctgggaggatggaaatggagaattgagcaaccttacaggcactccaggcaagttgcgacctccaccctccaccctccaatttccggagcgtccgctgc

SEQ ID NO: 68456 - DNA, 1045 bp, Homo sapiens
cttttggcagttggttctgacctctacctcccttattatgttattttttgtagagttgtctttttgcttctttgcactttctttcattttctaaaacttgaattcctctttgagcctcccttcttgagtaacccttttcctctttccctcaactaacctttggccttcttccctgaccttgtagaaatggctgggctcccaggcccatcccaggtgagggtggcccaggacagagggctgtgaaacagcttcatgcaggggaaatactatagaacaggagccaggagacctgtgtctagacctggctgtgcctctgtgaccttgggcaagtcacttctctttgagcctgggcttcattgttaagatgaaggggctatagatgagatgatctctgaggcctctctgaaggtcccggattctcagaaggcttaggccagtgcatcgttatctgctggtctgggctgcattgttatctaggagtcactttggactggtttgttagtctggcaggtccagaatgatgttgggggctgggccaatgatcctgaaatttagcctgcgagcccctcccagagagcttgtgactccactgtattccttctgacatcccatatttctctcttaatttcttttcctgttcttacttaggggctctttttctagttctcactttcctcccaacccagtctggtcttaatcattttctttttaaagtaaggtaatggcagtgcgcagtggctcacgcctgtaatcccagcactttgggaggctgaggcgggcggatcacgaggtcaggcgattgagaccatcctggctaacacggtgaaaccccgtctctagtaaaaatacaaaaaaattagccgggcgtggtggcgggcgcctgtagtcccagctactcaggaggctgaggcaggagaatggcgtgaacccgggaggtggagcttgcagtgagccgagccgagatcgcggcacggcactccagcctgggtgacagagtgagactccgtctcaataaataaataaataaataaataaataaaataaa

SEQ ID NO: 68457 - DNA, 1093 bp, Homo sapiens
ccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggccc

SEQ ID NO: 68458 - DNA, 1103 bp, Homo sapiens
ttagtagacacggggtttcaccatgttggccaggatagtcttgatctcttgaccttgtgatccacccgccttggcctcccaaagtgctggaattacaagcgtgagccaccgcacccggcttcctttttttcttttgcccagactggagtgcagtggcgcgatctcggctcactgcagcttccacctcccaggttcaagcgattctcctgcctcagcctcccgaggagctgggactataggcgtgtgccaccctgcctggctaatttttttgtattttttgtagaaacagggtttcaccatcttggccaggctggtcttgaactcctcacctcaggtgagctgcctgcctcagcctcccaaagtgctgagattataggcttgagccactgtgcccggcctcttcttgtcttattttctaaacttctatcatcttccaccttcttcacgcagtctacctctctctgtccttcccctcagacccttctgatgactgtaatctcctgtcctgtgtcatccatatgtccctcctccagtagggctcagcctgtccacccctgccaggcctctagttcttccactctgcctttgttccactttggacctccttgtgtttgtctgactcagttcccaggcttggatcccttcacccaaatgcatggtttgccccaaacctgccttctggtgacaccttcctcttctctgccctccagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttggtaaggatggaagttggggtaggcagctccaatgagaaaagggcagaaaggaggtatttgggtggggggatgggcctagttgggcttggggagggatgaggaggtgcctagaggagctgggcatgggaataggagagctggagctctgcccaagagaagcacgagttttagtgtcagcctaagaggttcgaatcccaattccaccctaccactggcaacttacagaactgggtgtgttacctcactttt

SEQ ID NO: 68459 - DNA, 4089 bp, Homo sapiens
tttttgtattttagtagagacggggtttcactatgtagatcaagctggtctcgaactcctgacctcaaatgatccgcccgcctcggcctcccaaagtgctgggattacaggcgtgagccaccgcgcccggccgaaactgtggcctcttaatacctatccctgtcctctccaggatcccttggttccagtaccccattatctatgacattcgggccagacctcgaaaaatctcctcccctacaggctccaaaggtaggtctgagcacttggtaatcacatggcaggtgggatgatcaaggtagctggcaagaaaccccaggggaatatggtagtgtcaggcctttaggcctctttccacatctgcaagagctgtaacaaaaatacctgcctcctggggtcaaagcagcaaattctgaacacactgtgtttgcgtgctttttactgtctcctccctgacgtgtattcaataagagtattgtttgtccctcgtcttgttcactgcctagatcaaagctttgttttaaagccttttttttctaactgcttgacttactatatctacagttacatccactagtacactctgttctggagaagtttgtccctaagcttgactagttcacctgttctctccttctagaccatacataaaagccgtgcctttgagttccccagacctcttcctcctccccacccacgcacacatatacaccctgggtcaggtagctcacctgtaacctgtaatgtacttctttgtgctatacctagtgcaggtcgcttattcatttactagactgggccctgggaataaaagattcattaaacacaattcttgtcccccaagtccttacaggagacatgattacggtacagcacgaaagcgcccacgttagaggttgcacagagtacagagggggaaagagtagtcagctctgctggtgacggggtttgcagttcaaggcttcacagtgggtgagggtgcatttcagctgtgctgcgtcttgtcttccttgtcagcctgattaactctcctccccccagggtagtgccaggctgtacaccattgcacagggcatacagggaggaacatgaaggagaaaatgcttgggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtctgactcccaccaccatctgcgtggtgtcagcctttccttcctaggcccagagtattgggaattaggaaaggcagcttattagaaaagcattgtcaccctagtgccatttccacctaaaagctgtgctaattgccactgtgaaataaggagagccagcattagaactcgatagcactcggtgttaggaagcacagaggaaaatggccaagtcttggcttttcctgcacctcttcgagcagagaggcttatgttacaggtttgcctgacaggaagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggctgaggcaggagaatcacttgaacccaggaggcggaagttgcagtgagctgagatcatgccactgcactccagcctgagcaacagagcaagactccgtctcaaaaataaataaataaaaaattggcttctccgatactcctcctgtcaagaatgattcctctgggttccctgaccttttgttctaatcatagctgctgctcagcgctctggatccctaagtgcgagcagaaaccatgtgttactcattgctgcacccctgccctaatctgcatgtgttccatgttaagtagctgctgaattgcaggggtcggaattgaggtctttgcttaatgcaagcatctgtcttatttcctgccctgtagatcgccacatcacagaatcgtatctatctcacagctgacaaccttgtgctgaacctacaggatgaaagtttcaccaggtgagagatgtggccacactgtggggtatcaccaagaacgtgggacctgagtctggttgtttgggctctggagcctgctacagctattcatatggctcagagacattgaaccaaaattagaaaagggggtggttgacagtttctatcttgcatctcataggattgattttatgagatcaaataggattattcacataaaaagcactttaattataaagttttcatctaaccaaaaagtgatgaaagatgatactcagttttcttactcaagagccctcaaactcctctggtgaatggagggatgttaggaaaggagatgagaaatagcagtggccatgagaacatgcctcctcctttcatgagcctgagattcctggctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccaccc

SEQ ID NO: 68460 - DNA, 1169 bp, Homo sapiens
cccgtggaggggcgcggggacagggcaaggggtttgggggagggactggaagcgtccggcgagcaggcggaggttgctcaccggtgaacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtagtttattgtggtgctggaaggggccagtctggagacagtcaaggtagtttgggacaggaagtggagaagtagtaaatcgataggttgggactccgtggaatgagggtaaggggcccagagtggatgtagaaagcagagaggggtgaaagatgcttttgaaggaaggtggcttggttggctttgcgttgatttgacatcctgggatggtagtactcatttttctttctttttttttttttttttgagacggagtctcgctctgtcgcccaggctggagtgcagttgcgcgacctcggctcactgcaacttctgcctcccgccttcaaacagttctcctgactcagcctctggagtagctgggactacaggcaggtgccaccacgcccggctaatttttttgtatttttagttcagatggggtttcaccatgttggccacgctggtctcgaactcctga

SEQ ID NO: 68461 - DNA, 2320 bp, Homo sapiens
tacttctgagagttttctttgattaaactgcctcctgcatcattagttttcacatttcttttttttgagatggagtctcgctctgttgcccgggctggagtgcagtggcgctgcaagctccgcctcctgggttcatgccattctcctgcctctgcctcccaagtagctgggactacaggcgcctgccaccatgcccggctaattttttatatttttagtagagatggggtttcaccgtgttagccacgatggtctcaatctcctgaccttgtgatctgcccgcctcggcctcccaaagtgctgggattacaggcgtgagccaccacgcccggccttcacatttcttgttcagatttgcagctcttcacttagtgcatgtttggtgtacgcaaactgagggtggtgactcgatattttgcacagtacctacttactgctcctgtaataaacacagcattcagccttgctaactactaactcctgcctagttccaggatgtctcattggccttgcctaacagccacaggttttttaattaaatccagtgtattagtagataatgtgaagtcacaggttgtgcccttcctcctgtttccctctcagaccattcactggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttc

SEQ ID NO: 68462 - DNA, 1074 bp, Homo sapiens
gcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttcaccactagcattcctgactgctctctttcacagttcttctccatcatcagggttctctcctttagcacatgggaatctgggagctaaagcctgccttcaaagcatggaaccaaactgcaaactctgtaacctcctatctgtccctgaagtcccggggaacaaacagttttacaccactggatactttaggaaccccaaaacaaccaggtttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgt

SEQ ID NO: 68463 - DNA, 1060 bp, Homo sapiens
caacatagcaaaatcctgtctcaaaaatatttatcagtaggaaatgcaggagggcacagtggctcatgcctgtaatgccaacgctctgggaggccaaggcaggaggatcactggaggccaggagttcaagaccagcctgggcaacatagtgagaccccatctctacaaaaaaaaattatccaggcaaggtggtacatgcctatagtcccagctactcaggtggccaaggcaaggggatcgcttgagcccaggagttcaaggccacagcgagcaatgactatgcctctgtactctagccggagtggcagagcaaggccctgactctagaaaataaaaattaaaatggtaaaaaaaaaaaaaaaaaaaaagtttaattgccagaagaattccttcactgagaacttgtccatcctgtgtttcagcatcaattcaaccaagaaatgaaggagcagattcaaagtggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagcatcattcctgctctcaagcgcctgagtctgggccttttctacctagtgggctacacactgctcagcccccacatcacagaagactatctcctcactgaagactatgacgtgagtgtctactaaagcagcagcagcatgactgcaccagagctagaaaatggacaggcaaggatccctacagatagcagagaagtaggaaatatcatctacaagtgcatgttggttttgctctagatctgtgagttgtca

SEQ ID NO: 68464 - DNA, 1048 bp, Homo sapiens
agtggtgtgatcaaagctcactgcagccttgacccacctcccctggactcaagcaattctcccacttcagcctcctatgtagcttggactacagatgcatgccactatgtctgataatttttgtatttttttgtagagacagagtctctctatgttgccaggctggtctagaactcacgggctcaagtgatcctcccacctcggcctcccaaagtgctgggattatagaggtgaaaccactgtgcccagcctctatctacctacctacctatcaacctgcctacctacctatcaatcataaatatatttcatatatacatgaaaataggctttaaaggcagaaatgtgactggttcaggcaaaatcctgtggcataaatgtggatttttatgtttgtactagtgttagaatggataactggaagaaccctaaactaaaaagggcccactcctggcacagagtgcctgttacaacagtccagggcctgcatgactcaggtctctatgccagggtcatgctggagaatgcagctttcagaagagtcacttcagagtgagtgaaatacctacacaaacatctggaccaagaggggcaattacctgtttggtatctttcctggtatgtcaatcagctctccctgcaccagcttcatgtagtgattcattgagaactggggccctaccaagaaggccccatagaagtaggagaaaccagcaacttccagcagggaaggaacaccacgtatggcatatttctgttgctcagaggacaaggaattctatgccaagaagagaatgcatggttcaggatagccttgaatctccccacaagagccactttgagtgttccccacctgtgtgccccactgactggggttcttcaaatagccttctctttgggggatgacaaatagttgcttcttgtggaaatgcgtatgtgtgtgcatagctggctgttgctgctttagcaaatgccttgctggcattgatctctggactttgtgcaagagctggatcctgggcaaattagatttgttgatccttgctca

SEQ ID NO: 68465 - DNA, 1050 bp, Homo sapiens
ctcccaccaccctacccatccgttctctctctgctcaggtttggctgttgactactttgacggagggaaagatcaggtaagtacccattcatcggcagagaggttcaagacttaatgaaagggaagaaaaaagttgttaacaaaagactgaacccaaattccagagcggagctctccctcattccccagcctgtgcaatctccctttcagatagcactgagcaaggatcaacaaatctaatttgcccaggatccagctcttgcacaaagtccagagatcaatgccagcaaggcatttgctaaagcagcaacagccagctatgcacacacatacgcatttccacaagaagcaactatttgtcatcccccaaagagaaggctatttgaagaaccccagtcagtggggcacacaggtggggaacactcaaagtggctcttgtggggagattcaaggctatcctgaaccatgcattctcttcttggcatagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacaggtaattgcccctcttggtccagatgtttgtgtaggtatttcactcactctgaagtgactcttctgaaagctgcattctccagcatgaccctggcatagagacctgagtcatgcaggccctggactgttgtaacaggcactctgtgccaggagtgggccctttttagtttagggttcttccagttatccattctaacactagtacaaacataaaaatccacatttatgccacaggattttgcctgaaccagtcacatttctgcctttaaagcctattttcatgtatatatgaaatatatttatgattgataggtaggtaggcaggttgataggtaggtaggtagatagaggctgggcacagtggtttcacctctataatcccagc

SEQ ID NO: 68466 - DNA, 1004 bp, Homo sapiens
ccacggcggcttgcttccaggctttgctgttctccgtcaccgtcttaacgttcctgctaacctggcctgctgcattctttttatttttctcccaattcctccgccttcttctcatgtgtttgctagtgtgcaatacctcacctgtttggaactcaacaacgtcccctcctgcaaaacgcacctgaaaacaagaaatagcacacaaggcctctaagtggccagaacagatgttaccaggcctaagtccataaggaaagcacccaagccccttgcttttgtcttaaatctttttttttttacacctttaaaataaggttatggtttctaaggcctgccgtaaattaggagtagggagaggaactattgccaagcaccccaaaagttcaagaggtgactgttgatcccagagtagcaaggaaagggacagacaggctataagaagtggacacaagaactcagaactcaggacagtgtaggccttgttagagtcaggcagacaatttcacatacctcagaacgtcataaagccatcatgactttactctggaatagatacgatccagacacctagaaaatgttaaattagattcaacttaaagaggcagagtaatatgtgtggtgttttttaatttcgagcattccaaatggttaagggttttcatgcttaaagagagaaacttagctacctagaacttatttatgagtgctctagataattatctactgttttatatttttttatttataccccgttactaaaacaaaagtaaaaataaagcaaaagattgaaggcattgacatttagtctatatactttctagttcctggctctagttcttagcaatatttgctgctaacctggtgttctgtctctgccaaatttctgcccatgtgaaatatatgagacttgatcctatttccttgctcattgatctacctgaaagggtcatagatgtctccacctccctagagctagtgatcctatatcccatcatctcagccag

SEQ ID NO: 68467 - DNA, 1804 bp, Homo sapiens
caggaaagaatacttgcccttaataataactcactaagttgatttcatgacttgttaatgagttacaacagtttgaaaaatcttgagttagaggctgcaattttttttttttttttttttttgagacggagtctcgctctgtcacccacactggagtgcagtggctcgatgtcggctcattgcaacctccgcctcccaggttcaagcagttctcctcctcagcctcctgagtagctaggactatggtgcacgccatcatacccggctaatttttgtgtttttagtagagacggggtttcaccatgttggctaggatggtctcaatctactgacgtcgtgatccacctgcctcggcctcccaaagtgctggaattacaggcgtgaaattacaggcatgagccaccgcgcccagccgaggctgcaatttttaatattcaatacttcaaagaaaaagtaagcttatgtggactgctgcactggagtattttgagcagtcagaagactgtaaaaggagtgtgtttatgtttgtgtggtgtatgcttgcaaggagtttgatggaaggatgctgaagaggaattttgccatgagccctggtgctggcaaatactaccagaaaacatctccccttcaacagcttggatctcatcactccttaatgtaactaataccatgaattgctcatataaattcagtaacatgcacctactacaggtaaagcagtattcttaaccctgcaagggcaggagcagtgggtgtagtatgagtcaggagccctgcactcaaaggtattatggtctgttagggtataggaaatgggcctgagataagtatactaataaccccaataaattttaagcaccataagagaggtacagagctttgtgagatttaaagatgggacatttcatttaaagatgagtaaggtttcagcatgctgagatggtaagacttaaggaatagcatgagcagaggcactgaggtgtgaatgtggcaacacagccaaggaacagtcagtagtctagtgtgactaaaacaggactttaaagaagtgatggaaaatcaggctggaactgtaggttaaagagcctttaaagccaaggtaaagagttagtactcacgtaggtgatagggaacattggagatttttgagtggggaataatatggctggagctgtatttaaaaagataatacagcctggggtgatttgaagtcagcatagacaagtagtagggaaactaaggagaaagaagtgatctagagaggaagttataatgacttggaggcagggtggctgtgctgagaggagaaagtgggcatctcctgtgagatggtctaggaataccggaaccttttgaaaggtagattctgtagacacagtcatctacacagctgctcatgcctgaaacccaagaatcagctttgttgcctttcttcactcactccccacatcccagtcacccaatcctatcaatacaacctctggattgtgtctcagatccatctactattctccatcaccacagccactaaccatctgtcaccagcaccacccaagtagcctcctgactagtctctaattctgttcttgccccctcagtccactctccaaaagcagccagagtgatccgatcctgtgcctctcctgctcagaacccttcaggggcttccatacctggctggtaagcccctgcctgctgccccagcctcgtcccaagcaagctgacaaccttttagccacatggcctttgttcagttcctcaggaaaggcatgaaggcttccctacctcagagcctttgcacacg

SEQ ID NO: 68468 - DNA, 1145 bp, Homo sapiens
attttgggaggccaaggtgggcagatcgcttgaggtcaggagtttgagaccagcctggccaacatggtgaaaccccatctctcctaaaagtataaaaattagctgggcatggtggtgggcacctgtaatcccagctacttgggaggctgaggcaggagaatcacttgaaccctggaggtgaaggttgtagtgagccaagttagctctactgcactccagcctgggtgacagagcaagactctgtctccaaaaaaaaaaaaaaaattaataaaaaaatgagctgggcgtggtggctcatgccatgcctgtggtcccagctactcccgagattgaggtgggaggatcacttgggcctggaagtttgaggctacagtgagccgtggcaccactgcactccagcctgaaggatagagcaagaccctgtctcaaaaaaaaaaaaaaattgtattacattcattagttaggaaactgttggtttctcaacaataaattcagaatgtaacacaagtagcaaccagttataaggggcaatctgttaaatggagttagggctggaattaggacttggaattcaacttttgtttgttgacataaagaattcaacttttgtttgttgacataatcacatattgcctgtgcactcctgctgggctattgctgtgtactgtcacggggcatacagatgactaggaaattgttttctccatatcccactcctcttctctcatcttctctcattaccaccaatcatcaaagtaataaacacttggtgtaatgcatctaccacactcccgagcccccttgctcattctaccatttcccacaccctgccttcctatctcacataccctgttgccttcagtaattcatagtatttctcatttttagatcaacttggggcttcaacttgcctcctatcaggtatagctcatcatgtggacgggtaggattgtattcctagtaggcacagtttaaatacatacatataaatataaattgattaagcttgatgtgtgcgtggtaggagtgcattttggttgtaaatatgtttcccttacaaaggttattaccatttctgtgtattgtaacctagaaaccagtagcctttcagcagtggagttcctggttcttgaacccagctctct

SEQ ID NO: 68469 - DNA, 1014 bp, Homo sapiens
tcctgggagcatttcgaacggagttgaactgtcgccgggccacgggctcagacctttccaatggcagctctgggtcccgacgccaagccccgcccagccctgagcctccccgtgtgcattctcggcaggagtcacctttgccttacaaaccttcagacccgccctcttcctaccttgccgcgctaggccccgccctctgcgcaggtcggccaataacggggtgagctggcgccgcggggcgggcctccagccaatgcgcacgccgtgggcgggccccgagccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggtaaggaccctcctgcctccctccgcccctcgcggagtccccggggagtaggggaggaatggggacaggacctccctctcttcccggagccacccgggagggctgtgccgggtgcgggtgtgaatcctgaagcacaccaacagctactgagggaagacagaagtcctgtctcgagtctggggcgctgtgccctctgaacctcttcatctttctcttcaacccctgccatgccctctggcctctcagtcgggcccccgccctcttgtgccaggctctacccttgctcccacgacctgtctttatttgtcgctctgttgagttccactgtctggccatgtgtcctgctctgtcattaataaccaccccgcacacgcgcgcatctcatcggtaggcatagggcccctaactttagccctttcggccttttcagccccatattccatatttcatattctgagcgcctgttttgcttattgccagcttatattatactttcg

SEQ ID NO: 68470 - DNA, 1028 bp, Homo sapiens
caaagccttgtgagagaccctgatcctaaactacccatctcagccgcttctggattcctgacccacagaaactgtgtgaaatagtacatacttgctgttttaaacaaaatgtgggggtgactttttacaagcagacagataactgcaacatagtctcaaccttgaatttcattgcaaatgaccccatcctgaccataacctcaatattcgctaagtgggcagaagaatggggttggggggtgggggcagtagatgacttcgggcagtaaaaatgtgtccagtcacaaaaaggcatgactccatcctcagtgctcacagccctcccatcctagctctaagctagacccttccacgagtctagagagtgaagttcagaggcaggcagctgccccctttcccttcctctttgaggcccacccacctgagtcctgtctgaggactgcctctcccctaggtaattgttaaaaggaatgtccagcatcttcagatggtaccctgctcgtttcaaagttgtgtgaccttactctgtggcttcaaaaggacaaagacatcagaatacaactcaatgcacctcacgccattagacagcatgagtgacaagccgcagggaggatatatcagacagcaccagatcttagctggtaggaagctgattgacaagttctgtggaggacagagcagcagagccctgaagtccacagcaataaggggaagatggtgttctagacacaccagcagggaagagccaaacctggatggtcagtttgacctcccagggtaaggagcctctgggtcttctctacctctcccaggaccaccacagtgaaactagagccagagggttctttgctgaaaagagggtgagtgaggtggagagatgcagatgagaggaggctttatgcagaagccatcaggttgtgccatatctaaagcctggaaaaaggaggataccagctgataggatttggctctatgtccccaaccaaatctcatgtggaattgtaatccccacgtgttggaggaggggc

SEQ ID NO: 68471 - DNA, 1358 bp, Homo sapiens
gcgagcatatcccatcgcctttctacaccagcagagctccagcttcccctccattcatgcctcagtatgtgcccacacccctgccctacagatgagtcatagatggagggtctacctcaatgtgaatggaacagtttttcttccacgcaagtgtgcatatcccacacgattctgtcttgcatgcacttcttcaatgtacggtgcgtgtgcctattgtcgtgtggcctctccatcctctgttctatagaactgctgagagccagcatcttcctttccctctctgtacacagaacaacagcggtggcatcttccttgacccaggcaggtggcacaatgcagagctaaaggcaccgctcgaggagtcgtgtaacctcaggcgaattctttcacttctgtgtgcctgtgctccctcccaggcctggtcccgatccaccttctgtcttgtctttcccacctgctcctcctcttggattcctctcccttcccggctgttttcggaagaggctcgctcatatccttgacccagctgtaaggaaactattgtcacccttaatgaaactaaagcttatcctgctgggtcctcattggagcaagaacccacaggtgaaggggcagccaggtggcaaagcccccaccccagcctgtctccccaccactccttcttttctgagaagcacaggtgggacaaggtgggcctcttgaatgagggtttattaaagtcttggaggaaacaaaagggaaacagaacagagagttatactcaccttgattatctgaggcacaaatgcagcctcagccatgaacatattgaaggaagggatagtccagtatgtaacagacgcaccctgctattggcaagcaaagcacagatggagtgaatttaaagagtcctttactaaaggactttgtttcaggacgaaagtccacacagagcccacagggtgtgggagatctgagatctggaactgggatctctgggctctgaacttgttctgttgggcaatctgctgatggagaccttgtcttcgagtgtcaggatgcacactgtggtcagctccccctaggttgcaaagggcattctatctgggacttgtcttccctgcccatctgctctccttttcaacagcttcttggttcttttgaaacctatgctgtcttcccaaagccctacctcctattgtgttggcctcctgtaagccatgctttcatctgtccagtcctgctcttggtgggatgaacgagaggcctctacagatctcaaggtggaggaggagagggtcagagcccccaaaggtactctggatttgggtaaatgcacctgaaatacaaccatacccagcaaaaataacatcctgcta

SEQ ID NO: 68472 - DNA, 1129 bp, Homo sapiens
tacttcacccttcccagagggcacgcagcacggatctgtggatggaaggggctgtggaaacaggttatggcagagttggggggcggggtgacgcggtgccacccctcctggccgccctcaggtcccgctgacgtctctcttccccaccccctggcttctggcttctttctccccacgtccctcttctttcccaccccctccgtggctctccagcttcctccccagcccccgcagttcctcggctcccccaaaattgcagccaggggaaggagccttgaaactctccagccccgacgccccagtctcattggctccctcccccgctgcagcacctggtccccccccctcccagtcacctgattggccggcggccccatcaatcgttgcccggctgtgctgacgtcatcctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaaggtgagtgaggtgggggtgggggtaccgaaagaggggcgtcgggcagcgccgtgcggggtgggggtgggaaggaggtgtcgaggctccctggcacctgacaggtgtctggccctcttctgatcaccctccttcccatccgttctcagacctgctccgtctcctctctttctcttcccccagctacatcttcctttctggtccatctctacccatgcgtttctcttgctggtcatcttgctcccatttggtctccattcccgtcctggggtctctattctccccttcccctaatttctacacgctggtggctacctcgggtctgggaaggactgcccccgagccggtgataggcctctccccgcggctctccctttcactggcgc

SEQ ID NO: 68473 - DNA, 1020 bp, Homo sapiens
ggccaagagcaagggagggagggaaggtcctgggagtgatgagaaagtaagggaagataaaagtgggctcaaggaggggaatggtctccactgaagaatggagattgagtcaaggatgccagaaaaggacatggccaggcaagggttaaacacatcatgattttgtcagatctcaggtctggaggctctgggaggttgctgctcagggaagctgggcttagagttgcgtgtttgatcattaatgcttttgtgcctacaggagaagggacagggctttgggaggagaggtggagctggaccccaggtggggagactgagggtggggaaggagacacagcagcctcactcctccccttctcccctttgccaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaagtgaggaagtccttgtctcctgccccatgtgttgcagggtcctcctccctgctcccaagcccaccatcctctgtccgtgcggtcatcgaatatccacccccacccgctgctgttcctaggacttagggagccccatcccctgctgttcctaggatttagggactttcaggcaaggtgacagaaacgtatagtagagttcagtggatctaatcttggctttgcctctcatgaccttgggcagcctagcctttctggacttgcttttccttatctgtagaatggagattgtgatgacacctacttcataaggctgctgtgaagattcaaggagatggtttgtgttgaaagcatgcaccacagtgcctgatacacgttgaagggcacagtacatgggcataatgatgaggaggagagcaagaaggaagaggatgaacacactcagcatgcatccagt

SEQ ID NO: 68474 - DNA, 1275 bp, Homo sapiens
tctcctttttttctttctcaactcttctgctctttctctcctttccctttctctcagccttcgtccttttccatcctcctctcttctcacctcccgtcctgctcctgtgttcctaccctaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtattgccccatcctctagccctgttcttcccagcatgccccttgccccacccccttgccctacccctctacctctgctcccttcctctgccacctcctggccctgctctcagctgtatctgtgtctggggcccaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgagtgttgggtggggcagggcaaatcaccaagcagagccagacagtgtcacagctccttggcctaaggcgtcacctagagctaggcatacctcttttgttttatggatgaggagattgggccctcaaatggagacaattgaccactgaaggtcacatagcaatattggtagaagagtctggactatactcagatttctcaacaatcaatctgttactctttctaccaagtcacacatctagggtttccgggctttgatcttctctatgcctctgtgctgatacgtaaagtgggacacaggattgggagtggggagacctgacattaattctgactcaatgcgaattgcttggataacctcgggcaaatggtgagtcctggctgcttcacttgttttaatcttgcttcaccaagctcttgcaaggtcacgtacgatggcctaagtctgggggttggcagtcctaggccaaatctggcctgcccacctgttttgtagttttattggaacacagcagtgcccattcattgcatatgtctatggctactttcactgtgatggcagaactgtgggtagttgggacaaagatcatatggccccctcaaacagaactatctaatccttcatagaaaaagtttgctggccgggcacggtggctcacgcctgtaatcccagcactttgggaggccaaggcagatggatcacgaggagt

SEQ ID NO: 68475 - DNA, 1635 bp, Homo sapiens
agaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaagctctgtgaggcgcctcctgactgcctggtcctgtgtgggtgtggtggaggctctggggcctcaggggctgtttgggtctctgcacagagctgaagtgaggtgggcagggctggtgatcttgggggcctgaccaggtaagtccccaggatgccagatcacctggaaagtaagctgggggcagatggttcccacgcctcccttccttcagcaccccctggaaaagtacagaagattcagggaatgctatggacacctgggcagatgcccagtgccttgcaggggtgctgccaaccccgccccacaacttggaacattttgcctgtgcacatgggctccctgctgggcggccccagggagaaggcaggcaaccctgctgtttgtaccaaagggatctggagactgttcccaggctgaccctttcctgctagccaaggctcagacccaggggatgtctgcctgccttgcccatgtccttgtggctgcctcacatggctgcttagtggcctccgccctctccactcgggcccagcccctggcctgacagcaggcagagtctggcccttctgcagccttttgggccactagttctctgacccaggtcttacttaagccccaggtgataaaggatgataaccc

SEQ ID NO: 68476 - DNA, 1561 bp, Homo sapiens
tcagaagccctcacctctgattatttcttctggtgtaacctttcccggccctcctcttcaccctcagtgtttgatgcccaagtcttggcccatggttagcacatctccccatgtgactactgggcccatcgagatgttacctggggtgggggtatacatgggcaccagaggcctggggaagaccatgaattccttgtgccaccacatgccctgaacttctgctgtcactcgctgacttccctccctctctcaatctctgcctgtctctgacacacacactcgcacacacactaaacagggatcaggcttgaggcaggaggccagctccagtgacgcagggaaagggcagcaggcaggattctgcatgggtttttattttgttgctcaagatctcctggaaagatgtttcctaacctccctcaaagaagctggcaaagcctggggctatcaggcccggggcagggtttccaattcacctattcccaatttcatttgaaacagcaaacacatttgccttggcatcactcaaaccgttctttctgcaatggaaggctgttttcctctcaagtctactctccgcaatgacaattaattagcttctctaaaggtgcatgatgaaaagcatgccctcggggaaaagcgatgctctagaggcaactgggttaaccaccagttcaagaacaaagtgtgtccttcttcctgttaccaaaccagagtcctggaaactcgcttttgtgccgtcagagcagctggacacaaatgcactggcggtgggcagaggtgtggctctacccactttcaaagtctgcactccaccctgcagcctttgggctgatgcaccttcaccctgggggcttcactggggtgggcctagaaggtcacatgtgctcccagccttctaggtgctgtgggagatctcacgttcccttcagattttaggtccatgtcaggggctccccaaagtagatcccctatatccccagacctgtcccaactaggagctcttctttcaccagtccagaagagctggtgaaactttcagactctgaggtgtttccctgatttgtccataagtgtgaaatggagatgagtgtgtccattaggttcctcggtgcagtttcctaaactccccagcaacctgcggaggctctcagtgtgctccctctggcggcctcctgggagaacggaagaacgggaggaagggagacaggtgtggagagagatgggtgagcccgggcaggtgggcgcgtttgacaggcagagaggaggagctgacgcgccagcctccacggtgctggcgtcactgcctctcctgcggcaccacgctgcggagcacttaaaatacccacgtcctacaggaagaggacagatgaggctctaaatttagcgacagtgggtaggtggagggggaatgaagactccgggatgtggtggagctggcgttgtcagaaaaggagtaggaatcctgtatttcctgggtggggattctaattcataaggataagggagcttctgtcccaatatccgatctcagcgacctgactccagtttcagaagttct

SEQ ID NO: 68477 - DNA, 1031 bp, Homo sapiens
ttatccttcatttttaattacagcatttgtggttgatacaattgtatgggttagctatggctttatagataagtagattttgagatgaaagaaggttatactttttaagttcttattttaaaatctccactgttaagagtcaaaatcaagtttaaaaagaatgttgcagctcaattatttaaatttaaattttttatttggaagtacttagtttcactggaagttgaaaaaaaaaatgtataggaaggttctgtatacccttcacccagtctcctccagtggtaacattttacatagcagttatgcagagatcaaaaatcaagaagttgcccttgtttcaatcctcagagtttattaggtttcaccagttttacatgcccttatttgtgtgtgtgtgttttttgcaattttattaaatgtgtagatttgtgtaagcaccatcatgatcaagatacagaactattctctcaccacatgaagttcatttttttagcttaccttattttgtaatggaatccccccgtcttaaatcttctgggtcaaataattctccatcttgtgtttgctcagatctagagataaaacacatcttcagggttcttaaatttagacagcttcggttgacatggtatgtgaggttcatatgataatcgtgagagataaacctgcactttcatgggaaaagccatggatagcagtagcagaagataattggcaacagatcttttctggatgttggaggagaggctttggaataacagtctcattgtgatgttttctgcttttgttataggtttgccatgagcagactaatgataataactaacatttgttactgtattcattggttttcaccgcagcccctactgttatctctgctttaaagataaggacatggaaacttaagaaggttgagtaactagtctgaagatgcacagtgaataagtgatggagttaggatttaaatgtgggtagactgaccctacaacttgtattcttctccacagtgctgctatttagcagacacagaa

SEQ ID NO: 68478 - DNA, 1036 bp, Homo sapiens
aagctgaggtgggaggattgcttgggcccaggaggtcaagtctagcccgaggaacacagtaagaccttgtctttaaaaaaccaaaagcgcatgcatgtgtgcgtgcacacacacacacgcacacacatatatacacacatacacatatgtacacacgcatacatacacatacatgtgcacatacatgtatatacacacgtatacatatgtaaacatgtagatacatgcgtacacatgtatacacacacatagacatacatgtatacacacatacacatacacatgtatatacatacacacatacacgtatatatacatatcagctatatttgggaggaagggagttttcagacttttaaaatatatgtatataggtaaatatatatatatttttcaagaatcctaactatcctatatgacgttcataacttcatcttaaagttcataattttaccttgttcccttcttaattttgagcctgctactatcccatctgtatgcaaagatatgtttgggaaagggagagctagaaggatgtagctagtactttcacactcctgcccaaatgtccttctataatgcaaattggagtttgtaggttctcaacaggagaatggagttccctcacaggaactgtcattgtcatgggctaggagtggggagtagcatggggagggtgatggcagactaatgtgtaaaattagttcttacccgttccaggtatgatgaatatcatcctgaggaggatctgcagcacacggccagtgactttgtggccaaagtggatgaccccaaattggctaattctgaggtgagccacatccctctgctgctttgcccagcagagctggttttggaaggcaagaatcttgcttttcttaccccagtttagtttaaagagaaggagaagagatcttaggtctcttcgttcctgtctatagaacagagacttaagatcctgcctcttccttctagtgttcattccctcatctccttgcctactaactcttttttctgatgcctttgcaagtcttta

SEQ ID NO: 68479 - DNA, 1028 bp, Homo sapiens
gagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatgagttctgctggtcatgaagctgggatggcagaaggtgagttggcgtttggaggactgggattcaacagtttctgcctttcaaattctcactggtatattggttacctgctcatccctctaaaaatgatagagcacaggagacagggtccctgttctctgggcctctgggctagcaggagaaagagatgtcgataatcatgaatttttactcctgttactactacaaaggaaagtgtgcagtgccatataattgttaggttgttttgtattatgaattacatggaaggattttgatagtttttcagtgcttagggtttctaaagcttttcatctggctctgcctgcctttatcgggaactgtatcaagtgccatatcaagatgggtatttatcctgaggaaaaatttaaaaatatacacaaatatttatacttggagatagatgtttgtgggcacattagacttggaaaaaaaatttttttttttttgtttttt

SEQ ID NO: 68480 - DNA, 1011 bp, Homo sapiens
tcttttaggaagatcttttggcaacgggatctaggaggattgaaggaggaccacttgactgacaggaatggcattttgtaacagttgaggtgaaaaatgaaaagtactataacatatatagtgagaatggaggggagaggaaagacttttagagatacttaagaaaagctccagtgagttatggaagactgctggcttccttgggtaaaaacagtgggttgtttatattaatacaatggcagtggggaagatttagccttgtgcctatttcatttgagtgtgcggaattgtaagggaagagcttggtagtagaatgggatagaaacaatagcagggataaagacgaggtatgtttgcagcgcttggaaaaaacacacttacagcaagggaaattttattatgatagctgatccctaacctagggatctctgttttcagtttcctcaagaggagagaacttagtccaccaaattcaataccgggagatgaattcttgcctgaatgcagatgatctggacctaatgaattcctcaggtctgtgggttcttggagggtctattgcccaggggttcagatcagtggctgcagttgaggcacagacattctactttgataaacagttaaaaaagtctaaaaatgtaataggaagcttagatgcatataatggacaagaatgactgaaaattattcttggagaatatcaaaattgcaatcatagggaggcctttagcttaagaggcctgtgattattcctgatagaggtatggaaagaaccatgcagaggaatattatgacttggacctcattttattaaaacagaaattaatcttacaaaagattgtcataagtgacagtttaacttttttctttaaattttgttgtgtatatttaaggtatacaacatgattttatgggatgtatatagatagtaaaaagcttactaaagcaaagcaaatgaacacacccatcatctgacatagttacccttttttgtgttgttcttgtggcaag

SEQ ID NO: 68481 - DNA, 1688 bp, Homo sapiens
ccgccaccacgcctggctaatttttgtatttttagtagagacggggtttcaccatgttagccaggatagtctcgatctcctgacctcgtgatccgcccgcctcggcctcccaaagtgctgggattacaggcgtgagccgccgcacctggggaccctctggctttcaggaatagagaaacaaaccctcccaaatgacagggcttgtgtctttccctgcccttatattgtatatgtgggtgtctggcatttctattatataggtggatatgaagtaaatacatcattatgactctgacatgtctcttttcccatctaggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtaggatgtcagaaatgggaatagaaggagtgttcttagggtaaatcttttaataaaactacctatctggtttatgaccacttagatcgaaatgtcaatatacctgtgtttataatttgtcttcctgaaaaacccaccataattaacaatgcccatacttgcatgcgtgtgcacacacacacatcctggagccctaataatcatagttaatttctgttctaacatactcattatgcatatgacagtatggacactggcatttactgatggccgattatgggcaggcattatcctacgtgttactttacaaacatttcactgtctttgagggaagtattgttatttatgctttacagacaaagaagctgaggtttagagaagctaacaaattttcctaaggtcagcagctctccctggctctccctggcaaatctgatatgctaacagcattacattaaaaatatttgaggccgggtgtggtggctcacgcctgtaatcccagcactttgagaggctgaggtgggtggattatgaggtcagaagatcgag

SEQ ID NO: 68482 - DNA, 1077 bp, Homo sapiens
ggacaagcttggtctatgtagatgattaattacaagtctatgaattattcactgctctattcctagcacctatctcagcaccgtgcacataatagatgcttagtaactgtttgttaaatgaataaatgcatgtctccttttcactctgtctactgctgacaacctcacattgttgtagaatttatgtccatgcattggtaatctttgttctgtgaactttttcctggaagagtagagcaagagaagagaaaaaaaaattccctcttcacatccaatggcctttgaggagctgggaagagagcaattcacacttgattatcttacatcagataaattagcagcctctgaattgttgggcagtctggcagtggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctgtgccttatatcttgaagaaaattttccaggatcgcgaggcagcagcgaccactggggtctcccgagacttatgctacgtaaaggagctgggcgtccgcgggaatgtacttcgctttctcccagaccaaggtaaggaaatagagtgttatccagaaaaacatctggaactgggtggtgtgaagaaaggaaaggacaataggaaatgacaattactgatggccttgtgctggtatttttcatattttgtctcatttaattccagccacgatcctgagaggaagttagatattcttatcaagttcctaacagtaaggaaattaggctcagacagtaggtaacctgtaatctattcaagatcatacagctagtgtgtgagaacaaagtcaggatttgaaataggtttttgttttctgaatcaactgctttgtgcttcagttgagatgaaagaggtgagggaggaatcagagctcagtctcccaccctgcagcccatatatacacatcctgccgtcttccatgtggcaagcagggtat

SEQ ID NO: 68483 - DNA, 1473 bp, Homo sapiens
tgggccaccgcgcccggcctttttcttaatttttaaaaatattaaagttttatcccattcctgttgaaccatattcctgatttaaaagttggaaacgtggtgaacctagaagtatttgttgctgggtttgtcttcaggttctgttgctcggttttctagttccccacctagtctgggttactctgcagctacttttgcattacaatggccttggtgagactggtagacgggattaactgagaattcacaagggtgggtcagtagggggtgtgcccgccaggaggggtgggtctaaggtgatagagccttcattataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactggtaagaaagaaatttatccttgaaaggccaagttccttaagggaaaagagagaaggagagagggttaagggatcatttccctcttgagcaatgatggaccattactataaagaagtgttattatcaactaatcctctggaaacccctttttccattataacttggtggcacctgccctttgaactatgtcccaggtctcaggagtgtgcattgagttgaaggacacagaattcggcagttgaacagtgtgcagtaagtttgagaacctatgggcttaggcatggtggaaacaaaaatgtatcgttatagttaaatgaaggtgatgtgtacatcttcacatagtgctggacacatgtgaataaatagcagatttattgctaattagccagaagacctaacgtcatagctcagggatgagcatgattttgttttgccaaaaatggcatggcaaatcacgatgagatttctgtaatacataatttgggtaattctttctatgtcagtaacggctgtctcttctccattctctgggtttgtggatgttactgggcagctctgagtttgggagcacctcccatgtctaattctcctaagtcctgggaagcgttgacccaactttatggtaaagataattccagaaagtttaatctactgacagtcaaacagaatgtagctagaagtccagtttggcttcaaaacctgtgctagtactcatgcttctgactggtagctgcaaggggtgggggatactcgggatactcataaagccgctaccacttttttgaaaatcaatttt

SEQ ID NO: 68484 - DNA, 1004 bp, Homo sapiens
cctccatcctaattttaaaaaaaaggggtagcgccgctcagcaatgcattggccaccattatagatctctcccaacgcagtctattatgtacaaaatggagatactgataagacttcttggagtaatactatataaagcttgccaaagtgccagggctgcttaagaaattgcttcttattacttagatctggggttctgggaattatcaaagtactttgaaaacaatttttttaaaggatattttaatatttgaaaaattttagacaaaagtgtccttttatttgttcccaacagtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtaggcttgttttgtccttggaataaggtgaacaaaaattggactaatttgcatggctaagacctctgtggatgcatgtagatgtgtgtactatgtgtccgtacatcgcctcttgcaaataatttatgaagatgaaatgcttttgtaacttccttcacctctttctttccttaaatattctattatgtgaataattatgtcataatttaaccactttcttgcacagaccaatattgtgaaaatctttccaacgtttccttaataaaaaagaagtatctaactccacttaccagggtaggagaaaccctaactcacactggttctcattaaaataaaaactttttttttcctttttttctttctgccagcaactccagcttgttttgttttttatctgtgtgcattcaataaggccaatcattgtttattacttgttggccattttc

SEQ ID NO: 68485 - DNA, 1022 bp, Homo sapiens
ggaaacttcattctgttctttcctttcagtgatctttcaatcttgtccatccctgaaacacacaactccagtcacagacagttctggttgtccttgtaccctttctgttaatccctccttctctttcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcct

SEQ ID NO: 68486 - DNA, 3550 bp, Homo sapiens
ggggaccaacctgactatcatggtgaaaccctgtttctacaataaatacaaaaattaggccgggtgtcgtggctcatgactgtaatcccagtgagcgagatcacaccattgcggtagcacacacctgtagtcctagctactcagaagactgaggcaagagaatcacttaaacccaggaggtgttcatggtgagctgtgatcaaccttctgctctccagcctgggtgacagagcgagattccgtctcaaaaaaaaaaaaattcataaatagagatggagttgcccaggttagtctcaaactgctgggttccagtgatcctcccaccttgacctcccaaagtgctgggattatgggcgtgagccaccgcactcggcccagaaacacagattttaaaaataatactcaaaagtccaaaaatactcagtagacatttggaagcatctaactgtaatgaaatggaatgacagaaagaaaactagagagaactacagtaagttagcaatggaatcataagcgaatctgaagaaacctgttttcattaaatatggaagggttatagcttgaagcctattggaaatatgaatgtgaaggaaattgactttgtcaatgaccagatttttatatcaaccttccttttttctgtcctttctctagcactatttaggagcctacgtttttattatcttcaccggcttcctcattaccttcttggcttttaccttcttcaaagtccctgagacccgtggcaggacttttgaggatatcacacgggcctttgaagggcaggcacacggtgcagatagatctggaaaggacggcgtcatggagatgaacagcatcgagcctgctaaggagaccaccaccaatgtctaagtcgtgcctccttccacctccctcccggcatgggaaagccacctctccctcaacaagggagagacctcatcaggatgaacccaggacgcttctgaatgctgctacttaattcctttctcatcccacgcactccatgagcaccccaaggctgcggtttgttggatcttcaatggctttttaaattttatttcctggacatcctcttctgcttaggagagaccgagtgaacctaccttcatttcaggagggattggccgcttggcacatgacaactttgccagcttttcctcccttgggttctgatattgccgcactaggggatataggagaggaaaagtaaggtgcagttcccccaacctcagacttaccaggaagcagatacatatgagtgtggaagccggagggtgtttatgtaagagcaccttcctcacttccatacagctctacgtggcaaattaacttgagttttatttattttatcctctggtttaattacataattttttttttttaactttaagtttcaggatacatgtgccgaatgtgcaggtttgttacataggtatatatatgccatgatggaaatatttatttttttaagcgtaattttgccaaataataaaaacagaaggaaattgagattagagggaggtgtttaaagagaggttatagagtagaagatttgatgctggagaggttaaggtgcaataagaatttagggagaaatgttgttcattattggagggtaaatgatgtggtgcctgaggtctgtacgttacctcttaacaatttctgtccttcagatggaaactctttaacttctcgtaaaagtcatatacctatataataaagctactgatttcctttggagcttttttctttaagataatagtttacatgtagtagtacttgaaatctaggattattaactaatatgggcattgtagttaatgatggttgatgggttctaattttggatggagtccagggaagagaaagtgatttctagaaagcctgttcccctcactggatgaaataactccttcttgtagtagtctcattacttttgaagtaatcccgccacctatctcgtgggagagccatccaaataagaaacctaaaataattggttcttggtagagattcattatttttccactttgttctttaggagattttaggtgttgattttctgttgtattttaactcatacctttaaaggaattccccaaagaatgtttatagcaaacttggaatttgtaacctcagctctgggagaggatttttttctgagcgattattatctaaagtgtgttgttgctttaggctcacggcacgcttgcgtatgtctgttaccatgtcactgtggtcctatgccgaatgccctcaggggacttgaatctttccaataaaccaggtttagacagtatgagtcaatgtgcagtgtagcccacacttgagaggatgaatgtatgtgcactgtcactttgctctgggtggaagtacgttattgttgacttattttctctgtgtttgttcctacagcccctttttcatatgttgctcagtctccctttcccttcttggtgcttacacatctcagaccctttagccaaacccttgtcagtgacagtattttggttcttagttctcactgttccctctgctcctggagcctttgaataaaaatgcacgtagctgaggccggatgcggtggctcacgcctgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaatgcacatagctatcaagtgtgctttagcttgaaaaggtgaccttgcaacttcatgtcaacttctggctcctcaaacagtaggttggcagtaaggcagggtcccatttctcactgagaagattgtgaatatttccatatggattttctattgttactctggttctttgttttaaaataaaaattctgaatgtacacgacattatgggcttatttactttttgtccttcctgtaaccacaaaatgagctctaaatcctgacttggctactcagtgcctgttgactttgagacttgtatgagaccctcatactcatgagactgtgttcttagagtctcatacataagagaatagcaatatgtgtttattatgtagattaaatgaaaaagctttcgtggccaggcgcggtggctcacgcctgtaatcccagcactttgggaggccaaggcgggtggatcccctgaggtcggaagttcaagaccagcgtgaccaacatggagaaactccgtctctactaaaaatacaaaaattagctgggcatgatggcgcattcctgtaatcccagctacttgggaaggctgaggcaggcaaatcgcttaaacctgggaggcggaggttgcggtgagcagagatcgcgccattgtactccaccctgggcaacaagagcgaaactccgtctcaaaagaaaacagct

SEQ ID NO: 68487 - DNA, 1200 bp, Homo sapiens
tgctgcctcagcctcccaggtagctgggattataggcacgtgccaccacgctcagctaatttttgtacttcttagtagagactgtgtttcaccatgttagccaggctggtctccaactcttgacctcagataatccacctgccttggcgtgagccacagctcctggccaaaaaaaaaatttttttttaattaggcaggtgtggtggcacatgcttcaagtccaagcgatttgagaggctgaggtgggaggattgcttatgcccaggagatcgatgatgcagtgagctattgtagtgccactgccctccagcatgggcaacagagtaagaccctgtctcaaaaaataaaaataaaaataaatccaagccttttgactccacagccactctttgtattgtacgtcagggacaggaggagcttgccgttaattgcttctgggaacctagatactaggttacactgtctttaaatttaattttctctgttccttgctcttacaggataactataatgggatgagctttgtctgtattggggctatcttggtctttgtagccttctttgaaattggaccaggccccattccctggtttattgtggccgaactcttcagccagggcccccgcccagctgcgatggcagtggccggctgctccaactggacctccaacttcctagtcggattgctcttcccctccgctgctgtaagtaaactcaccttatcttaaaaccagcctatgtaagctgacatgaagatactccttaataatacagtagtctgggcctggcatggtggctcatgcctgtaatcctagcactgtgggaggctgaggcgggtggatcacctgaggtcaggagttcaagaccagcctggccaacatggtgaaattcaaaaattagctgggcatggtggtgcatgcctgtaattccagctacttgggagatcgaggaaggagaatcgcttaaacctgggaggtggaggttgcagcgagctgagatcgcgttactgcactctagcctgctcgatggaagcaagactccatccctaaataaataaaaaaatacagcagtccctcctcttcttcagtttcagttacctgtagtctaaaaatattaaatggaaaattgcagaaataaataattcataaagtttaatttgcggccagacacagtggctcaagcctgtaattccagcacttt

SEQ ID NO: 68488 - DNA, 1103 bp, Homo sapiens
gggccttttatgcagacttaattggttctccatgattgaagcatggacaactgttctgacctgtgattggacaaaaagggaatgatctgaacccagctgggcctgtctgcttagatgatttgttggcctctctgtagcgtttcttcctctagggtgtggggcaggaccctctctgaaatgagggttttatgacccacagtcagattagcgtcctgccaagtgggagggcaggagaaagtcagagaagaattctgttatctgaggcctgctcctgaggcctgaagcatcccaacattatgacaaaagactctaccaagggctatggggattttgagccaggacctgtgaatggcacacaatatgtatgtatataaaatcataaatcacaggaggggtatccataacaagtgtcctgctgttggtaaggcagatttcaagtagctcagatgctgttttcatggaaaggaaaactgaagtttcatgtcatattcttcttccagctatttctggtggaaagggcaggaagaaggactctgcatatgataggccttggagggatggctttttgttccacgctcatgactgtttctttgttattaaaggtaggtgctctttgggtgaaaaaaaagggagggggaaagaagagaggttacagttgacttctgtgacacaaggggtgggttgttaaggttgcagtttgtcaataaagtcagaggagagaagcaggatgcccagagtttaagaaacatgggtcgtcagagaactggaggtaaactgttagaatccttacatttatagaacattattatagcttataaaataaattatctaatttaattcttagaataatatcaaggtaatcacacttaatagatgatgacatggtctcagtacaaagtgacatatatgagatcatatagatgggattgaaaaattcaatcctcagctgggcgcggtggctcacgcctgtaatcccagcacactgggagggtgaggcaggcggatcacctgatgtcgagagttcaagaccagcctgaccaacatggagaaaccccgtctctattaaaaatagaaaattagccaggagtggtggtgcatgcctc

SEQ ID NO: 68489 - DNA, 1098 bp, Homo sapiens
aacaatgtaaatgagtagctagaattaagaacatttagagagagaaaggagggccaggtgcggtggctcatgcctgtaatcctagcactttgggaggccaaggcgagcaggtcacttgaggtcaggagtacgagaccagcctggccaacaaggtgaaaacccatctctacttaaactacaaaaattagctgcgtgtggttgcaggcacctgtagtccagctactcaggaggctgaggcaggagaatcgcttgaatctgggaggtggaggtagcagtgagctgagattgtgccactgcactcctgcctgggtgacagatccagactaggagataagatacagaagataattcatttgcagaagggatattagtattgaacgaaaacctagaaaaaggacttcttacccactgggacttttaagtttatttttgagggttctgtgtaactggtgtgcagaattgcatcaaagctgcatgttttcttttctcctaggtgttctattactcaacaggaatcttcaaggatgcaggtgttcaagagcccatctatgccaccatcggcgcgggtgtggttaatactatcttcactgtagtttctgtaagttggatggtttggtaattttgaggggagaaaagaatccttgctacagatgttcaaagatggattgcatgaccctaccatcatttagttacctttttgttgcttaattttcctttgggaaaaagagataaatttaatgttggatgtagtcttcactcttcaagcaaatatgggatggatgggaaaggagggagtatagaagggactatatagtatgctttgaacttggaattggaggaaaggtgcttggaaaaactctcaagctctgttactccactgtttttacactaaaacaacaataatcaacagaagttatctgtgatccccagaatatgtgagaatttttccccgtgaggtgtgcaatcagttccgtagtggacaccatctaggtgtcctgcgattttttaattatgacactgtctacctggagatagcatcagatctcacaggttggtggcccagttcccaagactgccccccactcctgatgccagtca

SEQ ID NO: 68490 - DNA, 2888 bp, Homo sapiens
ctactaaaaatacaaaaaattagccgggcgtggtggcatgcgcctgcaatcccagctgcttggaagctgaggcaggagaatctcttgagcctgggaggcgcaggttgcagtgagccgagatcctgccactgcactccagcctgggtgacagaccaagactccgtctccaaaaaaaaaaaaaaaaaatgccaattagatattctagaaatgcaattggaattcacatttaaaaatcggtaaagcaacctgttttacttgattatgttgttcttttgtttttttaccccccaagaaagagggtcttgctctgtcacccgggctggagtgtaatggcccaatcatagctcactacagcttcgacctccgacctcagctccctgagtgcctgggactacaggcgggcaccatcacacctggttcccaactagaaatgttctgataatagaaagtgaaaaacaaaagttagattaaaaaaaaaagggatgatatgagcctggagaagaacagaataatgaggacagaggagaagttaggagcctctcactttgctaattctactttgtctttgattaaccttacaggcgcaattcaatgctgattgtcaacctgttggctgtcactggtggctgctttatgggactgtgtaaagtagctaagtcggttgaaatgctgatcctgggtcgcttggttattggcctcttctgcggactctgcacaggttttgtgcccatgtacattggagagatctcgcctactgccctgcggggtgcctttggcactctcaaccagctgggcatcgttgttggaattctggtggcccaggtactctagaacttctcatacttaatgagtgttagtttcatgggtcattaaaaaagttaacataggtaaagcactgaagaatatctggcacatgttcaattacatatggaagttttagataatagatagtagctgaagaagcaggctgaggccgggcgctgtggctcacgcctgtaatcccagcactttgggaggccgaggtgggcagatcacgaggtcagcagatgaagaccagcctggctaacatggtgaaaccccatctctactaaaaacacaaaaaattggtcgggcgtggtagcgggcacctgtagtcccagctactccggaggctgaggcgggagaatggcgtgaacccggtaggcagagtttgcagtgagccgagattgtgccactgatctccagcctgggtgacagagcaagactccgtctcaaaaaaaaaaaaaaaaaaaaaaccatgctgagtagagaaaggaaaagaaacacaatttgtttattttttcacatggtaaaagaatgtatgattttctgaactttttgtgttttaatgaacttgtggcctgtgaagtatggggtttatagcattatctttgtgtggtttctagatctttggtctggaattcatccttgggtctgaagagctatggccgctgctactgggttttaccatccttcctgctatcctacaaagtgcagcccttccattttgccctgaaagtcccagatttttgctcattaacagaaaagaagaggagaatgctaagcagagtgagtatccttcacaccttactacatgaattatatggttgtggtttgttttagggatgattgtactggacctactttctgttacactctttccctgcctctcagaatccaagtgaggagggttctgattactcctgagtaaaattttcagcccctaaagaatgaggtgaaaaggcgggtttaggaatggatgctatcaggcagggtgtgatggctcatgcctgtaatccagcattataagaggccgaggcgggtcacctgaggtcaggagttcaagacctgcctgaaacaacatggagaaaccctgtctctactaaaaatacaaaattagccgggcatgggggcgcatgcctgtaatcccagctacttgggaggctgaggcaggagaatcgtgtgaacccgggaagtggaggttgcagggagctgagatcatgccattgcactccagcctgggcaacaaaagtgaaactctgtctcaaaaaaaaaaaaaggaatggatgctacccatcacctcacctcgtgcggccctttcctggctgccttacaggaagaatgaatttggggcagcacattctcttttatcctttcctctttcttcttttcaccagtcctccagcggttgtggggcacccaggatgtatcccaagacatccaggagatgaaagatgagagtgcaaggatgtcacaagaaaagcaagtcaccgtgctagagctctttagagtgtccagctaccgacagcccatcatcatttccattgtgctccagctctctcagcagctctctgggatcaatgctgtgagtgtgatactttagggtcaaacgtgtcttaaagtatttcacttaaaatgccgggcatggtggcggtgtgcctctgtagtcccagctactcaggaggctgaggtaagaggatcacttgagctcaggagtttcaggttgcagtgagctataattatgccactgcattccagcctgggagacagagtgagactgtgtctctgaaatttaaaaaaaggaaaaaaaaaaaagaccctggaaggacactggcaacttcagagtgaactgactttaccagtctgtttttacaactagtatagcgagcatggtagtttaaagagggcatgatagatgatagtttaaagagggcggcacaacggaagctagcatttggcaggtagcccttgtattccatgcaaatatcagcttcctgcatttgactgtggattgtaggaagagagtattcctgtgccttctagtcaatatggatattaagagcacccttgtcccacctttttaaatactg

SEQ ID NO: 68491 - DNA, 1918 bp, Homo sapiens
agataagagactcaaagagccacccagcagtgaagacacaaactaccaccccctccaccaccaccagtgggcttccgtggagtctggggtacagatcagactgcactgtatttgtttccagaatggtcaattcttagtaatcctacccgagactgtctttttctctgccctcccagttcgtgagtggaattctatgcctacatttgcctgatgcaagtttttaaatatttccaaactgaccaacccagtttctcttaacttcttccttccccaattttctttcatttttaccaagttaacttcacattcttatctccagataagttctttagtataatctattcctttgtcttccccattaattacctaaatctcattggatgttcttttcataccactcataactcaaattctcctaatacagctccataattaataagaaacagtcatcaatcacaagttttaaggactattctctcctctgtcttccctccctccaggtcaccccagctctgatatttgccatcacagttgctacaatcggctctttccaatttggctacaacactggggtcatcaatgctcctgagaaggtgagtgccaggccacaataattagaatttagaatagggaagttattcctttaagtagggtttcaggaattcagaatttaaggccaggcatggtggcatctgcctggagtcccagctactcctgaggctgaggcttaaagatcacttgagtccaggagttaaacaccatcctgagcaacacagttagtgagggtccctccccaaactaggggattttaagacaaactttgtatctatcctgtccaagactgaagatggagacaatattggtggggaaaattagtggggtcatctaatcgaagcacaaagctcacttactcccggaacgctgggcggtgctgttcttcctcccactctttcacctcatagtgatgcacatcctgtattatcccttaggggttagttacaaagaagctgggttcccttagcagagggctggggtagactgtgaacatcggtgctgccacctactgggattttcaggacaaatagaattactattccagcgagagttaacataaattccaatacgttatctgccccttccattcctgtctatttattcccttgattctctaggaaggaaatgatccctaatgtttgtcttttgttctcatccaactgtaacagtctgttcttccaccaacccttttattttgcagatcataaaggaatttatcaataaaactttgacggacaagggaaatgccccaccctctgaggtgctgctcacgtctctctggtccttgtctgtggccatattttccgtcgggggtatgatcggctccttttccgtcggactcttcgtcaaccgctttggcaggtattgactagaaactgggcaaggaagtgggctctaccagccacattgaggacaagtgtggagagttagggcagggaggtgatgatgcctttgaataagaacaccttgaattctaatcaagggaaacctagtccaactggccccgaatatgactgcccttgcttggagctctactaccctggagagctcccacccagctgtgcaagagatgaactgtgagtgattggcctttgcagtccagctagggatagttcagaattattccctagtaaactcaactatggggtttctagaaacatacttaatttacaaggtccgaagttgtttacttgtattataaatgtttttattattttacccaggattggtaggaattatttttgtctatggcaaatgtggataatgacaaaaaaaaagtcttattctatagaagcttaacaatatgttttagaaggtagaatatattttcatttatgactaatgaaggaactgttttaatttg

SEQ ID NO: 68492 - DNA, 1054 bp, Homo sapiens
tgagacggagtctcgctctaacgcccaggctggagtgcagtggcacgatctcggctgtgcatggtggcaagctctgcctcctgggttcatgccattctcctgcctcagcctcccaagtagctgggactacaggtgcccaccaccacgcctggctaatgttttgtattttttttttttagtagagacggggtttcactgtgttagccaggatggtcttgatctcctgacctcgtgatccacccgccttggcctcccaaagtgctgggattacaggcatgagccaccgcgcctggccttgaccgtctcaattctcacctatgtctgtgcctattgtttttaccttcgtcttttatttttctttctgcacccttttgtttctgcttctgtcactgcttctctctaccagctggctttctatgacgatgccattcccatagcaacctctctctggggaagaatgaggggaaggaaaagagagagctagaatagatgggctaagagaagccagattggagttggaaggtgaccttttggattgagtcctagaacagagtacagagaaactatgaagactgataccagccaagttacactaaaccctaagaaaacacaaattgggagcccaaatccagtccctgctggcaaaactcattcagcaaatcctttctgttgtaaattaacctgtcatctattttccccttctctgtgattcagattattctttctttctgtttttagatctcatgattctttttttttttttttttttttttgagacagagttttgctcttgttgcccaggctggagtgcaatggtgtgatctcggctcaccgcaacctccgcctcccaggttcaagcaattctcctgcctcagcctcccaagtagctgggattacaagcatgcaccaccttgcctggcttattttgtatttttagtagagacagggtttctccatgtgggtcaggctggtctcgaactcctcacctcaggtcatccacctgcctcggcctcccaaagtgctgggattacaggcgtgagccactgcgcccagc

SEQ ID NO: 68493 - DNA, 1856 bp, Homo sapiens
ccattgtactccagcctgggagacaagagctccttgtcaaaaaacactccgtctcaaaaaaaaaaggagagagaaagtgcttcctgagaggaaccaaagccttcctatgagttatgctttgaattctagcgagaaatcctgttttctttccttgtttcctcctgcgtatattcaaaataaatgagtttcccaaacagttgagtgtcagataggtgaggtatttcagccttttgcacaggatctcattggagattttctgagatgtcttgctgaaatcaaggtgcgtggtgtctgtctaaggcagtggttctcaaacagtggtgatttgctcccagtggacatttggcaatacctggagatatttttgttgtcatgattacaggaaagggattacaagcttctagtggggaggggccagggattctgctaaccattctgtaatgcatgggacaagcctctgtaacaaagaattgtctggctccaaatgtcagtaatatccatatttaggactatggtatttctctgattttattaactttatgggaaaaagttagaaaagttttaaacttaatgaaataattctgcttccaactaatcactgctctctctctctttttttttttttttttttgagacagagttttgctcttgttacccaggccggagtgcaatggcaccatctcggctcaccgcaacctctgcctcccaggttcaagcaagcctcccaaatagctgggattacaggcatgtgccaccacgcccaggtaatttcgtatttttagtagagatggggtttctccatattggtcaggctggtcttgaactccgttcctcaggtgatccgcccgcctcggcctcccaaattgctgggattagaggtgtgagccaccgtgcccggcctatcactgctctcttcttgcatacaaatcatctgttaataatctttctagactttagtaggaaaataatgaagcactgtttcttttccacttttttaaaatggaaaagtttacatttttctgtcatcattctcaatctccataattttttcaatattaacagtgcccgatgattaaatttggacacaatgttcatatactgttatttaaagaaaaattatattcttaccatatcccattgcctttttggccttttgtttctcttccccatgtttattcatttgttacagttgtaaggtttttcttgaggaggtaagtaatcccacttttcttctgtcatctctaaaaactaagtaaatacaatacaatttaaactagaagctctgttcttatcttttaggacccctagtgagacatgtagctattttggaatgaggctatactaatcatgttgactagctacttattagtgagagagaagggggcagaagtcactgtcctgtcaccaggtagataagaatgtgggagacaaagaatgatgctgtctctgcacgtcctccacgtggggacattggaatcttttcctggggctgtggcatttcttttgtattgactgcagctgtcaggatcaaagaagaactaatgagacagaagtaaatagcttcattctcaggctacctgagaggagcaatgtctgatggagattaaaagatgaaaggggagaaaaattctttctcagccacacccagatacaactaagtcactcttttcacatgcttctgattcttcaaattctatgttaccacttagaatctagtggcaaaaaaaaaccttttcctaatgcttttttccttattacgtttttattatttttaagatagagaacagtgatgtttcctgatctcaatgcttttatatttagagctagaggtttattcagtcagccagtcatttatt

SEQ ID NO: 68494 - DNA, 1005 bp, Homo sapiens
ttatgacagcaagatcacctaatccaatccctgctcatttcgcagatcgggaaactgctagttggtgacagaaacgactcaaaatacaggagagacgtttttaccttaccttcagctgtctctccccagaacccttatttgataaaatgcttctcacaagctactgaatgagtgagtggaatgagctttgttggagatcccagaattgagtcattctaaaacatcattagaattatatgaagtttcactttattccacaaggatttgttagagtgcccattggccagaggtctaaatcacagccttttccctcaaggagcttaagtagatgcagtgaatgaataactagccaattacaacttacaggacacagtaccttgaagagaaattggagagggagtcaattcctaggatagcagagagatggacaacagacagaatgtgagtattaaaactgatgtcagatatcaaattggtttgtcagggttatgttgataatcacagtacctatcatcttcctaaacttttcttgtcttgataatgtgtaatatacgtaagtggtggtgggagagactattgcagccactagacttggtatattcccaaattatttttattcataagtaattactatttgccatttgtggccttttgtgctttaatattatcaagaacaataagaatgataaaatatttatgatcagcattgtaattgcaaacaggcctcagtaaaaattatacacaacttgttttgagcgaatttccttgaaaagaaccatggctatataggtgtgaagagtaacatagcgtaatatatgaatatacacaataatagctattcttttttttttttttttttttgagacagagtcttgctcctgtcgcccaggctggaatgcagtggcgtgatcttggctcactgcaacctctgcctcccaagttcaggcgattctcctgcctcagcctcccaagtggctgggactacaggtgcatgccaccacgttg

SEQ ID NO: 68495 - DNA, 1384 bp, Homo sapiens
ggaacgagggaaacttacgacttttgctaacgatcgcggcgtgctgtgtatctcctgtgccagttctgtctccccaagaccccaccccaagatgggccccatggcccacgtacccggcccccagtttcagtaggacgtgtccttatccctgaggtcctccagaaaggaacccaaccccaatggcccgtgcttcacacgctcctccccgcgccggtggagtagggggcaggagagacctgctgcctctggcgccaacctttccattcagtgcgtctttcctgcctagcccacgttcccgggccggagctgacacgggggtgggaggagccgagtgcttgctcgtcttgggcagaggcgaaagcttcttaaggtggaacaggaatgttgggctgctgggcctctaccgctgggatgtgccggcccctgcttcccaacctcgcctcccagtttttcatctcttgttccctggctccagtctaatttttaggggagtggaaatcaaacaggctgggaagaggatagaaaaataacgtagaaaagctgggcgcggtggctcacgcctgtaatcccagcactttgggaggccaagacgggcggatcacgaggtcaggagatcgagaccaccctggctaacacggtgaaaacccgtctctactaaaaatacaaaaaattagccgggcgtggtggcaggcgcctgtagtcccagctactcgggaggctgaggcaggagaatggcgtgaacccgggaggcggagcttgcagtgagtcgagatcgtgccaccgcactccagcctgggcgacaagagcgaaaactccgtctcaaaaaaaaaaaaaaaaaaaaaaggaaagttaacgtagaaaactgtaaataataaacagttatgtaaaggaaatacaaactatacagataacttcacctttatgatttaatatcttgcgttctattccccccattactttttattttttcaattcccatagagtcaatggtgaccccattatcttttaaagtagcagttagaatttttctgatggtgcaaatgtaagctcatattttgtctgataaatattactaaatgaatcgtttctatgttggtttagtttctctctaatagacctgactagagtcattaaaagaggtcagaactctgtgtctagtggcggcaggctaccccctactccgttgatcacaggtccccaggaatctggaagagtggagatgcggtcttggctgtggttcagttgtctcatttgtaaatgggaataacatttccccacctcgtaggtttagtgtcaatcctaaaagacctagtgtaaatgaaaacattgtaatctgaaaggtgtaaacagacattaggtagtattacacatacaaagcatataa

SEQ ID NO: 68496 - DNA, 1399 bp, Homo sapiens
gggtggaagagtgagactctattacacacacacacacacacacacacacacacacaaataaataaatggttagaaaacagttttccaacctataaaactatttttttttaaaaaaaaattcttcactaccctcttcccttagctaaatcaatattaacctctataatgcgtttcagtgtaatgaaagaataatggactttaaagttaggcattattacttactgtgttatcctttccatcatttagagagaaagagaggtatgacaggcttttcatgcctatttcacatatctactataaggacataataagatgtacatttggaatcttactgtgaatcatcatagtggttttttatttatatatatataaagttttattactaaggtaaatgaaaatttgtaaggtaagttaaaagtattgtcagaggacaagcaaaatcaagagttctttagattaggtcttggagtaggaaaggaactaaggctcaaggctgagggaatctgctgccatgaatatccatttacttacagaatttgttaagtatcggacactagatacacaagagaaataaggaactcatccaagaaaaacacatttaatagacttgttcctaattttttttttttttttttagagacagggtctcaccctgttgctcaggctggagtgcagtggggcgatcatagctcactgcaacctcaaattcttaggctcaggcagtcctcctgccttggcctcccaaagtgctggttataggcgtgagccacggtgcctggctgttcctaatatttttaatagcccatttacatgagctcttggtggcatgattataataagtaataactcattaatataatagatgaggaactttagagctctctaatctggatcagatttaggtacttgagggtctttgagggcagggaatcaagagggaagagaatgggaaggacttattttacagatcctgttcaaaacctgtgctaattttcactttcattttcctcctttcagctttttacctctcatcttgttaaactcattcttgttcaaatataccttgtggttgcttttttagtctttaagtattagtctttggtttcttagaagatgaattattaataacttttactttgctaatctgttttccatactcctggcaaaacaaatcacaaatacaatgttttgtaaaattcatcataaataatcttagttgttgttcaagttgattataacacgttttataaatttctgatgttttcatggccgtttgtatctccagcccagatgtctttcttgaactcgtctcatatattttactgcctactctacatctcttgaaaatctactagacatctcaaactcagcatatttaaaactgaatccctgatccttc

SEQ ID NO: 68497 - DNA, 1330 bp, Homo sapiens
accataaccagctaatttttgtatttttagaagacggggtttcaccgtgttggccagactggtctcaaactcctgacctcaagtgatccacccaccttggcctcccaaagtgctgggattacaggcttgagccaccatgctcggccagaattttattttttattgcttttattcgtgcttttccatctttttaatgatgcttattggactccaaagtcctcaagtagtagcattgtcttttacttgctttggactgtatgtaacatgaggcatctaaatagatcatgaattattcttgttgattaataggtagaaagaataggcaatccaggatagggaaatagaaatacagtcaaagattgtgggtgggcgttagtaaattaaggacatgtgcctgaggcttcctcttttcctgtcctagggcctctgactggaaattagaccagcctgattggactggtcgcctccgaatcacttcaaaagggaagactgcctatatcaaactcgaggataaagtttcaggtaatctttgcgggtgaccctctaacattaagaatattaatttggtgtgcttttataagtaccttcaatttggggactggaatggaaatactacttgttaattggggttctggattttggcttgctttactcaaaaaagtctttctcttatctgtcaggggagctctttgctcaggcaccagtagaacaatatcctggtattgctgtggagacggtgacagattctagccgctactttgtaatccggatccaggatggtactggtaagagaactgggattttgagtggaacgaagttaggaaaacaggtgaatgcacagccatgaaaagtgtttccgattgcatttatctttctttggtttacttcattttttcttccctttctctaaagttgctctagttgctaaaggaaaagtattaacatgttatttgtaatagataagcacgagttcaagatgtggtaattcatatgtagacttaaataaatgaaaaacacatatctaacaaatgaattaacacatttggcactttaggaggccgaggtgggtggatcacctgaggtcaggagtttgaggccagcctgaccaatatgatgaaaccctgtcgctactgaaaataaaaaattagccaggcgtggtggcaggtgcctgtaatcccggctactcgggtggctgagacaggagaatcacttgaattggggaagtggaggttgccgagatcacgccattgcactccagcctgggcaacaagagcaaaactccatctcaaaaaaaaaaaaaagaatgaacactttttgcccgtttattgtt

SEQ ID NO: 68498 - DNA, 1781 bp, Homo sapiens
tgacagatcatcaggcatcagattctcatagggagctcataacctagatccctcacatgtgcagttcacagtagggttcacacccctctgagaatctaatgctgccactgatctgacaggaggcggagctcaggtggtcatgcaagtgacggggagcggctgtaaatacaatgaagctttgctctctcgtgtgcaactcacctcctgctgcatggcctggtttctaacaggccacagactggtgccgggggttgggggctcctgccatagaggatacttcctagtcgagtcttcctacgttttccacagggcgcagtgctttcattggcattggcttcacagatcggggagatgccttcgactttaatgtctccttgcaggatcacttcaagtgagtgaagcttgtccttagttacgaggctgaatgcttataggaatgctgcttctcacatgaatgggcagtatctcttttcctcctggtttctttgtttcttaaactatttcattgtgaatataaatctccccattcacttttgtttccttaggtcatctttgtatctattctgtttcctttccttatagcctgcaatatatttcagatcccttgtgcagtagtttgaaatgatgctctgtcgaatttgccccgtcttttaggtggtagagggaggcctatggtaacagcagggctttatgtggggagtcgtgtgccactcttgttaccttatgtagctgacatgttttgtgacttttgcaacatttctttagcccacttgattttggtgcagctgtggttgacagcactgtgcacactgtcagcttcctacctcaagagcaagcatatctctccttttctgccttaggactctctgaagttatagaaagctaagagcaagctttaacttggaaagactaagaaactaacaccccctcaggagcagccctcaactgtggggaatgggaattggtggctaaataccatccttctggaaggggcaattctaatacgtattccgtgagatttctcagagagtccccagtggaattgaaccccagttgttttctttcttggcttttttcccttctgtttctcactcttttttatctctcactgtgttttctggaatctcatttcataaaagtaaatacacccaaatttgtatgtcagactctgctttcaggaaatctcaaactaagataacttgctgtgttcccaaaggtgggtaaagcaggaatctgagatttccaaggaatctcaagaaatggatgctcgtcctaagttggatctgggcttcaaggaaggacaaaccatcaagttgtgtatcggggtgagtatggtttttaaaaattttgttttcctgtgcttccataagcctatgacatctttctcttgctcttctttttttcttttgtagaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcaggtaaatctagtacttctaattttgagaaatccaatcttatgttttaattaagcaacacctgtttgtcaaggagagttaatgtttttgctatgaaatagctcatggtactgacaaggtgattctgtcagcttctagcaaggaatcaaagcttttctagtgaactaagagtcatagtatctcatagg

SEQ ID NO: 68499 - DNA, 2029 bp, Homo sapiens
tggccttgaacttctggacttcagtgatcctcctgccttggccccctaaaatgctgggattacaggtgtgagccactgcatctggccagttctttgcagttttgtcatgtgtaggttcatggatccaccatcatttcaggttatagaacagtttaatcactacaaagatcccctgtgtcaaccttacacaaccacacccatctccctctcatcctttcttcccccattcctaacgcttggcaatcaccagtctgttctccatctttataattttgtcacttcaggaatgttctatgaaaggaatcatacagcatgtaacctttgggacaggcttttcccactcagcataattcccttgagattcattcaagttgtgtgtcaatagtctgtttctttttattgctgaatagtattccatggtatggatataccagtgtgtgtaactattgcccatggaatgacatctaggttgtttacagtttttgaccattatgaataaagctgccgtggcatttgtatacagatttttgtgcaaacataaattctcatctccaagattttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccttccaagattttgattatgtttttcttttttcttttcttaccttgtgtttagatatccttttagatttggattctcctgctcctgtcacgacaccagcaccaactccagtttctgtaagcaatgacttgtggggagacttcagcactgcctccaggtaatgggcatagtgaaactagcatactctcaatcagggtgtaggagatatgtacagtcaattgaaatctttgatctggagaagcaatggatatgcaggtcacatagagtcttttggaagagttctagtgaaggaaatatagtagtgctgggaatggggggacaaaaaagctgtaggatgaggtttgagtgggatatttcaggcctttgtaagtagaattgccatgaagtgtggttttggaaattctaggcagtgatttcttagaaactattaagtaaagaatggagttgttatcctaatattatgtctctggctttctctgttctcctgtcttgcagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgt

SEQ ID NO: 68500 - DNA, 1349 bp, Homo sapiens
tccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtgtctcttttatcttttaatttgcttatttgattaccttttaaatttaattgaccaaatataagtggaccagtagttaataaaggatatttatatcactctttattaagaaataaggcttttaagaagttgagactagacctctgtgttcatggttctaaaatgacagagcactctgtgtaatcaatgaatattcattatttattttctggtacagttaatttaatttgcttcaaattatcttcatgatctaggccacctcttatatcttaactgtaatcagcagaaatgaaagggatcagtataagagaaataactaaggtcagaaccacagac

SEQ ID NO: 68501 - DNA, 1063 bp, Homo sapiens
aaaagacaatgtgaacaatgaacaaaaacttttaaagtataccttgtgtgtacatggcatgtgaagacacagcaacctttgttttcgagttgaggaagagatgatagagcagttaattaaatcccaagaactttctaggtgagcaaaaagagttgtgttaaggcaaagacaaagaaaatgtaagattctgtgataaagacaccatcagggtccctgacttcatttatagcactgttagggagtgaatgtctgtatctcctcaaaattcattggtggaagcactaccctccaacgtaatggcatttggaggtcaaaagtttgggaggtaattaggtttaatatgaggtcatgagaatggggtcctcatgatggaattataagaagagacccggctaacgagctgtttacttcctgcgggtgctcaggctgtggccatcttccttgctgttgctcttctcattggagaagatggccctggagacggtgctgaaggacctgtggcatctgtgggcctgtttgctgtgttcactggtcaaggtactatagaccagtttgaatatgatggttgtgactattgagatgcatatctacagatgaagggtaactgagagatgctatatggctgcaccagctcctcctttgatggaatcattgcgatgatgagtccagaggacagctgggtctccaactggcagcgagtcaataactttaagccaggtgtatatgcggtgtcaaccactggtcgcttgccctaaggaatcgtgcgggagctgaaaagttgaggagtggcctacaaatccaaagacacagctataaagaccagacgcagggctgccagcgtctttgctctccacctcctgcctctgcttattttttgttctggaactaaatgggcagagcttcaaatgcttcctaccctccaattcagactcagccaactgttgagagaacagcacatcattttatcattttaccttatttggacttcaggtgggggtgggagggatttgggttggtggattaacagatggaattgaggagagagtaggatgctgactttcct

SEQ ID NO: 68502 - DNA, 1079 bp, Homo sapiens
tcagcggaatggatcccccgattagcgggggctgggccggggaggggaccggcccgagcgcgcccggggtccggggctagttgaggccggtggtcgccgctccgcggagtcggtggggagcgaggcggggcccggccttcgcgcgtgtgccgggaggcgccggcccgtggcgtgtgcgtgcgaccgggcgagccgtgtcgagggggcggcgacttcgggcgtgtaaggagtatggtttccccgccggcgagggggtgtggtaaccccgggaacgccggctggagtcggacccgcgggctgctgacctgtcctcgggattgcggcgacactccccctccccccccttcccacaaattctatggagcgaccgcgggaggaggatcacgtggtgcggtcccgcagctactgtattcgattccacgttttcctccttacgtgtaaattttagagagtgtgacagtcattccatcttttcctttgacagtctctgaatgagaaggggatgaccaaataattgcttgtccagttttgattctttaaaaatttgagcatgatgtaaatattacactacttgcccctcacccccccccaaaaaaaacccaaaccagagtggtaataatttcaatctccccttattaatatgtccttatctctgatcacacatttgttatttcactgttttatcccatttgtattggcgaatagcgatggggtggtaattctgttctgtgaggggttattgcactaaccatgctcaatgcaactgctatgtaaattctttcagtatgctgtcattttcccattagttatatatattgttaccacatctttgtggagttaggttcaactctaaataggtatagaaagtatatgggcagcctactatgcagatttttttttgtgggcttggtatgttcattatatttatgggtgttcttaattattaactataaccatttaaattgaaatgtttttaaatctcatttttgttactttcacaatattgggtaccttaaaggtcatttcttctattttaaaaaatgatttcttaaaagcaattatgagaatacttttaagat

SEQ ID NO: 68503 - DNA, 1032 bp, Homo sapiens
tgcacaatgtgcaggttagttacatatgtatacatgtgacatgctggtgcgctgcacccactaactcatcatctagcattaggtatatctcccaatgctatccctcccccctcccccaaacattttaagggcatttttacaattccttcatcaaggggagctggggatattctacgtcaggtattctggcgtgactttttcttttgtggagctttgctttctgagaccttcccaagtggcctggaaggcactgtgtggctataacttttttctaatgagcatagtatgtctttgggtacagcgtctggtcagggacacactgtggccttccctatgattgtccgcagggaagagaccgaaatgcaacccataaaaaaagtcgttccatcaggttgaattgacagtgcaggtttgcactgtacctttcccatactgtggttaaaatggaaatctcttttcaagaaaagtttcataggagaaaaagtttatcagaaacactctgtttaaggaggagggaggataaggtttactgcctgtaatatgcatggaatatcctgctgtagggaagccatagtgtttatatatttttcattttaatgagcctggtccttatcttcttttttgtgcgcgtgagacggaatttctctcttgttgcccaggctggagtgcaatagcgtgatctcggctcactgcaacctttccgccttctggaagaaattagctaggtatggtggcacatgctacttgggaggctgaggcaggataatcacttgaacccgggaagcggaggttccagcaagcctagatcacaccattgccctccagcctgggtgacaagagtgaaactctatctcaaaataaataaataaataaaaataaaaagttattaaatattcagaactgctaaccctagagcatccgacattaagttagcatagttccttcctagcatgtgtgtaagctgagttactaccataatccagtttagataccctgcttgtttaacagagacttaggcctttgaggcagtgg

SEQ ID NO: 68504 - DNA, 1151 bp, Homo sapiens
aatgtaaaattaaccacagatacaaaaatatacttaagcggggtttctagtgatgggaaagatggaaatatattgattggcatttcatttcatatcaagaacagaatgttgagggaggagataaaacaaaaagtcagtgatcagattaaagtatattcctagacaatatataatattgggaagggtatttaaactttctgctaagtgacgagctacagttattaagttgcagtgccagtttccccaaggaaaaatggagaaatcatatttctgaagaggtggtcagtttccatattactagtgtataaaaattttagtttgaatgaaaaggaaacaatatctctacacgtgttttttcctgtttatataattagtatataatcacggcatttatttgtatgaaatccagaaatcaagtagatttcttgatttaccttttatgtatattttttcttccatctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtaagtctgtatactaagtgatcttttggatttttacctagaatatgatgaatctgcatgttttaggaataattaggacagaggaattcttagccttgtcattactaagtatcttctaattataaggtctaatatattttatgaaagtaatataaacactaatatttattaactttattaggaaacagttgtgagggaaattaaaggtgaccttcaaaacagataaacaataaaacaaagtaggcgcatatctgtagttccagaggctaaggtgggaggatcacttgaacccacaagttcgagtccagcctgggcaacattgtaagacacagtttcttaaaaataaaagtaaagatgattctcaagttcctttcatttttactgtcttctatttttaaaataccttgtttataaggtgctgctaaggaaatttgtatctttggaggttctttgatta

SEQ ID NO: 68505 - DNA, 1150 bp, Homo sapiens
cgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacac

SEQ ID NO: 68506 - DNA, 1043 bp, Homo sapiens
ccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactt

SEQ ID NO: 68507 - DNA, 4427 bp, Homo sapiens
cctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccaggttcactgactgcttgcttgctttctttttttttttttttttttttttttcttcttaaaaaaacaaaacaaagtttcatttaaaatacatttaggcacctttggagcttggattttggaatgtttcagtagtggacagaaatctgctgttggaatcttctagtcttccaggtttaatttgaaatgtttttagttttgttttggatttttgtgtggtattttatttcctttataccaatgccattttgccatgctgttttggggtggctgcctaactctagtgaaaattctttctatattaatgaaagtttggcctttgaagatccttaatgttttgcattttttacattgtttttaaagaaatattctaactgcttgcactgttactgttctttaccagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtaatttaactctttctcctttctttccatcactaggctaactttctttttttaaaacttcctttctttacgtactttaaaaagtaaccatgggtttgtcataattctcacttaaaaataatgcataaatgtatctagcaaataatatgattaaagaagagcttttgggggtaaagtttgacttggttatgatatactcaagacttgggaattttgtttagccatttagatgactccatttcttgcatatatgtctataattaagtatttcagagtgtgaattttttggctttgtttttgttttgggtttgtttgtttcttccattgtgctactctggcttaagctttttcaggggttggtgttccgaatacacagtgagctcacagtataaagacatcaattaggagttgacaggtatggaaaactagagttttgaaaggtaaaattaggctctaggttatatatatggtaaaaactcaacatagcattcattttaccttagtgcttctctctgtgactttataaaagtgaaagggaatagtaagacgaagataatacaaaaaaatttagttcttttaggagcaatgtgatttcagaactaatcgttttagcatttctaagatactagttctaacaaggagatgtgagcagtttgagattatcagaaaatcatggtttaaaccttcaaaaattacaggtttgaacagataggaggacatttctgaagcacaagatggctaagcacattaaccaaggacataaaatgtcagggataggactacaactcgtccattttaatagcctttctgttaggtaataaactaaactatcctctcctccgtctttaccccagtctacctacccattcttcctttctcctatacttcctaaagttttagttctgagcttttattattttgggatattgtcatctttctaataggtagaattttagtgaaagtaatcaggaccttttcaagatagacttctgcataatttcatcctgtggctttggacgtactatccaaagaggctgtacatccagcaagtcactagttagtgaataggaattcttggcgtgtaatgccatttcttgtagctgaaggaagacatgtgataagtgattaacctgttctgtgcttcagttgactcttataaggacagtcattccctttaagcatcttaagacaaaaatatttatctgttgaattggaatttactaacagagggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgagatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggtaagttatctttaactaagaatgtgtttttagtctgatagcaatgttatataaattatatgattggtactatggcatgtaatcataaatgcctgtaggtccttgccttaacgttgaatttgacctcactggtaaactgtcattctttactttgaataataactaatagtatgtaaaattaggatttttctcctcagcatgttggtatatgtgacctttaattatggcaaaattatgtggacagtaaatctgaatgtttttaatttgcaagataaataaaatatgcattgttaatcattttatacaaataaaaggttctggccacgtactgtggctcacgcctgtaatcctaacactttgggagactgaggagagtggatcacctgaggtcaggagttcaaaactagcctggcaaacatggagaaaccccatctctactaaaaatacaaaaataagctggac

SEQ ID NO: 68508 - DNA, 1032 bp, Homo sapiens
tactaagagccagagccttccctggggtagtcttccaaagctctgccatgatcaaggaaacaatatatactgtggaaaaggtaggaaaagggaaccaagactattacaagttgcatgtcatatatctgctacaaccttgcagcccatttaaataatccaatcatgagtttgtgtgtatgaatatatacatatatgcacacatatatgtacatacatgcacatatatacatgtatatatacctacatatgtatacacacacatatatataatcacatactgtgtatatggatgccatatatatatatgaaaactacttttcttacaagtgtacatacatatacatacatatatatgtatgtatatacatgccttgtgtgtgtgtgtgtatacacgccatgatgcccattttaccagttttttaaattataacgttaggtcccctcacagctagataaatgaagaaaacagaagtaacttactaactgattggtgccctccatgggactgaacccagatagcatcttcacttccacaatagccatattggaagagctacggctccccacataactgagagcaggaagaagaaaacacatgtgagcctattacttcagtgcactctgcatccccaacacacacacacacacacgtacacacacacatacacagacacacacacacacaagtgtcccagctcagctcctatgaccaggtgctctgccggccaccagcaccccagctttaatcacctggtgtgaatagtgagagtcaaggatcgaggtgaagtcggttgctcacatctagcttttcctatttccacactaagactaaaggtcttcatatttgtgggagggagaatattgtatctcaacaccgtctggtaggaagaaataggtagccaaatcagacttggaaagaactttaaagattgtacagttcaaactacttttcttacaagtgagaaagaaagagagagagaaggcctaaggggaagatgctctccgactctccttcccaatgtccgctcattc

SEQ ID NO: 68509 - DNA, 4707 bp, Homo sapiens
caagcttccacggtttagcacatagtagacgctctataaatatttattgaatgttgaacgatgagagagtaattaaaaaccggtaagttgatatcataaatacaacgacaacggctcccctatcaaatgtttagtgttcccagagacagccccattgttctacatctcgttatactctggccttttcccgtttttgtcattcgaactcatatacatattgaaatcgaagcacacacaaatccctgaaatgacaaacttaaatgctatccaaaggaagttacattaggttgctgctttgaaaatgaagtcaactcctaatgggttagctgtttctgcagcattctttcccgccttcttggagttgaggtgagggattaaacaatcaaccttctctctcctttctctcattctcaaagtttttctcgccttttccttcctttcctttgcttcatttcttttcccagtctatcgtttctctaggggtcgttgctttgctctttctccctctctgtctgttggtccctttgatcctttctttctaccccttattcccagcagctccagaaaataccttctttctccccgtctcacgtcacttccctcccttctcccatctccctctcctctccgagaggtgcgttccccactagaggccagcactttcttagtttcgtccttccaaccggcgagcagaactcggagagaaagaagggggtaaaaaagaggagaaagagagcaagagaggaaaaaacccctgggcctggagcgcagaggcccgggagctgcgtcgccatggcaacgggcgccggcaggaaacgagggacgcgcgggagggagggggcggagggcgccgaggggaggcggagggacggcggggggggggtccggctgccccggaagcacctccccgcagccccctcctccagcccggcccgcagcccctggcctgcggcccccaccttctcggccgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggtaaccgggcgaccgagggccggggaggggcaggacctctgggggcttggctgcgcggggatgtatcctcagccacctccatctgtgtaacgccccaggtacctcccccagttgctttccctgcctacctccggcgctgagctctgcggtccttcggctctgcctgtccgagtcttctggctattcattctgctgcgcttcatgctgtctgtccgtcaccctagctgcctctgactgctcattttcttattcatttttccttctctgactttggtccttccagccgagcatgctgtctagttatctccctgctttcgtggtccgctgggttcctcagcctccagttccttgacttctgcctctgctctctgtatgcacatgtcccagctcacttgggtcagttcattcccggcgcaccactggatccacccccttcccccagtgtatttgatttctctttgaaacatcattttcatcaaggttctatatagaacgaggacccttgggcgtctactccctgttctcttgattattaccgtgtctttggcacagtcttccctgaaccacccccttctcccgtcccccttcctatgtcccatcctttctgcatgataagagtttcgtgcttagggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccattttttatatttaatcttgtagtcataatgttgatcacaaatgaatacatttatgtgcccgggatccaggaatcctggttttggtggcagtttcccttgattttattgagacttttaagttggtccctttacatttttatttctagttcacaatccaaaaaaaattattaatcagaattcaggtttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtaatatacatgtttgcagtgacatttgctagtcctaaatgaaactaaagactggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcagtgttttcatatgtgtctttttgcaaatgtaagtgtagtccccagtgggtaaattctgacatgttagtagattataaagttgcatcttactttcttgaagattttcattgtgtgtatttctatgtttcatactccggagtcatttcttaaaatgatatattacattcagtatgaagcctcctttgcagtgaggaaacaggtataaggaaggaaagcaacatgcctgaggtgttattagtagcctgagctggaaccaggcagctatttgggctatgtgggctgtaggtgagctcttctgcttcctagttttatgaccttccatgacccactgaatgtgtctgtatcttaaggtcctcctccataaaatgaggataactactcactatcatagtgaatgacactgccttaattacagtttggtttgaagaagcatgtgttagtccaaagacttgatacttactagggcaacttctttaacctcagaaaaccttatgtctcaaattgtagaatgaggataacagtgttgactttacagcactactatgagagagatacagcataggtgaagtgcctagcccagtgaaaggaggcaactagtggctctccagtatatggtgactcatttggatgataacgatgcagatggagacaaaaatgagataaccaaaacttttaagtggaaagattttaaactgttaaaaaatgctatgggaatgtaaggtaactttggtattgtaaggtgccatctcacattctggccgttttatttaatgacagccatgagggaatacgtaaaggttgtttcttttgagactgcatagcttcaaaagatggtagtattgggaagacatggttgcaagagtgtattgaagatttgggagttttaagatgagaaatcatggcttatggaagaggaggaagattcttagatacttatggatttcctgtgtttttgaataataacatgagataacagcttgggatcaagatataaattttaaccttttactgcttccctctaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggtgagactcagctctgaggggccatggtctgtgagtcttggcttgtggtaggcagtgatgctggaaaataattgtactcagttctttttcaacaaactggggagagttgggttagatgatgactaagctgtcttccagctctgagaatcttaggagtttacaaatgtttaggcaagcaaacagtgaaatctggtctttcaaataaggatttaaaaaacacattcagtccatctagctagattctaactaaccctttctcatactggattgccaggtttttaatctttggccattcttgtaaatccccttgagtaatagaagtatcatggaactctttagagatttatttttaaacaaacagcaaattccatgtttttattaattctgttaggaaatgaggtcttttagcaaatattttggttactagaataactatacatatcataaaaatagttctaattattaaagaataagaatacagtaaagtccagttagcacta

SEQ ID NO: 68510 - DNA, 4252 bp, Homo sapiens
tcaccatgttggccaggctggtcttgaactcccgacctcaggtgatctgccctcctaggcctcccaaagtgctgggattacaggcaggagccaccacgcctggctcagaaagatctcttgaggccaggagttcaagaccagcctgggtaacatagcaagaccccatctctaaaaataaaaaaaattagctggacatggtggtgcatacctatagtcctagctacttgggaggttgaggcagtcaggaggattatttgagcctaggagtttgaggttacagtaaactatgatcacgccactgtgctccagcctggtgatagagcaggttgactttgctctaaaaaaatgaaggaaaatcagccgttgacgatttagcccaaactcccatctcctctggtttctgtccttcccatggccccctttcacacaaatacagtgatttacatagaataggagctaggagtggtccattctaaatgttttatcctctcttttcctaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggtgggtaggggagattttttgggcatatagcatcctatactaagccaggctgcagacagcctcctccgcctcctgtccttctgtgggaggatggatgcatcttagcttctggggttgcagtaagaaccgtaaaatcactttttaggtatagagtggctgtgttatagacctgcattgtctaataacgtagtcactagccacatatcgctattgagtgcttgaaatgtggctagtctaaatggagacgtcctataagattttagagttagactacttagtacaaaaaaaggtaaaatatcagtaatttaaaaatattaattacatgtgaagtgatattttatattgggctaaataaaataaattatgaaagttaacttttcctgttttactttttaaaactttgcatagtagaaaattataaatgtggttcatattatatttatattggatacctctggactagacttttactgactcatgatatgacctgaccaaaagatctttttctagctgggcgtggtggcttacgcctgtaatgccagcactttgggaggctgaggcaggtggatcacttgaggtcaggagttcaagaccagcctggcctatatggtgaaactcattctttactaaaaatacaaaaattagctgggcgtggtggtgtgcacctgtgatcctagctactctggaggctgaggcaggagaatcgctcaaacctgggaggcggaggttgcagtgagcggagatcatgccactgcactccagcctgggtgaaagagcgagactccttctcaaaaaaaataccatctttttccacctaaaagagagtgggagctggaggacaagttgcctctctgccccaggagggttatgtggggctaattggttagcatatgtggtaatgtgaggatcactggactagtgaatatacttttctttaccctaaagtggaatctccctgtttataatgtgaaatctctatgttttgtgcttgtgatttattactagaagactgagagctttttccttcactgtctttgctatttcttgtttcccttcccctttaataggccacaattgctgccagtcggcaggccagctccccaaacaccagcactacacagcagcagactaccaccacccaggcctcggtgagtacgccctctcccactgagaggcttctctacctgggtctttgtctctgggttaaattactttgtgccgctgatctgagagtgtttattgagccgtcagtggatagttactgcttttaagtagagaatagtagtacaaggggaaagtaaccaacattaatctatattggagtctctaaagaggaagtctaaggaagagaggaaagaaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaaagtgaaatactctgttcttgactgtgtgactctgaatttgtcagtcacgtacctttccttttacttctcccaaatccttagtcctggttcctttctgtaccacacagatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacgggtaagccacagatgcagtcaccattgccccagaggcataattgtctggccctggcaaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcgcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgacgtgtgactcttggacatcaatctgtagttttctatgcattctaggttttcttctggatggttcattacatgtggagaatatgaggctcctgggttggtgtggaagaggcagggctcagctgtttaatatcttctgtttattttgtcttgtggtccttcctttccatctcttctgtctcttctttccctcttgtcctctttgctcttcctcttcctctccttgccagccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttagtggcgatgactttacctgtgggtgggcactgggcaggatgaagggaatgaccacggacctgggtccacccttctgccccattacacttttcagaattcttactttttgtgttttgtttttccttcccttaatcaccatagaacttgaatcccatataacctttgagttaatctgagttagaaagacaaggagatttgcctgaaaatagtcttgtggatctgggaagtcttattttcaagatagggtaaatttcctcaccatccttctagtcctctgtgggtttgttttattcggagagtcttaattctctcatagtactgtcagaagagaagagattgttgagagaattcttctgttagttagatgtaaagctgacctggctgagttactggaggaatgtttggttgcttctgtttgtgagttactctagttctcaactttcagtcttctcttcctgttcactgttttttcccagtaaaggtcttcctcaccattacttctcatgacttattcccaaaatacatgtatttttgagcctggaattttagcttcttatagatgggacacaacctaggatcttacgataattatttcatccttttagtttatttatcagtaagctggtaaatgttgagttcttccttcatgtacttttggccctccctgtttatgggtttcatacctgtaggttctgcatctctggcttccacatct

SEQ ID NO: 68511 - DNA, 1926 bp, Homo sapiens
agacaatgaaagtgctaaattaggctgggcatggtggctcactcttgtaatctcagcactttgggaggctgaggagggtggatcacctgaggtcaggagttcaagaccagcctgaccaatatggtgaaaccctgtctctactaaaaatacaaaaattagccgggcatggtggtgtgtgcctgtagttccacctacagggaggttgagacagaagaattgcttgaatctgggaggtggaggttgcagtgagctgagatcgtgccactacactccagcctgggcgacagagtgagactccgtctccaaaacaaaaagaaagtgctaaactaaatggtgctaactttgagtgacacatgagtttggaaaagaattggttacattactttgcaatgccttattgggatacttgagcagagtcttggacgagtggatttgatttggagtgagaagaaaactagagagagaacagcaagcgtaagagtatagtcatatatttaaatacgagtatgtgtggtaggcgttggagatgaggggataaataaaatagaatcaacaggcatgatgatagaagaggtcattgctggggtagagcatataaaggaggttgtagttaacttcataggtcacagggatcattgctagctattgaacagcagattaacaagatgaggaaagtacttaggaagaactatagggagaataactgttctaacagttcctggagaagagaagttagggaacttgctaagaaactcttgtggtcatctagctgtaaggcaagtctttgttttagactctggtgatagcaatgggagccacgagtgaggttggttccatttccatatccagttctttgatttatccgctcattcattcatcagatatttgagtgtcaatatgtggaggaacagagggcagtagttaaaaatacgcatctgatgggtcagattccagctccactacttactgtgtgaccctgtgcaaatgatctgacatctttctgttatcgtttttttcatctgtaaaataggtattgtaatatacctacctcaggatgtgttgtgaggactaagtgagttgctgcgtttgactgcttgaagaatgcctggacgtagtgagtgtttaggagaaactactgctattaatatatcaaacattccttagcgttggatgcccaagaaagtcacgatcactgcatttgtggagctcacagaccattgaaacaccagacattaaactgatagtcacctgaatggggaaataattgagaaagtaccgagtgttctgagaatttagaaagggacctaacttagctttggcatggggtgtaaaagtcaaggaggtgacatttaacttggggtgtgtagaagttagccagataagaatgtggaaggagagtgttggaggcaggagaacagtgtgtccaaaggtcctgaggagggcaggaacttgatttgttagaggaattaaaagtcttgtattcttggagtttggcatagtggggctagacgggtaggaggaaccttatctttcagggctttgggggctgtgtttaggattttgggctttttataaaaagcaattggaagctatagaaggattttaaatatggaagtgtcatagagagatttggatgtatttttgttttgttttgctttttaaataccatgttgatttcctctttggagactaaacggatatggtgtgagtgtgactgtagggagaataactgttctaacagtttaagggacagacgatgttcatactgggggtagcaatggagatggacagaaatgcatagatttgaggataacttagaagaatcattgaagagggtgaactaatttagtagatgggggaattaaaggagatgccagataggaaatctgtggggtggctggtggtgctgtttatgagacgaagaat

SEQ ID NO: 68512 - DNA, 1100 bp, Homo sapiens
aaacatacaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaaacattagctgggcgtggtggcacatccctgtaatcccagttacttgggaggctgaggcaggagaatcacttgaacctgggaggcggaggttgcagtgagccgagatcgcgccgttgtactccagcctgggcaacgagggcgaaactccatcttaaaaaaaaaaatgtttggggagatagtacaggttgaggagaggaacgtttaatatggggccctgaggtaggatgaacccccactttggaaaagcagttcaaggtcgacagagggtcgtgggctgacagaggcgaatgggaaagagcagcagataggaaaatctggactgtagtgtcacgaaggcaagggaaccaaatgttacaagatgtgcatgtgtgcatgcgcgcatgcgtgggcagggggcatctctttctaatgtagagagagaaagaaagatggttttattaacagggagggagagttgtttcagttgtttggggggtggtgaatccaaagtagtatgagtttgaggggtgtgaatggctggtgggaatgaatacagtgactgtaaacagctattaagagtttagcagcaccaggaaaggaaggtggaactggggaggggaatgtgcagttcctacatggtgatgagggagccagtggagaagaagtggaagaggaggcagtggatattatatgctgcttgagatggcaggaggaggtggaatatagagtgcagagaaggactgattgccttttgataggaagaggagagaagggggaaatgatgggtgtgtatgcagataaatgtatagattc

SEQ ID NO: 68513 - DNA, 1636 bp, Homo sapiens
tggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtactagatttctacatggtcttcttcacttcagtcttaacctacttgtagttcttttccacattactatcaggaaacttttactatgtttttttaaataagaaaatatatgttgttactactaattttttaatcgtacttctggtacacagaatttgataaaattgtaatccttggatcatgacactctctcactgttggtctcgtcataacctgttaaaatttatttactctgtaatttttaataatgtaataagcagtgtgcagttccgtctactgccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcttcaacaattatcgacacatgaccaatgcattcaggcccttctctgcctgtggaatattttgaagcaaaccccagacaccatgtatatattttaattgtattgaaatgtgtaaggtactcgtgctgtatgtacacttttggagagtgctttcttaataacattgtcacgatccatttgttttgttgcagtcattggagtttattaattgtagtttctatatactattccattgtatgaatatactatagtttattcatcttctcttctgtagatggccctttgagttgattccaggtcgtggttgctaatgaataatgccaccatgaacattcctacacatgcctcctgtggtacatggcaagagtttgtcttgtggaattcctgggttagagggtgtgtgaatgttcaactttaggatatgataacaaatattttctaaaataggaagtgtattgatttatacttcaatcagaaatgtataaatgtataagtgaatgtttattttgattaataagctttattggcttcctataatcagttaagcagacatcattctttccctttatccatattttggagtactgactatgtgccggaactgtgaaggtgctagcaatataacaatgaataagacagataaacttgctgttcccaaactaaagttcagattccttgtttcaatacaccaggcccttactggcccagcaccttcctacctccttatccacagcctgccttccttgctttatttctttccattccttgtaactctccccaaacataatgaaatatttataatttctaaaaatacagtctttttagaaattatacattttttttaataatattttaaaataatgtctttttttttttttctggacagggtctcactctgttacccaggctggagtgcagtggcgtgatctcagc

SEQ ID NO: 68514 - DNA, 1547 bp, Homo sapiens
tgtatttttttgtagaggcagtgttgcccaggctgttctcgaactcctgaactcaagcagtctgtccgtcttggcctcccaaagtgttgggattacaggcatgagtcatagcgcccagcctaaataataatccttttttggttctggccttgcaaatgctgttatcaatatctttaaacccccaccttcaccattacctactgagtgtcacatcagtatcacttgttttaggaagcccttccttgatctccctagtcttagttgatattccttctctgtactcctatggtactgggtgcatatctatacatcttattatgtcataagtgataattttcttgtcttctgtagtagaaagtaatcattaagagcagagactgtgtctttcctctgcatttccagtatccagtgtagtacctgaagcatagtaggtttttgggaggtgctgaatgattgaatggcgaggaaagggataattgaagagatattttgaaggaataaaagaccacacttgatgataaacttgctagtgagtgaagatggctgaagaatcagatacagagccagagttcctccttaggaggtaggaaggccttaaagtatatggtaaaggcagagatacgagctgaggtattctgtggaatacgacacaatagcagtcctggctgcttttgaatctttaaccttaatgcctccagtcctccttttctcaatctgttttttcgtatctttcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcaggtaaattgtcattcctcatgtcattattctctcagaattcatgtgaaattttcctttttttctttttttgcctttttttctttgcctttttgttttttccccgcttctgttggtccttgaatagtggaaggaatgggaataatatcagccttgaacatattagttcagggtcaggaggacaagtgacagatacagattttatctgtttctaccaggcagtagtcagcttacaagttcccctgtccgctttcttaggctgtgagttcttcagttttatcactctgtctattcattcatcacatcttactgaattgcttac

SEQ ID NO: 68515 - DNA, 4097 bp, Homo sapiens
caaaaattagccgggcgtagtggtttacacctgtagtcccagctgctcgggaggctgaagcaggagagtagcttgaacccggttggcagaggttgcagtgagctgggatcacaccactgcactccagcctgggtgacagggcaagactctgatagtttatacttgctttcagactgcgggtaagatgtagttagatgtgtgtatcttatttggtcatgttgatttttgcctttttttgtttctagtaccttagttgttgatgtatttagataatttactcacaaaaaaattaagagttagttattactatacttggtatttatatactctagcagttctatttctaaattgctttatcatcacatgctttgatctctggacaatctggtacaatatggagaagtagagtttgtcactcccagtttacagtggaggaaactgagttaggtcagagctgacaggtgctgactctcaagactcagatggtggtctaagctgatgatttgtaaaatccaagtcatttgtgggaagacgttgacatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaagggagttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttagaatgattattattctctgctcttttttctctctgttgtattctgggattgttcctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaataggggaataaagagttaagagggttaatattggtatttatctgcttcttctgtaagagagtgacacattatataatatctgaactttatactcctaaatttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggaggtgagtaactgacttctaatgctgttggagagcacacagagtagaggaatgttctgagtgagctaaaagataaaactggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgagggcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagacataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaa

SEQ ID NO: 68516 - DNA, 2507 bp, Homo sapiens
tttgagaccagcctgagcaacatagtgaaaccttgtctctacaaaaaaatataaaaattaactgggcattgtggcacatgcttgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttatatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcaagggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcatagctgatattttatgtctccctccttgcttttattcccttccccaaatcagctcataagcagaaattcacatttagagcagggtggtcttctgtggcactattgacatcctatatatgccctgtcctgtaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccggacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaagtgctgcttatttcacatatgataagatgagtttttcttctacgcccaacccagggtggtttgggaagaaagagagaggaataaacctttgacactgacctcattggtttgctcttttcccctatagggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggtactgaccctctcttcaacagaacccaggttgttttccttaacatcatcccacaggggccttgataagagggaaagtaattgacttttaagcagtaggagcttgaatgctaatatagaggctctactcctaatattcaagttgacttcctaatttttttctgggttgacattatcttctgtaatgtcagcaattttacagtgtttgattctcatcttatgatgtagctgcatttctcactaaatttttggataaaatgtttttgtgtaattaactatgatacctcccatggggaaaaaattttttttttcagtggagcagggtattagaaactaagtggccattgttgccccactcttcaaagagggcttgtttgctagtcttctttttttttttttttaaacagagacagggattccctatgttgcccaggctggtcttggagtcctgggctcaagagatccttctgccttggcttcccaaagtgctgggattataggtgtgagccactgcactcagcctatatgcaattttgacaaagagtttttttcggaaatgaaaatcaccctacccttcttgctatttgtctgaattctgggcccttaaacaaaaatatcacaaa

SEQ ID NO: 68517 - DNA, 3393 bp, Homo sapiens
ttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaacttgtgaaaatgtgtttaaaaaacaaacggccagtgagcctgctacaccattttgcccatatgcctattgtaacttctgatgtcaagagacaatgcaaaagcctctgttttcacaggccctattatattaactctgacttacaactgtacctctctagagaaaaaacagaaaataaggaacaaagggaaggcagttttactagtgagaagatgcaaatcaaaagcaaactggaaagcaagagcaatagtaagggtgagatgagggactggagttgagactgcttgagaaatctggctgtgtagctttggtttgggggactgaggaagaggctggacatataaagtgcaatctacattggtaataaatggtcatccctttcttctgactcctcccccagctggtcatcccccacaccacgatatgctgcaggcacatttcgaggtttagaacggcagacaaagtcacagccatcctgtagggggaaaaaaaagaaggaaataattcgcagcatctaactttaggatatgagaaagtgtacttatggtctaggaatgtggcaagaattggttttctatagggataatgagaaaacctaaaagatctgacaatcagcctaaattcaatttggggcaacaggagaaaaagtttcttcttattaggcctcaccttcttcccacccaggccctcttaaaagctaaatcagatttagaagagcccatctggtcaaca

SEQ ID NO: 68518 - DNA, 1994 bp, Homo sapiens
ctgttgaccagatgggctcttctaaatctgatttagcttttaagagggcctgggtgggaagaaggtgaggcctaataagaagaaactttttctcctgttgccccaaattgaatttaggctgattgtcagatcttttaggttttctcattatccctatagaaaaccaattcttgccacattcctagaccataagtacactttctcatatcctaaagttagatgctgcgaattatttccttcttttttttccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccatcaccttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagcc

SEQ ID NO: 68519 - DNA, 1023 bp, Homo sapiens
ttgctgggacttttgtggttttagcactcaatgtcctgtgtcccaggaaccccctcagtgtgaacaaacgaggatggttggtcacccaaccttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgtagagagagaaagacatctatacttaagaactgggaaatagtaaaaactcagataggataacctctgcatttattgtcagctgtttcctaagatacattccctgaaaaggaaaaatgagtagtgatactaaatgaaaaagggggctggtaactcttagaaaaccagttagagtgctgtcagtccaagagaagcaaaggcccagacaaaatgtgacagcgtgtgattctatggccaagaataatcaccattaagtatatgattccatttctctagaagttctcataatctaatgaaataatataaaaattgcctagtcctgcagtaggggaaaaaagcacctccaaatgcaaatctataccggcaactaaacattaaatctcatttttcaaaaacttgcagtcagaattttttttttttttttttttagacggagttttgcccttgttgcccaggctggagtgcagtggtgcgacctcagctcactgcaacctccacctcccaggttcaagtgattctactgcctcagcctcccaagtagctgggattacaggcatgtgccactgtgctggctaattttgtatttttagtagagacggagtttcatcatgttggtcaggttggtctcaaactcctgaccttaggtgatccatctgccttggcttcccaaagtgctgggattacaggcgtgagccctgtgtcctggcagaattattttatagccagaggatttaaaaagttatccccatcaattacagcat

SEQ ID NO: 68520 - DNA, 4547 bp, Homo sapiens
ggtctgttctgataaaggaaggcatactcacgtgacaagtaagatggaacccacactgaggtgggagatctctggtgaacaggccaggctgctatccatctcaaagaggtagaaacaatcttggactttgccacgctcctcagacacagggttaaaattgtcctgatgatgagatggcataacacattcaggtggttaagtgttttgactcctgtccaacaaaataaaaaacccaaaaaacatctgctccttcctggttcagcagcctattttccatggaagatgcgtgtctgacacagagagaaactgagctcctagttttctaatgtccatcccaacgtatcgtgtcccctctggatattctccccaacctcaggtcagtcctttcagtctcctccctcggcttatacaacacagggtgcctcaccgctagggtgtgtcgattgcaggagatcatcaccactgcacgacgctgctccttgccacagtggttgtcatattcatcaccccctttatagatcagcatgatccaattacctgaggagggacaaggaaaatggagctatggggtgggggaaaagcagaggcagatctgggtggtatggcagagtggaattgcgtaattcattgcaattggttataactaaacaaccctcatcagtacgaacttggtataccagaaatgccaagctaaacttgtttgcttacaaagacttgtgttcccttaagacaagaatcagatattcatttaagaataatcttaatttttaacattaaaggtaggcaactgacaatgcaaaaccaattatgatccataccttaacactgattcattttctgaataccttctaaaagcaaaaaaagaggttccatacaattgctgagcagcaggggtaagcccatctaagatttcaacttagccccagataaattcagagtggatatctaagattggaatgcatatctcttctttagtatttactgtgttcagttcttttgcaaaatatcatttgattcagtaattgtgaggtgaataaggtaaagattctgctcctagttttgcatatgagaaaacaaggtcaaaaggtgatacgactttccagtcacaggattaggaaacaggaggagaacctggtcacatgatccccagccccaaacccttttgttacttttttattgtattatttaccaggagtaaatagctaccttgtataacttatttatctgtatgggagggaattggaccataggtgcttacatggtcctctccagcaatatgacttttaagaaatatcaccaccatagcacaaaaatcagtgggtaaagttttgcagactgagtagtttgcaaaaaaaagtttgagctcttaaaatttaactggtaaactttgattaatttgatgaaaagtggtggtggtggttggtatttgtaagtctagtgtgaaactcattaaaagtatttgggtgaataaaaggactctaggctacagaattctggctagagttggctgggcgcggtggttcatgcctgtaatcccagcaccttgggaggccaaggtgggcagatcacgaggtcaaagatcaagaccatcatggccaacattgtgaaaccctgtctctgctaaaaatacaaaaattagctgggcatgatggcacacacctgtagtcccagctactcaggaggctgaggctggagaatcgcttgaacccaagaggctgaggttgcagtgagccgagattgtgccactgcactccaggctgggtgacagagagagactccgtctcaaaacaaaacaaaacaattctggctagagtcttcattttgcataagtttttcactgattttaatgcacaactgtcctgagctgtggcttacagaggagctgtggaattaggcatcctgtggtatattacagtctcaggtgtgccgaaccacacgtatgatatgctgaagacactagaaacggccaagacatacaggattgtcagagggattgacttgggatcagttagtcaatcgatggtaggaaggggagttttcttacttccgttgaagatgtgagtctcgttgagtctccctaccactgtctccttcccattacttttgttgatttgcaccaggcctgccccagaagtgtggttgccagcttcccggcacaccctgaagatgtagatgtatgtgtctgaaccctggcccacagtgctctcaaagctgtaaagagaagtgggaagaaagaagaggagagttactagctatcagcctcaggaataacagcatccctttccttaattaaaacaaaacaaacaacatgctcgatttatttatttgaggtcatggctgagtgaatatttgtttaattttaagatattcataaccttgacagaccatccttattgctgatgatgaattattaaaacacacttgagctatcttgatagctcaatattctagttatttttagaatgcctgttagtaaccatgttccaatgaataagggcccatgttcatcggatagtctcgtttcttagggaccaacttcagatttatatatctgaaggttcctgacacttataatgacatgtgtcggcctaaatatgtttatctgatatttctaaagtcctattatatgtaggtgtcaaataatccttaaatttctacaagctggtctcttggatccagtcttggaaatagctacacttctgtgaaagatgagaaaactgcacacagcaactaaaaactgggctgagaatttgctctatgtcataaaagagagcacattatgaaataaaatcagtaagaagaaaagactttaacataaatattttctcaagctctttaaggttcttctcatttaccttttattaaacagtggtttcagcctcttcactagagccaactctttctctgactctttacccttttctcctaccaagtcgcaagttttttcttctgtctgccaggattctctcactgccacagccaggagtagtagtagcagtccagtcctccagcagctgtagaaagggaacatcctttgggagagagtgtgtgttggggagggcaggtaggatcaggagagagaggaaagagataaagcgtatgaatgtgtaataaatcgatggtattttaattatccagaaagtacaagattctctggcatatgcaacacatagtacattttaatatctctgtaacaagagcatctgcagcagaaaattcatttatatgtaacttgtagtctaatgtataggtgagtctttcagaacaaactacaaagttgggaagagggaaatgaaagaacttaaaaaagaatgatgacagcttgggtggagccatccttgcctctttactgtttgatggcttgatgtagtcttctgaaacctctttggcctctacaggtcacaaatctcaagggtttctagacttcccataagtacagttgtcttttacactacaaatcaatgacaacaaattggggatcaccaagccactttacaattgagtaaattcaatgcacctgctgcttgtactgctctaggaatgaaaacacacagacagctctctttcccaaacttactagactggtgcaaaggtcattgtggttttggcaaaaaaaccccaccaaaacctaacattttcttttctcttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttggtttgaatattctttaaagttctctagttctttttcatgcgggtccacttactccacctcatttttaaaatataaaacttgaaacaggcagaattttcatgggtactaatgagtttgaagatgggaaaatggaagctccaaccttggccgtgaatgcactttccccattcccctaaacaacctaacatctgaccttccacttcccacaccccactaaagcaaaaaatcccgggaaattgtctacctgacttcctgtaccccaaacatcaattctctactgtaatattatggtagtttccatagaataatcatagctaaccaagaggtccaaggccctcataacacatttaatgcactgaaaccacacaacagcaggaaacaacagactactgccttgggccaggtgctgttcaaagcacttaacatatattaattaactaattaatcctcacaaccttatgagtaaatacaattattgttgctattttaccagtaagaaaactgagacacagctagtggagtgagccagagagtctagctccagagctcatggtctgtgttgaacaactacatgtatatttccactatgtgcataacaattttttggagatgagagtagacagccaaaactgtgggtttttttttttttctactaagaagtgaaggggaagtgattcctcacacagttgactgaataggaggtgaaataaagaactcaga

SEQ ID NO: 68521 - DNA, 1050 bp, Homo sapiens
tgctatggtggtgatatttcttaaaagtcatattgctggagaggaccatgtaagcacctatggtccaattccctcccatacagataaataagttatacaaggtagctatttactcctggtaaataatacaataaaaaagtaacaaaagggtttggggctggggatcatgtgaccaggttctcctcctgtttcctaatcctgtgactggaaagtcgtatcaccttttgaccttgttttctcatatgcaaaactaggagcagaatctttaccttattcacctcacaattactgaatcaaatgatattttgcaaaagaactgaacacagtaaatactaaagaagagatatgcattccaatcttagatatccactctgaatttatctggggctaagttgaaatcttagatgggcttacccctgctgctcagcaattgtatggaacctctttttttgcttttagaaggtattcagaaaatgaatcagtgttaaggtatggatcataattggttttgcattgtcagttgcctacctttaatgttaaaaattaagattattcttaaatgaatatctgattcttgtcttaagggaacacaagtctttgtaagcaaacaagtttagcttggcatttctggtataccaagttcgtactgatgagggttgtttagttataaccaattgcaatgaattacgcaattccactctgccataccacccagatctgcctctgcttttcccccaccccatagctccattttccttgtccctcctcaggtaattggatcatgctgatctataaagggggtgatgaatatgacaaccactgtggcaaggagcagcgtcgtgcagtggtgatgatctcctgcaatcgacacaccctagcggtgaggcaccctgtgttgtataagccgagggaggagactgaaaggactgacctgaggttggggagaatatccagaggggacacgatacgttgggatggacattagaaaactaggagctcagtttctctctgtgtcagacacgcatcttccatggaaaataggctgctgaa

SEQ ID NO: 68522 - DNA, 1856 bp, Homo sapiens
cagtacaagcagcaggtgcattgaatttactcaattgtaaagtggcttggtgatccccaatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaaggtaaatgagaagaaccttaaagagcttgagaaaatatttatgttaaagtcttttcttcttactgattttatttcataatgtgctctcttttatgacatagagcaaattctcagcccagtttttagttgctgtgtgcagttttctcatctttcacagaagtgtagctatttccaagactggatccaagagaccagcttgtagaaatttaaggattatttgacacctacatataataggactttagaaatatcagataaacatatttaggccgacacatgtcattataagtgtcaggaaccttcagatatataaatctgaagttggtccctaagaaacgagactatccgatgaacatgggcccttattcattggaacatggttactaacaggcattctaaaaataactagaatattgagctatcaagatagctcaagtgtgttttaataattcatcatcagcaataaggatggtctgtcaaggttatgaatatcttaaaattaaacaaatattcactcagccatgacctcaaataaataaatcgagcatgttgtttgttttgttttaattaaggaaagggatgctgttattcctgaggctgatagctagtaactctcctcttctttcttcccacttctctttacagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaagaaaactccccttcctaccatcgattgactaactgatcccaagtcaatccctctgacaatcctgtatgtcttggccgtttctagtgtcttcagcatatcatacgtgtggttcggcacacctgagactgtaatataccacaggatgcctaattccacagctcctctgtaagccacagctcaggacagttgtgcattaaaatcagtgaaaaacttatgcaaaatgaagactctagccagaattgttttgttttgttttgagacggagtctctctctgtcacccagcctggagtgcagtggcacaatctcggctcactgcaacctcagcctcttgggttcaagcgattctccagcctcagcctcctg

SEQ ID NO: 68523 - DNA, 2284 bp, Homo sapiens
tgggcctctgtagcactcacttccccatctgttaagacagccatggccatttaccagtggaatttctactgtcttcccgctggctcctttctgatgtagcagtccttatccctttttctccagcagcctacatgtttagaaaagcagcctcaattggctaaaaggcctaatgctgaaagaactcaagagagaaggagcctcagacaagtagcggctatgtcccaagagcggaagctccccacaacgaggaacacaagataatccgtccatcagccattcttatccacaccacagtcgcatccccctcaaagctctcccagggtgccagaaattctcgctctgtctagtgtcccgactttccaagcgcttgtagccataccctctccaaatgatgccacttgacctcccaccgtgatgcaggccaaaattcctcctacaaataaatccaccaacacctccaacggactccatacttggggtattttcctttccctgctttctaaatatcgtaaatcccctctctggtcttggaagtcctttctccctcacacctttcggaactccgtgactctccgctctcatgcctccgcctccattctacccttagggctcctcagccagatctttggctagaaccatggtcaagggagaatgcgattccggctcctgtcacagacgcttaagtgtgagcgcaacccagcccgcctcctcctccacgcccctcacactcacgtgtcgtgggaaactggagtagccaaagctcagaatccccagtgaatacccttctggggatgggagacggggccagctaggggccggccgcagaccccggtcccagagctagtttcagaggccagcgttccccctagcgcctcgctgtgccccactctgggaaccggaaacaggaagcgccaagaggccgctgggcaaccgctcctcccaccagaccccgcggcatgtgaccatagaaccatttcgcccctttccccttcccgggctccctgataatcttaaactctgattggccagtattctgggactttagctccgccctcgttccatcagctccaatcactatcgaggttgtcgtttcgccttttctggttgcctttctttcaatggggtcccagagtcccgcttccagggcctctcggctcgcgcaccccggtcacgcggggtcacgcgcctgaccgctcccgggtagggttcgagtgaagagggtgagaggggcaggtggcggaagcggaagttacgcaggcagctcgccctcgggctccgcgggagttgtagttctcacgctaggtctcctccgggcgcttccctagcccgttcgccgcctgagagggacgctgttccgccgcgtggaagcttcgagtctcgactccactgttgacccctagacgagagtagtgcagcgacggggccgtgatgtgcgtcctggctttcttaacgacacctctcctctgtatttcctttttccagttgagtaccttggggtgaattattattgttactgttatctctgtcgttccttactgcttcgtggtattttgcttgataagcatgctctgcaaccacctctgttcgccagaggttacttctgcaaagtaggaagaaacgagcaatacgatggtaatctttgcgcctttgctaagatcttttgtaggttccttatgtcttactagccacttgttgaagtcctgctcattcttaaactctgttcagatgttatttttcctgtaacttcgtgcattcactctcttcagaattaacaatttcttcctgtggaccctcgcttgtggcttgtacctggctttagcatgttttcattccgcttccactcttacgttgcttctatgtgtgcctctctggctctatgcaggtgcctggatttttgattcttacccctctcattagaactactacagtgttttgagtctaataataataaaagctaacggatgcatatctcggtggtgcccggcacttttgtaagtgctttaaacgatagttaattcacttggtcttcacaccaaccttatgaggaagtatcttatcccaagtttacagatgagtaaattaaagcagatagaagctaagtaacaccgtgggtcccaagctattaagttatggagccagtatttaaatagtctccataatccatgctctcaagcactacgctttaccgactgtatgccattctgcatttctttgtttattagtaatacattcagttcaggctaggtagtaatcatatctgggttggatgttgccccaataaaaa

SEQ ID NO: 68524 - DNA, 1018 bp, Homo sapiens
ctcctgttctgtataatcataagagaggaaggtaattaacagtcctagaacctcagcttcccaagtagctgggaccacaggcgcaagccaccatgcccagctaatctttgtattttttgtagagacagggtctcacatttttgcccaggcttgtcttgaactcctaaactcaaataatctgcctgcctcagcctcccaaaatgctgggattacaggtgtgagccactgagcccggctcagatgcttttcaaaatgatcatgttttccatatttcaaggactaaatatagtttttggtaactttcaattttaatatatttatcatttatagagaagatgcaaggataatacaaagaactctggtacacattttacctaaattcatctttttcccctccatatacattagtttattttgaacaggttgagagtaaacttccattaccattaaatatatcagtgtgtatttcctagaaacaaggacatcctctcatcaaaatcaggaactacagtattaatacaatattaccaaatccatagtctgtattcaaaattttatcacgtttcaatagatgctatgtatagttacttccgatttcccaacaatcacaggagccaagccagagtcacacattgtaattagttgtcattgatcttacttgactttgaaattttgataggtactggccacttgttttgtagaatgtctttcattttggttttgtttgatatatctgatgtaggatttttctcggtcactttgccaaccagggacccgtccatagctagtgacaccccccccccgcaaaacccccaggcctcacttgacctgctgcctgtgttatagtttgtatctgcattcggtggttcctgaactcttgtcccacatccaagaagaatgaggatatgctgacaatttgaaggatgagaaggatggagaagaattttattgagcgatggaacagctctcagcggagaggggatgtggtaggtggaggtggtcccccacccctgcagtc

SEQ ID NO: 68525 - DNA, 1045 bp, Homo sapiens
cctgtgtccatgtgttctcattgttcgactcccacttatgagtgagaacatgtggtgtttggttttctgttattgtgatggtttgctgagaatgatggtttccagcttcatccatgtccctgcaaaggacatgaactcatccttttttatggctgtatagtattccatggtgtatatgtgccacattttctttatccagtctatcatcgatggacatttgggttggttccaaggtagttctgtcttaagttcttcgagaaatctccaaactacacttttttgtatgaacgcacagcttaccacacaaatgtattgtacagctatacaaaaatattttctttctttatatccttattatataagtttttttctatttaattttttttttactttttaaatagctttgttaaaaactaagacacaaaaacatacattagccaaggcctacacagggtcaggatcatcaatatcactgttctacttccttatcttgtcccactgggagttcttcaggggcagtaacacgcatgaagctgtcctctcctgtgataacaatgccttgttctggaaaacctcctgaagggcctgcccaagaccgttttacaattaacaaattttttaatggataagtataaagaatgtactctaaaataacagtaaaaagtataatggccaggcacggtgcctcacgcctgtaatcccaacactttgggaggccgaggcgggcggatcatctgtggtcaggagtttgagaccagcctggccaacatgatgaaacccgtctctactaaaaatacaaaaaattagccgggcatggtggcgcatgcctgtaaatcccagctactcgggaggctgtggcggaagaatcgctggaaccggggaggcggaggttgcagcgagccgagatcacaccattgcactccagcctgggtgacaagagtgaaactccatctcaaaagaaaaaaaaaaagtatggtatattaagtacataaatcaataacagaggcacatattatcatcaggtattatgtatcatacataaccg

SEQ ID NO: 68526 - DNA, 1049 bp, Homo sapiens
tataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggag

SEQ ID NO: 68527 - DNA, 1099 bp, Homo sapiens
gaccagaagaaaaacagagaaggcatcaccttaatggcattgttcagcagtgatccagagccttcgaaaaaaccatctgccttttgtccctgtgaaagccaggtgagggcatccctgatgtgtgagctctccacaaagatgtacgattgggcttgagcaaaggacttgagcacaaatgcagtgagcccgtcgagcaaaacagaaacacacacatgaggaccacctcactttcatagctcactttgtgcactgcctccagacattgctcttcacaattcagtggaggagattactgggaggtattgatggggaaatagtatttaagagctgaatatactctagtccaacaaacacctcaatatcttttattatatctcaactttattggtttctctgagttgatgctttttaatttttttgttgtgaaacatttgttggagcctccaagcctccccaccatgaaaactgcatttccagaatgacttgtcctgactttactgcatcacggtctccttctgtcctcgccctcccctccttctttaatgcacagtgtgggagcttcttcccctgtcattttatagaatgacattttctgctttatatttccatttagaagatccttatttcaccattttcagctgtgttatcacagcaggtaagctttcagagatgaaacggtgagattacccaacaggaatgatacatacagcatatgcgttatttaaagactaacaattttccacaaaaaactccagatattagagagtagctgtttctagaatcctgaaatgtcatggatctacagagagcatagggaaaaaataatcttgtttccctgactgctaccatcattgtccccaaaggtgctgtaggaaccatctctgtgcttataattcaattgcctttggtaccctgaagaggaagtgttcatagatttattgaaatggcaaagacattggaggattattgagcttttttctcagtgctattaggaatcatagggtaactaatatttagttaaaatttcccgcaacccccaatcacaggcttgatgatactattgaattttctacttgtatattgggacattttattgaaa

SEQ ID NO: 68528 - DNA, 1011 bp, Homo sapiens
cattaaaaacttacgctttaacttaggggggatatgggagattcctgaaagggttagagaagaggagggacacgatctgacacatgttttaaaggatccctctcgctgaaggggaacaagaagagatgatcaggagaccagttagaaagctattgagagcctgcaagagaaaggactagaatagtagagatggagagaagtgggtagattctggatgcaatttgaaggtggaatcgactagatttgtgcatggattgggtagggaagataggggaaagaatgtagtaaagaactccaaagtgtttctccctagcaaatagaagaatggatttttcatcatctgagatgaaggaaattgagggaggagcaggtttgtgaggacgagcagatactcagtcttaaacttgctgattttgatatgcctatgagacctacaagcctgtaagtggagagtgggcagttgaatacatgagtttgagttcaggaaaaaggtgtggatcaaagttgtacagttttggacacaagtacatagttgttattaaagccattgactagatgattttatcaagggatcctcgtatagagaagagagatctgcagactgagcattatcgtcaagatgattataggtggcacagagttgggtttttaatgataatttaaataaacttaaaaaagtgttagcttttccccttctctttcaatatagtggtaatttttgtattgctatattaatgatattggtaaaatactggttttctatacaagttagtaacctggagttcctcttaaaataacttgtttaagtaaaaacatgagtgcatttaaactgtcaattgaacagtaaatcatactagtgtcacacagatatttcaatattttgaacatggtttaggaagacatttgagaaacacagaggtatcagaaagaatcctgtcctgaggtcaacagccttagaccttattattaggcaagagcttttaagcttttaagcaagtcttttatttctct

SEQ ID NO: 68529 - DNA, 1002 bp, Homo sapiens
cttttttgcatccataaaactgaatattttagacttagatgttttcttctcttctttttccccatgaaacaaatatctatgtctgtgtatgcatataaacagctctccttatggctttattacaaagagcatttttttgcttgtttcttgtcattttaaattgaaggtttgcatatcggaggttgttctttacaatcttagtaaactctgttttgtttatgttttaccagaagatatggcttttcctgaatatctatgcttaactcgttcctgtggtcctttcctcttttttctcagtttcttctagtcgtctcaaatgtctgcatctaaaacccacattcagatgcccacggttgtctacagtccacctgtttccagcttcccccttcttcaatgttagtcacagataaatattatttgctattttatctcagagtatttgggaaactgtgggactcttgaacacagttgtcagtgagggttgtgtacgcaacagaaagaaataaaccagaaataaatatttagagattaaacagctggttaataaaccaagaagtattcttttcatccttctaccatctgatttgtgattccagaacgtccagaagagagagatttaaattgctttcagctaagctgtagacctctagcagatgaacgacatattttcctgaaggtatgatgaaagtttttagtgctttttgatagtgataagatttaatttcacgacctggataattctgctcagttatagttaatactaaagaattacatttttaagacatcttaacatttctaatacaagttttgttaatcttttcttaatgaaagacaacttcaaattttcctggaattttactgccctgtgaggactgaagttttgcattttatgtattcaatcctgtattcattcaacaagtgttttctttgtttgtttgtttgttttgttttgttttgttgtttttctttgagacagagtctcgctctgtcacccaggctgga

SEQ ID NO: 68530 - DNA, 1065 bp, Homo sapiens
caaacactgaatgttctcacttataagtgggagctgaatgctaaaaacacatgaacacatggtggggaacaacacacactggggcctgttggggtgggggcagggggagagagagcatcaggaagaatagctaaaggatgctgggcttaatacctaggtgatgggttgatctgtgcagcaaaccaccatggcaaatgtttacctatgtaacaaacctgtacatctggcacatgtaccccagaacttaaaataaaagttaaaaaaaaaaaaagattctgtgccaggcatggcacagattgtcttggtaagcaagattgctcccttaaggagaatataacagagaatacaatgagttaaaatatgtaaagtactttatgcagtttctgcttgttgtggaattacactatgcctgttactctgaagaacttgttttttgcaaacatttttggaacttttaacttccaaaaatgatcttatcacgtgagcatttcatgatctccaaggttggaacgtgactcacagatttaggtgagagctcagcttcaggcttcattagcagcacactctggtctacagcacggagggcacaaagggagaggggggtggctctcaccttcaggcgggtgtttgaggctggcaggctctgagctgaggagaatctcaaatttacctgtaaagaggatatgattaaagcagccattttataattattacagtaaccggcccttcttctactccaggctaagagtagccttttctatacttcctttctctttattcatcttacagcaggattaagagatgaacagcctaggaactaccaattcagtgtctctggaacaacctggaaatttgattccagttaactcaggttttccattccttatataaatgatgaaatataaattgacttaatcatatagaaataaaatgctgcatagaattgaaaacacacgtacaagaaagatgcataccttgctatcactgacctatctctgtgcagtgtttatgtgaagactgtgtgcagtttgcacggtgatgtgaaaatcacattccacccctgag

SEQ ID NO: 68531 - DNA, 1020 bp, Homo sapiens
tgacacacaaatcctggcttgtctgtagagcatacattcatcttggcaatcccttatttgaggaaaacacagatactgagtcatttcacaattgtcacgacgtgcaatccattttatgaatcaataaaaaaatgtatccctttttgggtaggaattctatattcttttttggtaaatgtttcatagatgttgctgccttatgtctgtgactttcctgaaattggaggatgtctctttccacatgagtagtaatgacttgctgatacttcctggcccttttgacagcagaaaattgtgtagggaattaggaaatacagatcaaagagataatagaacgggaaaaaaggaggacaatttaattttctggaaataatgcttatggttctgcagcagctgcagcatcactgggaaggagcaggaaaagcaggatcaagactggcgggggcagttgatttcccatcacggtacagaaaggaagagggcagaatgggagcctgagccctcgattcttttaaccctgttcttgctccaactcactggtttttatttcatctgatgggcagtgaaagtaaactgccaatcatttatttttgtaacatattaactacttccagcataaaaaaatcaattccagatcattttcatgaccatatgtattaatttatccactttcccaaattttctaaattcctgaaaaatagtagtttgaggctaccactagctcaggtcattaatcagttttaaaactattttcatgaaaacacaaaacaaattacatggtttgatgaaataaaccaatattcttgcagttttaaaaagaggtattaatgtaaatccatatcccaaatatgttttggtagtctagggagcacaacatacattcttcacccaagattcatcctaactggctcttcagtgaaacaaggaagtgaaatctgtcatagaattttaaataagacaagtttgggagcaacctctccattgcttgaaagattcacttttgatctgtataagtattct

SEQ ID NO: 68532 - DNA, 1059 bp, Homo sapiens
caagacaaaggtaagttacgactgtaattgtagcattaaatatagggactagaagagaagagatatatgtgaaaaaagttgactttgtaattgagaatagttttgatacattaattgtataacagatttttcaaatgatccaaaataaagctacttttcaaaggaactctacaaaagacattattacctttggacatatttctaaaccaactttattttcaaagagaaatgtgtttacgaagcattgagcaactttgggtgggttgagaccgaaagtatccttgccacttgagtatacattgggggaggcagagctggaatcattggcatatgtggaatgaaattaatgcatgtattagcacataagggatgtgaatagcaatacttttcataaacaaaaaaagcaggattattggttgtaaaatttatctaccatgttaatatgctgaataatcctgtacgttttctatccttgtgaatacttgggctggcagagaacaggctggaaaaatcaggagattacagactacgtttccatccttcaagtatttccctgcatggatactgagacgtagaacaaatgataaaaagaacatgatgaatgtgctttttgtcttattagaaagactcacacttaatatgacactatattaatattcagagatcaggccagtgggcttgtcaactgagctgtaattccaccagcctgctttagtcaatactgcaatggcgcttccttctatacatattattagaaactgccctagtggaaaataatcttctaccagcccagtcttgctttttatattagaattaaaatttttattcattaaaaacattattaggagagtgaaaggaaaagtcacagagaagaaaaagatattttctgtatatataattgacaagtgcttatacccagaatatattgaagacttccagaaataaattagaaaaagacctagcaccttacacaaaacatccaaatagctaataaatatatgaaaaggtacttggtctccagagaaatgcaaattaataccacaatgaaatctctacata

SEQ ID NO: 68533 - DNA, 1053 bp, Homo sapiens
taaaagttttgtggtcttattacaggatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgtctgcttccgatatcacaggcagcacagaagagccgccctccaggtgctgctgggaaatgctgcctggaaccctttgccatttactttctatcaaaagctgagggaaatggtacatatggggctttcctaaaaatatgggatccatccatttgtcagcaatgtcattctatcctatcccagggcctttcaagattttggtgaaaactaatagatcccatattccagaataatgctattaataattttattattattacttaatgatagcaaaaagttagctaactccaaccgctcacttgttatttgccaggtaatcctctgatccagaggatttggccttttgtgtgtgttaatgtcctgcttgcaccagctgtatgaggaaggtgccactgttgtcatttccatttctgcactcgtggaaacaagcgtagtgaggccagcctgagccacagagctgcaggtaggggaggcagctggaaccctggcgcctggctgtggagtttgaggctctgactcctgcgccgcgctgctgccccaaccctagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcc

SEQ ID NO: 68534 - DNA, 1078 bp, Homo sapiens
agaagcaggcacggtagccaccgggaccatggtgtagccgcaggtggtctggagagagtgaggcaggggtggcagtgactgaagaccattcagtgtctttcatagaaagaatggcagaggagaccccagttccttcctgagtcccctctccttgggaaaaagtgttcctactctctgggtgagcgtctggtccgaatcgttggcttggagatgattttacgggctctttctggagaacaaaagtaaaaccttagtgttccgatgagacacagtaggcagtacttgggagggtcttatagaccccaccctgtggaagtgggtctcaacattacacaaccccctctcgggcccgtggacagttgctgtcttctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagccaaggtgagggccctgcagggccagaaagccgctcttggctctcactgtggtctaggccatgaggggcgtcctcatcacactgtagtttgggggatgccccccaccgtggtcaggttgatggcaccttaacccattctctcctgatgcgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgca

SEQ ID NO: 68535 - DNA, 1839 bp, Homo sapiens
cagtgaaattccgtgcatggggacactggagcccagaaaagttaagtgactcatattttctcaccaagcgtgggtgatggagccattcagttttccgatattttattttttatatgagtattcctttaactggaaactttcctaacaacaaacacctaaagacctgcagagttgcttttatttttgttaccccagctccacgccttaaccctcactttgaaataggatgtatcaaccctattttgcagatgaggaaagcaagggtcagagaggttagacaactcttccagagtcacacagctgggaagtagcagctccaggagcagaagctggggccgcttcctggtgcaccgatggtcttcaggtgttttgtggaaactcgggggcctccggggcgaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgtcagaagctgttttttgaacgtctctacacagtccaggcaggaaatagaagcactcacatcaggagctcagtgtcaggcaggcaagcctcctgcaggggagccccgccctgctcaggtggcctcatctcccctcccagctggtggtgctgccctatcagatgctgctgcatgcggccactcggcaggccgccggcatccggctgcaggaccaggtggtgatcatcgacgaggcgcacaacctgatcgacaccatcacgggcatgcacagcgtggaggtcagcggctcccaggtgcgtgggcctcccctccccaggccagggcctgccgtgaggtaaagggacttggatggttcctccagacacccgggccaagaattcctccggaggtggggcttgctacagggtgcacgagtcaaggcggtgacctcatcggaggctgaccatggctttccagtgcatcccagaactctggggaccccgctatgacagagtgcctcatttccctgcacctcacctgcccccatgctcctgagtccctccagccctggatgccagcagccagttctgcaagccagggagatggcatgtgtgaggcagaagtcccctcaggattggattttgtcattactgaagttgtctggaggggactgaattgaggaatgctcaagatcagtgcaggctcctcctgctgccctatcatgcgccatgcatggcaccaggtgtctctggtcttcacgctgactctgccatgggggtggtgttcctgttttacattggaaacttggagattcaaagatggtcaagctctgtcctgaggtcatgcagctcatgagtgtggagctggggtgtgcccactggtttctgactgtgaaacccccacgacatcccaccagctctactgacctgtgcctgggctgaattgaggctgggatgtgatggtgaccttgaaccatcactctttgtagactccaggtcttttcccaacccggtggaaactagcaggcagattccatacttgaggaattcagcctcttgctttttctctgacccacagtggacactggaggaaaccttcccttccttcccttttctcttagctcccaccagcctaagggctgtggaaaccagtaccttttgtctgcacccagccccctctcctccctttggtggcttcctgtgtgtccagggctagcatcttctaggtgaatctaagatgtcagtaccttagccctcggctgcttgctcagagcctggtttgtgttctttccccagctctgccaggcccattcccagctgctg

SEQ ID NO: 68536 - DNA, 1046 bp, Homo sapiens
gcaaggaggctccaggtgcctcagaaggtagcactgcgttgtgctgcctgggtggtagaagtggtgttttttgttttgtgtttaagattacagcttgctcagtttgcacacatgcctacagctgggcttggtttttgcaggtgcagcgatactgtgagaagagcatgatcagcagaaaggtaactgctcccatcttgtggtcctgaacaagacccagctgtgccccaaccccctgccgttgccatgctttcctcccctgccctcagggaactccagagtccccttcgtctccaccctccttggtgcagtgggccttgctggggtggtgggatgtgcgcttcaggtgtcttgagcctggcagagcctccgatccacccagcctctctctcatggctgttcctcgttcctctccactgctctctctcatcccacccagctctttggcttcactgaacggtacggagcagtgttctcatcccgggagcagcccaaactggctgggtttcagcaattcctgcagagcctgcagcccaggacgactgaaggtgaggcaggagggtgagcaggcagagccggctgcaggcatgggcaaggacttctgttcctcatgtgtggacctgactagagggaggcctcctccccattctgctctgtgcagctcttgcagcccctgcagacgagagtcaggccagcgtcccgcaaccagcttccccactaatgcacatcgaaggcttcctggcagctctcactacggccaaccaggacggcagggtcatcctgagccgccaaggtaatcaggtggttcttggccaggttcagttcccaggaaggagccaagctgagcccgggagccgcagcatgaaaggattctttccttccatcctgggaacttcctgggttaggaggaagcagtgcagtgggcactggcctgctgtgacctgggcaagcagtggaggtggacgggaggagatcgaggggctgggatggaggtcctctagggcaggggtcctagggaaacttgtattgtggggtaggtgggctttggt

SEQ ID NO: 68537 - DNA, 1046 bp, Homo sapiens
agatggagaggacagtatggtccacctctgtgggctggttgtcctagagattaaatggtgtttaatttaaagagaaagcactagcacttgtgcctcagacctggactcacctgggggaccccctttgctgggacgatagaagtgtctgttgggcttgcactcacctcccaccgatctgtttttccaggcagcctcagtgagagcaccctgaagtttttgctcctgaatccagctgtgcactttgcccaagtggtgaaggaatgccgggcagtggtcattgcgggggggaccatgcagccggtaaggacacctttcccagcccctcgtgccccaggtgttgggatgagatggggacttgggagagatgcattatcagtcctgttctctcctggggccccaagccagaaagggtcagctcgagcaggcccagtggtgtccactgggtgacactgctattctctcactgctgtgccttttaggctgcaggagcagtgcagactcctctgctgctccattctgtagccccaggatcacacttctcccagagaaagctgttctgtggtttcaaactcaaggaaaaaaatcatgattccacttttaaaaggttcattttgatgtatatgaatataatagtctttgtaggcataatttttacttatgtgcatagctattttaaaaacaaaagtgcggctccctccatgtgctgtcactggaacttgctcttttcactcagcagccagagggtcataaaccctgtctccttgtcagcaagcatgcacgtatttcagtatcccagctgtgctggattccagttacccagatatacagcatttcatgtacctccttctcttttgttaggtgtgcaagctatttgtagttttctgttttgagcatgactgtgatgaatataaccgcatttccgcacagtggtgactcctacctagcaaagggcctcctggacaaaaagctgctgggaatcctgaagcagtgcttcccagccccagctgccttagcttttgatttttatatttttgtatggatagatt

SEQ ID NO: 68538 - DNA, 2033 bp, Homo sapiens
ccccaaagtccctggctgtgaggttctccagtccgctggccagaaaacacaaggccacgagcagacccgagacctggcaccctaaacctgtctctgggaaatgtcctctgtctttctcagatattccaggaacctaagagcgcacaccaggtggagcaggtgctgctggcgtattccaggtgcatccaggtgcgggcgtcatgctgagcttgggtctgagaccatgtgggggtggcagctggaaacgtgggtgtcatccaagttttggctcagcaactcagcgtctgggtttctcctacaggcctgtggccaggagagaggccaggtgacagaggccctgctcctctctgtggttggaggaaagatgagtgaagggatcaacttctctgacaacctaggccggtaagtagtggttctgctcatctcctgggtcgtgatacatggccggccctcactcccagcagctgggcccctgcctgctgtctgctgccattagagcccacagctgggctgcgactgctcagaccagccagctggagggaggggctcagcagctctgggtttggccctgagagagtagttggattttaggctggccattgctgtatcaggacccaatcaattggcctagacgggatctctcagccttacaagccctctccaggtggtaggtacagagtggagagaggctgagttttgatcacagtcggagagggctgacggaaggggtagaacggagcagctggtgacatgggtgatgacccgggagttcctgacgtccacccactgggctcttgtctcccccccacgtgtgtggtgatggtgggcatgcccttccccaacatcaggtctgcagagctgcaggagaagatggcctacttggatcaaaccctcgtgagtgaccccagtgtcacagagggtgacagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacaaagcctcctggtctggctccaaagcctggcagggtcttttccccgggggagctgcaggcagggaacagtcctgatgggtcatccccttcactcccagcccagagcccccggccaggcacccccagggaaggctctggtggagaacctgtgcatgaaggccgtcaaccagtccataggtgagcctggctgcctccagctgggtggacagatgggggctggagaaggggagaacaggaaagaggggttgcctgccctgtttcctatataagtctgaggaaggggagggggtcgccatgggaatgtgctgtaggggaggcaggtgttgctcggagccccagcctctgttcctatgcaggcagggccatcaggcaccagaaggattttgccagcatagtgctcctggaccagcgatacgcccggccccctgtcctggccaagctgccggcctggatccgagccagtgtggaggtcaaagctacctttggccccgccattgctgctgtgcagaaggtcagtcctacctttttctttctgagagcctcccaaccccgagatcacatttctcactgccttctgtctgcccagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccgggacccaggcacaggcgttagctcccgtaggagaaaatgcgggaatcctgaatgaacagtgggtcctggctgtccttggggcgttccagggcagctcccctcctggaatagaatctttctttccatcctgcatggctgagagccaggcttcctgcttggagtccgcaggaggctgtggcagcagtg

SEQ ID NO: 68539 - DNA, 1689 bp, Homo sapiens
atagcaaaaggtcatgcagatatcaaaccaggtaagactcattccctaagccaggattgaatccaagctacacagaggctacacaaaaccttgccaagtggttacaggtcttgctcccaaggatgttaaacaagatggaggtcctcagcaaatttgctatggaccatacagaaagacatgcaaagcagaccagattggctacagcttcagatcagcctcacaaatcgtctctcgcaattaaaacactacagagagccctctgctcagtcctgcagctgcccactgccctcctactgtccaccgtggccctgctgcactctggctgcgtcctctctgggatcgctgccaccttccacctgggcctcgcagctgcggcctctgccagagccagctcctgatggacccatgtggaaatgggacctccagatatcatcctggcagtcattgaagactttaagagggacaccaatagcaaaaagatgaatctgggagttggtgcctaccgggatgataacggaaagccttggacgtgctgcctagcgtccccaaggcagaggcccagattgccacaaaaagtttggacaaggaatacctgtccactgggggactggctgaattttgcaaggcatctgcagaactagcccttggtgagaacagcgaagtcttgaaaagtggccggtttgtcattgtgcagaccatttctggaactggagccttaaggattggagccagctttctgcaaagattttttaagttcagctgagatgtctttctgcccaaaccaagctggggaaatcacacgcccatcttcagggacactggcatgcagctacaaggttatcggctttatgaccccaagacttgcgattttgacttcacaggcgctgtggagggcctttcaaaaataccagagcaaaatgttgttcttctgcatgcctgcacccacaatcccacgggagtggacccaggtctggaacagtggaaggatacagcaacaatggtgaagaagaagagtctctttgccttctttgacatagcctaccaaggctttaccagtggtgatggtgataaggatgcccgggctgtgcaccacttctttgaacagggcattaatgtttgtctctgccaatcatatgccaagaacatgggcttatattgtgagcgtgtaggagccttcactgtagtatgcaaagatgcgatgaaaccaaaagggtagagtcacagttgaagatcttgatccattccacgtatgccaaccgtccccacaatggggcccagattgcttctaccattctgaacaccccagattcatgaaaacaatggttgcaagaagtgaaaggcatggccgaccacatcattagcatgcggactcagcttgtctccaacctcaagaagaagggttccacccacaactggccacatagcactgcccaaactggcatgttttgtttcacagggctaaagcctgaacaggtggagtggctaaccaaggagttctccatctatatgacaaaggacggccgcatttctgtggcaggggtcacctccggcaacgtgggctaccttgcccatgccattcaccaggtcaccaagtaatgtacctggtgcaaggaaacagagacgacctttctgtcttcagcctctgctattgggagcttcacacagaggatgagagagagcggatggtgg

SEQ ID NO: 68540 - DNA, 1051 bp, Homo sapiens
aagtatatctccaaatcattggcccactttttaatctagttttcgttttcttattgttgagttttgagttcttaatatattctagatacaagtcgctttttagagagatgtttttctgcctttgcttgtctttttattcccttttcagggttttttttctagcagagagttttaattacgttaaagttcaatttatcaatttttaaaatattgataatgcttttggtgttgtatgtaagaaatttttgcctaattcaagttcacaaaaatgtaattttcctcttctaatagttttagggtttgaggctttatatatgagtctaaaatttattttgagttaattttcttataaggtattaggtgtgagctgaggttcactgttttgcattaggacactcaattgttccagcactacatgttcagaaaatattaccccttacctacctgattactttccacgtctgtcaaatgtcaattgatgatacacgtttagatttgtttctgaaaccttttttctgttccattgatttatgtgtctgttcttttgtcaatatcatactgtctttgtttctattactttgtaaattacgaaagcaggttccctgatttccaaatttggccatttttttttccttcaaaattgtttggctattctagttctttgctttttcatataattttaaaattaccttgcttatttctacaaaaaattcatactgcaatgtttatcagtattgcactgaatctctaaacctgtttgggtataattgacatccagcaatattgcatattccaatctatgaatatcttatatctctctgttgattcaagtctgctttgatttctttgtccctttggtttccagctttcatcatactgatcctaaacatattttgatatatttatttgatatctttcatgttattataaatgatactgtttttatatttaaatttccacttcataattatgaatatggaaatataagtgatttttatatatgaacataggtaatcctgtagctttgccaaattcatttattctcatagcc

SEQ ID NO: 68541 - DNA, 2203 bp, Homo sapiens
aggggcagcggaacgcgcagagggcacggtgcaagcacgggacagctctgcattggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaataaaacataactcgaatgttttgatgtttgcagtgacatcgattgtgaaaaaggttagccagaaaggaaacgcagtgagacagagcgctcggccaccccctgccctgggcgcctggcgcatggggggcggggcggggctcgcggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgagtgtagaggagcggaggggatgggaggggaagggcccgcgggggcgggggcgggtagtcgagatggcttccctggggcgcccaggcggctctggagaagggaggttccgagaattacttaatcctgaacgcccttcagtgccagagccaatggacgtccagactgtagagcttttaaaaccccgtatgcctgggccccgaaccccacttcagggctgacggcgttttgggggccgagccgccgtcttcagtgactcagcaacccacacacggtctcagcagctgagaccgtgtgtgggttgcggtgcacaaaatagggcccctgtgggcgagactggttagatcggggccatggattggctgcctttaagaacgcagggacattgtgctgtgcggtgaggtttgcgcaaacccagtcgatttctgccttggctggttctcctttaatgaagttgactttggctctcatatcattggtcttgggacgaaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaacccttttcctttaaaaagaaaaaaaagtcattagggctcttcattccccaggaattacaaaaaggttttcagcttatagaggggtgagctaatcccttactcgggaaaggatcctttacaaattactttcctggtttctggaccttggatacctgaaaattttgcccagttctggtgataccaatcttttgagcaatgatatttaaaaaatacaatcaagttttattgatagtttaccctagcggtattataagtactcagtctgtaatcattgacttacttccttacacgattaccc

SEQ ID NO: 68542 - DNA, 1030 bp, Homo sapiens
tgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatccactgagttcagcaatgttgcctttattttgtatgtattagaatagatgatatgtggactctctgaacaaaagaactaagtggggaaagctgttagtgatgaatgttcacatatg

SEQ ID NO: 68543 - DNA, 1063 bp, Homo sapiens
gcaccaggttttgctgtaggtcccaaccacaccttactctctccatcacaacttggtcagtctgaagccaccatctcccaaagcagcaaatagcacctaggcaaggctcccggcatcagaacaagcttggtgtcttctgaccatatgaaagtcttgttcagttattcaggaacgaatatgtgggtgggctttgagcatgcaagttaaatgagagaatggaaaacagattagtgaaaacttctttcatgaaaaaccttaagacccatctctaaccctctctaatctcttgcagtcatatccccaagtgatgtctacctctgtagagagttagggaatatatcaaggtcaccaaaaaggaagtaggaagttataaaagatccatgccaagcagcaccacatgcagaaaattatgtaagattacggaattttgatgaaggcattgaaaatggacacttgtccctaatgacaaaaatatcaaggtgctgttccctgataaagccaaaaggaagctaatatttgagtttaagatgtgaactgtattttgaaactaacagatttatccatgacctaggaatgagactggatgaatatttgaaagaaagcaaaaaacacatggcggcagatcctaaccctctgtacacatctgaaacagtccctgtagggcaagagactgtaggccattgctaaaccaaagagatcgtttgaatttaggggctgtgtctctcccaggtaggctttgcttattgtaggcctacttcctggattttcctaaggaacaaattttgtccttggataggacattacatatcattttcgacaagctgtctgattttacgaaacagtggagtttttaaataacagccaagttcagaggcaaagtcacaccagctgttgtggaagtgtgtccggaattggtgggtttttggtctcactgacttcaagaatgaagccgcggaccctcgcggtgagtgttacagctcttaaggtggcgtgtctggagtctgtcccttctgatgttcagatgtgttcggagtttcttccttctggtgggttcgtggtctcg

SEQ ID NO: 68544 - DNA, 1841 bp, Homo sapiens
tcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaatcaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttgcaatttctctttaacaaccaaggggtttattttcaaagcgatattggggaattgatttcacagtttgttaccttagtaggtaacggtaaggttattctctctttttttttttggttatgaaaacttagggactacaattagtataaaaattggcataatgttggattgaatctacattttggcagaagttaagcattcccacataatgtcaaaattatacattatgcagtttttttgtttgttttattttgttttgtttttgagtctggctttgtcacctaggctggcatgtagtggcatgatctgcaatctctgcctcccaggttcaagcgattctcctgcctcagccccccaagtagctgagattacaggtgtgtgccaccacacggggctaatttttgtattagtagagacggggtttcggcatgttggccagg

SEQ ID NO: 68545 - DNA, 1050 bp, Homo sapiens
cccaggctagtcttgaactcctgggctccagtgatcagccctcttcagccttccaaagtactggggctacaggtgtgagccactgtacctggccaccatctttcttttttaatctctcacttttattgaaaaaaaattagcacaagaaagcaatatatcataatttcattgcaatattgcaaggtacttttgccttctgaccaaaaattgtcggtgtggaataaaatgggagattgtgggtgtgattaagaggtcatgattctatttaatggactaagagcaaaagaaaatattttagtgatgaagttatgataagcatttccatattctagacatttaggcagcagaattttttaaaatcatggtttatgcagttgtaagctttggaattaaacagttgactacatatgttttctgttctacagtaattctacaataatgcgtttttcttctgggagaggagaatgtgcatttttgacctcaacaagaatggcaactattgattgcattcaaacgtacaattgtatctgtgggaagagaatagactctattttctctgattcggtgtgcgccaagaagaaaaggtgaaaatggaatgttttctttttttgtttcccataataatttctgattataaatcattgcttttaactgtgggacttagttaattcttcaaaagataaagatgaacaggaagaaaaagaaaattattttggactatgactttaaagatcagatgccatctttcttcctggagaagaggagattttctcttttgagagtggttgttccttcctttaatgtccctgaggaattattcattctttctaattctcagaactacctatacaaccagttagagaactctgatattatatcctgggtcttttttcttatcaataggataaatcattccagcatcttctggttttgaaagcagttgtgaactagaatgtagttatttttttcttcccatctagaagttacctcatcttttaaaacatttgttttgctacaaaatataacttcaaacttactgaaagttgcaag

SEQ ID NO: 68546 - DNA, 1308 bp, Homo sapiens
tattgtttctaaggaaataattttaaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaggacagaatgtttaatgggagtgtatttttgccgaccttagcgtgtgtttgtcttctccaccacttgatttacttgacttgattaatagtaaattcaaagccaaatgtaaagttaagttaatgctgtttcacaaatttaggcatataagcttgagatgataaaaaattggattcctgttgaaatgtacagctggaaattgacaagttcatgtctgagttcagtagtaggcatgaattatttggtactgtctctttttgagtaatcttcattcagtgaggtgacgtgatgacctttagattaacgaaggagttaatagttctaacatcc

SEQ ID NO: 68547 - DNA, 1766 bp, Homo sapiens
ttgttgcattgacctgcgaataattctagcaataagtactcatcacttgacttttttttttttttaattttgagatggagtctccctctgtcacccaggctggagtgtgccaatctcgggttgctgcaacctctgcctcatggattcaagcaattcttatgcctcagcctcccaggtagctgggattacaggcatgtgccaccacgcccggctaatttttgtatttttagtagagatggagtttcaccatgttggccaggctggtctcaaactcctgacctcaagtgatccgcctgcctcagcctcctgaagtgctgggattacaggggtgagccatcatgcctggccctgatcacttgactttttaatttttaaaaataaataaaaccttattttctggagaagccctgtcctgttggcacctgttctattttcttctgtgttccctacagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggtaaatccaaccagtcagggcggatgttgccagatagtctttaatcatgtcagactttagcattctaaaagtggttttatcacatgaaacctgacacttaacaaatataaaaacattttgctcaagatccatatatatagggtatgccttgtacataacacagaccacatatttgaatccagttaacattctctgaaagaatgacccatattaatggggattcagagctaaaacatttggggttcttcaaagaagagaggcatttatcaagaggaagctgcctctaagcatgagttgaaagcagttgtatatcagactttatggagagtagtggtatttagttgccgttttgtaagctgttcttatatggtactaattttgttttgttttgttttttgtttttgtgaggttttggtttcgttttgttttggtagagatgccagggactgaatatggtactaatttgtgactcatacttaagagtagttaaatttttgcatgctaattttccttcacaggaaaattcaaacttttaagaactttcagtcttgaactttccactgtcatctgactttatctgatttatggctttgttttgcattttaggccaaggcaggtgaagcaccaactgagaaccctgctccacccacccagcagagcagtgctgagtaacaccaggctcctcaggcaccttcaccatcggcaggtaagagctggggcagcccagtcttgagttggtattttctttttagtatcactggtttctcaacaagagtacaaattagtctaaactagttctgcagttcatctgtgccaaccccttgtctctattgggactctgtggaaaaagtgatttggtggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgag

SEQ ID NO: 68548 - DNA, 1114 bp, Homo sapiens
taaaacatcatatgcagaagctgatcgaaagctgcttttgaacatgtacgcttattcctgtaacttaactgcatttagttaattgactgaatggctgactttcctacctattccatgtcagaagtaaaagttgtcttgatcctttaaaccatattttttaataatctttataatatctactagctctctgactaagtagtctggttaagccagtcaagagcatcaaaagaaaattcctaaagctctcatccatataactaagctacttcaaggttgtcagtgtgttctcttaaaaatatatagatggatctctaggatagtaaaaattattgagatcaaatataaaagtcttcgccaacgttttctactattacaacgctatgaaatttattgggcataatagaaaaaaaaaataggaatatataggccagtggtatttgccttatgcactaaggacataatatagcatgatttattagtgactgaataacttccatttttaaagaaaatagttctatagatttgaaaattaagtagaatcattcactgagctactatgtgcttgttgtctttgagaaaataattatatgatggagggaagggagcaacattgtggcatctaccaggtgacagatatttggaatcggttcttactttagttgtctctagagcctgagggaagcagtggtttccatattttttgttgttgtcacaaatgaaggaatttgattacttttaaaaatcagcaacttttattttacatggacaagaagtggtagaacttaattttaattcattttgttcttgtcatccagtctttctggcagactctcatcctttatacacgttaattgctgtttctgtcagtctttttttgtgactcaacagtttctgaggaagaaatggccgagcttacttaggaaactaaagagaggctcatgtgatggggatgatgtgaatgaagggggagagggtatgaggtgagatctcaggggaggtcagacatgctggtagaccactgtaaagacttgacctactgtaaatgtgatgagaagccagtaaagggatctcaacagaaaagaaacattgaagagattattggactgttttgttg

SEQ ID NO: 68549 - DNA, 5022 bp, Homo sapiens
tttcttcttgttgctgccaaaataggagaagtttcactcagtacctttgtgctggacagagaatcatatgagcccatgaatagggattgtcctcttggtacctcctagactaacataggtttcaacacattctaggaaaataacagtatctcaagtctttcccattgaggaatattcttcctggtctagcattgcttctactttgacagttgtatatttgctaatttatgttctttaaagaggttacacattgcttttgcgattgacattactagacaagaaagcaaaactcaggttgtatgagcaaacaagccatatatgtttaaatcaggatgtgaagtaccttgctcactttgtttaaaacctagatctgtttttaaaatcacagtgggaattcttagtatgttctgccagtcttatactctagcagtccaaggctgttttttgagttagtgtatattctttttaattttgaggccatctttttattttcttctcagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagttctttagtggtgatttctgagattttggtgcacccatcactggagcagtatacacggtactcttaaggggaaattttagcgctcagaacttttccagagccgctggtctcattagacacttgccattcagaagttgtatcagttaggatatatttggctacaagtaatagacatttaattatcttttaacaggaagacttaagggagacagtgctgaggttttttttaacaaggtttctcttcatttggctcttttttctggccagaacctagtcacagacattcactggcaaaggggaatggatttccatcattgacttaaccttgttgttcattctttggtgccgacactgttgacctctaagaaaatcaaaatttggttggtgaaagagtgagaaataacttgtgaacaggcaataaaagtacaggccacagaactattaacgaatttgccttggttaagaggctgttttatttagcatagcatttttccattatttcaaagtaaagaagcaataagtgattctgtggatttttagttctttaggttggtttcaatgcaggggaaagagtttgtcacaaatctggctggagctttcttgggaggctcagtttataggagtattctcaaggcacccaaaacggacccagtatatttgtggtcatgagaaacttactagatttgaatcattcttggtgtttctagaattagaaccaggtattggcacattgaagaaaactccgaatgtttgtcagcacaggattgtgactgcctgtctcatccaaagaaaaactcatcagaattaaatatctgcagattgagaatgacctatctttatgttttgatagctttatatctttctgtttacctaaatgcttttcctccttattctgccatcatcacatcctgcccaaattaattctgtcagattccttaggacttcccacttgtttctttgtttttgcttatcttatttggtttttaataagctatgagggggatagctaggaatgagctgctgtagcatttcctacatcatgttctctttgaagttcatcagagtcacagagcgctaactgtgattattttgactcccaggttaattcaaaagcaaaagtggtagaaaaacattcagtgaaaaatttttcttaaagacttttcctgtccaaaacctgaaaattccaaagtcatgcatataaaagatatttagaaacaaaattgttaaaacgcttaagaaacaaaattgttaaaactcttaaagtatacataaatgagcttttttgttgtaatatctaagtcccaacaacttgttcagtatctctcaaaagagtgtgttcagcattgctggtgccattattatgctttgtaaaactcttaaagatttgattgtgtgaaatgcaaaagaggaagataagcccaagaagaaaaacagtttatgttgtctcacacttaatattttggtaagcattttctgtgcaaataaacgtttacataattgtgaatctcatctttggtagaggttttatgaagagtagaatgacttgattttttttgaagttagactagttgaggcttttttggagggggagtttggttgcacatgtggacttgttctggaagggtccaaagcttaaatacactcctgtaaaaaaaagtaatgggtcattattttgctttttttatttattcatttttaaaaactagttacttcccattaaagacatttgcatatcccctttaaagtaagacttgaaatcacagtctttgtaggatgtttggttttttaaaatgtaaaatggtagtatatgatataatttaaatagaagaaaaatataaaatgaatcggtaaattcctttgtgaatattaataagatctattatttagaaacctccaggattagggcttactaccatcaaagtatgattaaagctttactcctaaacatataaagggagtcatgccttaggtcagtggttctcaaacttcctgattttgggatctgtttatatgcttacatgttattgaggattctagagtttttgtcaatgtttatttatattaatattatattagaaagtaaaataaacttaaaatgttaattgattaaaaataactatatgttcatgaaaataacagtttttatggaaaaaaaatatttaaattgaaaagagtggtattgctttatacttttgcagatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattgattgctcttgcttttctgcttcttggtattttatctgcacagatctactctaatcttaatgtagtttatcccaggcaatcacatgataatctgggttaaatgcattttgtctgtataatggaaaggattatattgctttggggagattttattttggtgatattcatcctaaatggtgttctttggttctttccttgctaaaacttcttctgaatctctgtttctttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggtaaaattgcaactgagacttctcttcagcaatcctcacccttccgtccttctctgcctcctcttcctcctcctcctccaacatcagctgccagaaaccttgcttatggcttcctgatgctacaaaagctgaggcaaggccttcagtctgttttttcaaagcagtcattccggtaacacttctaaaagcaaaaccacgtgatccatgcctataatagggaacccttatggccaaagtttctagttgatagaagaacaaaagaattaaggtaacaagacaggtggaatgtgtaagagcttggactctgaagtcaggctggatttgaatcctgtttctgctacttatttgtgaggttttgagaaaaccaagttttagattaagttcatccattaagtgggggcattaaatgcctgcaccatagggttatgatgattaaatataaaggatttagcaaaagagatgcctgcagcataaataacatttttaaagtattggttttaaatgagacagtgctgatttttaaaggcaacctaccagaatggaggttgttgattattgattctcctttttcactgcagaatattagtacagctgttttgagtttgttttgtgcttaataaaccttacatcaattttgcagttcctagggaacttggaaaactagggatagatcatcatttttgttatcagtagccacaacttttttctcctcagtgtcgttggggtttcttttttttcccctcaccgctagatgttttgaccgaacattatgttcagtctgttctttgctacccttctcctgtcccatcatgcatgactgtgttctttcttgtttttttccttctactcttcaacagctgcccctgacaaatgtgctaaaaataacaagtagacttacatatatggagagattgggtacatgagacatagtagctttagggcagcactctgggcttctaggaaacaaggacaggaaaagtcagtgagattgtaatatgcacttatttttagcgtcttaatagtgctttcctgaaatactcctccttagtgtttggcttatacaacatatatcacgtttgctgaaagcatgatgatt

SEQ ID NO: 68550 - DNA, 2709 bp, Homo sapiens
ttttcaaatagttttatttttgcagttgtataaagtgatatttggttagaccactttctaatttttaaagcctttgagtccttagcaaaaaaaagaaaagtctgtttcccttttagcatcctgttctcctgatgtggttcctccttagtgtttgcctggagccaatctggcttctgcctgggtaggtattggttaaagctcctctgtcagagcagctctcaattgaagtaaatagcgcagagaagcagatagtaagatgagaaaacttccagttcccagggtagccctcactcttgttaaatgaggcatgttaggacgtgtccaggtcaaaagctgcaaattcccttagatttgcaggaaatagaggaaatgggtaagatatggagcttctctgctataggtgcctcagtttttctttgctttattagcctaggatgttatttattctgttattaatatgtcctagacttcctttataaaataggttaagagaaggaatactatccttagtgttctttttgtttatttagttttcagtgaattgtctgaaatatgcgttctcagagtataacaataaggaagatagagcagcaggtactaatgccagcccattctcttgcagtgcagaaatccagaatacatctgattttctgtgtttttgtttccttctgtttaggtttgtgtgtgtattggagtgaccgtaggagttggagatagtggtatctagctgtggtttctattgtttatatttctacttgactggatatatctcagttgcatttagataatttgagtagatttattttgttcagatacagtgacttttagggtcataatagtgttgtttataatacttggaggtttgaggttaatagaccttttagggtaagaattctgaagactgctagagtcaaggtcctcagaagttgctgtattggtggctggctttattagcctgtgagtatatgacccgattccagcccccgtgaggttgtgtggtgagtcacctcaatgtgttgaggcttgcccagtttaacaggaaaaagggagcgagccggcagggaggggctgtttttggaatggctgaatgttcatgctgcgtgcctgtcctgaactgccttttttcctctatgggtgaggtctctgctctgttggctcactatttcttttccctcctactcagagttaggggacgggctggattacacatgcttaatcgctttataaaataaggttgacctagttccatagaaacgcaagcccctttaactgtttagagataccagccaaagaaatggaaatgcatggcaggaattattttctgccttcattgatggaacaagagagagcagcacctattcataagcagatatttaggtgtagatgtttaatgaagaatagcatcttcactaaccttttaatgtattatcagggaatgtaggatttgttgacatgaattgtgtgatgggagaaaagttgaataaatatcatataggtagagtacagggatatgaattccccctcctccacttcccccatcatccctggggctgttacggttgtgacttcagataaatcactttaactgttagcctcgtgttaactcatctgcaaaatgggaggagaggggggaggccagattattactaatacgttctgattcttgagataattttgtttactcgtcagaaatatttatccccttggcattttaatttgtttttctttatcactgcctcctttcctcctccggagattcagagaatctctgaagcttaatggtttgaggtaattaatacatctgatatgatcaggtgatcagcctgtaacagtagtgtgtagtcactgcacacactgcagttatagaaaaaacatgttctgtttaatccacctgtcaagatgaatagcacaaatcaaggaagtaatgtggaatatagttttatagtgctttcttgttgttgtgttggagatccaacttagtgggagaatggtggaaaaataagaatcggtcaacagtttcttcaagttcactctggtgtacttgaaagcagtgaaatctgtggccaatattgaaatatacatcgaataaaattttctgttctctttccagactgccatcaagaagaataacccacggaaatatctgcgcagtgtaggagatggagaaactgtagagtttgatgtggttgaaggagagaaggtgagaggaaattgtggttgggtatcaaagtgctggcacatagtactgttgcacaataaattatctatcagccccttatgaattgacatgactttggaatttttgtacaatagcaggaagtgacttttaaacagaattttttttttttttaagatggggtctccctcttgcccaggctggagtgcagtggcgcgatcttggttcactgcaacttccaccatccaggttcaagtgattcctctgcctcagtctccctaatagctgggattacaggcatccaccaccacgcccggctaatttttgtatttttagtagagacggggtttcaccatgttggccaggctggtcttgaaactcctgaccttaggtgatccacctgtgtcagcctcccaaagtactgggattacaggtgtgagccaccacacccagctagcagaaatatttttgacattgtcattataaacattctgcaataaagatactttaatttcttatttaataaatgatca

SEQ ID NO: 68551 - DNA, 1052 bp, Homo sapiens
ttgtcattcataattgattccaaagatcatatttgaaatagttgagataaatataaacctacaaaatacaagttacatgaagttttattttgtttagattccttctctcaattctgctaaaatcaggcattgtagagaagtggtcctgctcatgaggtagagacaaccattatggtaaagagggggattttatggaaaaatgcttaagtttgattcgcaaaactgtagagagcaaggtaaacaaagaaacaagcccaaattcatcatgtgatttgaaaagacctgttatatcacgtctcagagtggtaagtacagaactggattgagacagcagcagttctataattattcttgactcctctgatgagctcccacttggcgactggacaagttgctttacgtctttgtagattgcctgttaacaaggagccaccttgtttctcattaaagtttgcctaatatttccaagtatgaaagtgatgtgttaaggtctttcactcttttattgtagctcctattttgaacttataaaatttgtctaggttaaaacttggaacattcatcttgaacattctttttttccttcagtgtttctcaattttaatgattacagaattgtatagacttataaccactccttatcttgcgagtttcctgaaaagttgaataaggaagaaaggtttagtcttctgaaaagtatttccttatgagatcttggcttgctccattttctttttctaaagtattttggaattaagcttttaatggtttctttaggtatgtttaggctttgtctaatgttatcaagatcttagtgatatgagctatatctctctgtaggtcagatactaatttatctgcttaatcctattttagccaccaaagtccttggcactgtcaaatggttcaacgtcagaaatggatatggatttataaatcggtatgtgtgtgtgtatatttgcatgttttaagtttatacttacattgtggcaccaggagttataaatcccttagccttcattaatggcttatataaattttttaggtttcta

SEQ ID NO: 68552 - DNA, 1838 bp, Homo sapiens
ttttccatcatcagccttcaccttcaagtcacctcttcagttctaagtttgaccaagttgcagcggaaggtggttgtggcctagcagacacggtcccttgtcaggcttggcacagcttgttagtgggccaggactaaccagaatccaaaaacgagtcacacagtgtctctagtcccctccttccctgctgtccgtatcagtcagctttcatagcagaaggaaatctggtttttaaaattttgctactaactgggagactctttcgagctccccttctggactctgggctccttgggtttagtgatgattatcttggtgtcctagtagttagcttggcagctggcatagaaatatttctcagtaatgtttgctgatgtgaatgaagtgagaggtgggaggaggccagccccctttcctctttctgtctgcgtgtaacctcagggtgacgtaacactttcatccactggcttgcttgcagaaagcactcaatagggcccactacagccttagagagggctagagcactcctggggggtctgtcctcaaatgcttattaatagaattttgatacaataatgttttataatttttttttggagacagagtctcgctctgtcgccagactggagttcagtggtgcgatcttggctcactgcaacctctacctcctaggttcaagcaattctcctgcctcagcctcccaagtagttgggattacaggtgcccgccaccatgcccggctaatttttgtgcttttggtagagatgggggtttcaccatgttggcaaggctggtcttgaactcctgacctcaagtgatctgcccgcctcagcctcccagagtgctgagattacaggtgtgagccactgcgtccagcgtaatgttttattattttgataaaattctcaaaaactgcttttgtgtcaaaaataacaaagaaggaaattgaggaaaaggtacaacaaaggggcttaaggaattgctttaacaggttcagattagcaggcttctaagtgccccccagtttttctgacaatagaatcagggaactttcaaacattcagagttgagagaccttagagatcccctgggccaacctcctctattttttacagggaggggatccagagagctaaggggtttgcttcaacccatgggtgagtgagccaggtttggaggacacaggcctacaggttcttaggccactgcattctctgggttcatggtgtgtccctataaaaggccaaggaaactcgatataataggcttcgctctctctggcacttcctagcttggtccattttaatcacaagccagctggtctgagggcacgggggtatgtgccaaggaagatggtatgtgggggtagaaatgggccactggggtctggtcaggtgtgagaagaggaagtagtaggagggaggagatgagagaagaagggcctgacggacttgtattggcaccactatttgcatcaatatatgtatatatatatatcttttacagtgcacaaaggcctgcaagttctgttttgggctgaaggccccctatctgctgttaggactcctttgaggaatccttgggtgggccgtaggctcttttatcaagggtcagacaatcctatttatactttaatttctgtgtagtaagctccctgtttcaaacagtcaaagctaaaaatgtggcagctggccctagagaagtagctatcctgctcaggataagtaagtcaagggcaaaaaataccccagatgtgagcaccagaggcaggtagagctaagtcacattctgctcctctgagtgcagctgtatttgtgcacaccaggaaagagctgggg

SEQ ID NO: 68553 - DNA, 1071 bp, Homo sapiens
ttatatgataatagcaaatgccttttgcatcttacagcagaattttgaaggaatagctaatgtggttctgaataagtttccagagatgaaagaaaaggaaaaaacctaagtctggaagtactgtacagtgagtctaactagcattattactcagcgctcaagtatttgaacctattcagggatctgctccttcatacagttgcttattatttgtgactggggtgagacttgaaagagagcatcaattctccagtctgcttttgtttaacaggcagttccatgtctgtctgaccacagaacagacactgtttgctgtgggctggtgaatgttcactttcaagagcagggagtagatggcccttcgtggaagtttaattatacagaagagtttgaaaaggccaagtttgttactttggggcatggggaaaccttcctctctagcagatgtgaggggaccgaagtgtctcttttcagcagttgtattcttcttgctgtggacctaaattcgatcctaagtcattctttgtatgtacatggcagatgagaagatgaactatagactggaaaataacccttttttgaggaattgtggagaaaatgttacccacctgtccctcctaccaccatgcaataagtgtgggctacttaatactcttgaagcaagagtttaggtttggagagaaactgctcctctgatcttctcctggaaaccacaagtggaagtttgtgattttcttctcagctgccctgtcccctctcccttgggttatgacaggccgtgtaactttatctttcttaggacttatctctttgatgaggtcagtaatcctgcttcacttacgtcccctatacgtaagattgccataaccaaagatgacatgcagactctaaagcatttcctggaaaaaatgagctacagatagaagtaaggctcgtaatttaaaaaatcgaaccccagagaacagcctgtctctgaagttaaccattcccccagtactttctcttgtttccctggtgaaagtgtgaatctgggttgtggcaggggaagttctggcactgctaagaggtgag

SEQ ID NO: 68554 - DNA, 1114 bp, Homo sapiens
ggcagtttgccctgctgggagagatgtgggataaggccccagagtggaaaaaaacaaaaaaccttaaaaatgcaagaaggaagaaaggtaggtgagccagcaggtcccactgaaaggccttgttattgcagcaaagagggaagaggtgggcccagtggcacaaatcactaacattcttctgacagtcactagccagttcttctgagaatttctctgtcttgaaaaacttggtaaaatggccaaatggagcttctccgaactagggggaatgcctgtgtgtgcgttcgttgttagccatcatgttgaacagtctgatttaagggaaagttggtctgtgtacattttcatttcagctgtggtctttgaaggttcaccatggaggaggtgtgggtggatgagaatagagtcttctgcctcttggttggcttatatgtaggttataggtgaatgtgagttcacaacccccagcctatttcttatttgggtgcacttttggatgacttgcagggctgagtttgggaaaacccagttactcttcctttatgcacatatttctgccagactaaatgccaaatagataattggaaagaattttcttcgcagccctggtccccaaattggtgtctgtgattcttcctagggtctcatattatgagagtgcactccctttaatcttttgggacctcaagtggggtctgtgtggacaagattgtgcttctttgagaaacttcttgctgcacaccagccagggtaaggcaagagttagtcctgttggctgggtggttcttgggcagttgagcatgcttagcacttgagaggtttctgttataccatttgccaaaagggacatctctccgctggtcctagtgccccagggcacaaatggcaggctttaggagaaaatgcacaatttcaggttcagtctctatctgcatttgtgtgcatgaatggactaataattgcagtgcgttgaacgatttctgcatattccaacacctagaaagtagcttcctggattagggaacggttcctaggtacagctaccaaaggctcaagcttaagcaccaacactggaggttagaattagcacgctctagggaggacagcgagaggg

SEQ ID NO: 68555 - DNA, 1022 bp, Homo sapiens
tttatatgttggtaggttgtgtgtgtgtgtgtatgtgtgtgtgtgtgtgtcttgtctgtcttcagtggtgaactgaaaaaataaagtgttgtttacgtgcttctatgttagtgtctacattccaaactgggcaatagttttctttaagctggcttaagtgaagaggtgtttggtcagccacagggtatgaatcaaccaaacttcaaaaagcttcagtgtgtttttgataacactcttaagtatttaatagctgctttaaggatttgtgccttagtgtacttggatgaataggtaaatcacctccccatcagcaaactagcgtttgggttcccacgttggcaaagcagggttcctgttatgtgtctggtcatatttgaacttcttttcacattcaggtgacatagttgaacatcagtccgtgccagtttctgctactattgggtttttaatggaagagaactctttcttgttactacgatgccatgcttctgctgtgttagcagctgctgtattgaaaaacaggtgtctcttataatcctctgactggatcagtttgctagcctggcagagtcttattgttattgtttttatttatttatttttgtcccacataagtcagaaactgccaagagatgttgatgagtgggattagtatgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcct

SEQ ID NO: 68556 - DNA, 1013 bp, Homo sapiens
ccttgaattatcatccacactagactgaaagcctgctgaggacaggagtctgatgggttcatttttatatttccagtgtccagctcaaggtctggcacagaggacagccaatggctattaattgaatagaatttcttaatcagtaggtatttattaagcttctgttacggacttaattggtgccaggctctttgatatgtaagataaagacctcacacagttgacatcctgagcaaatactctgtgagggttgaggaaagaagaaaggtagagacctgtgttttgaaacatatcaggactccatgtcagggcgaacatactgccacctcccatacctaaggggctcctgtgaggcataagtactgacatgtacacacagggcactcacaaatgctctccttctcagttgcctactttctagaggggaatatagatagctggagaagaagcttgagaaccttcaggctggatgtgccagaaacagcagagacagcccaagataaatgaatgtattaactgatcatccttttttttgatgtggctcaggatgcctcttgggtcagggagagagaaccagtggctgtttgttgtagctgtgtgcggtcttggccatagctggctgtggtatctgggacccagtggcaggtcaccaccgtatggggctgccagttgctcccccaccccattcctctaagagctagtagggagagagaacccggaagagcagcacggcttgctgaaacttctctgaggtctgtgattggcctttccatgtcaagggaagaatccctctcttacttgagtcagctctttccagtcttctcttgtacagcccatgttctctcctaccctatctgagatgaagatctctctggagctctcattttactcctaatgggttgcctggagggactaaaccagtgagaatgactgggcatactatgggactagaaaaacaactcaaagttatgtcttacggatggtaggacagcctcaatattgctgtttacagt

SEQ ID NO: 68557 - DNA, 1053 bp, Homo sapiens
atatcagttttcatggccaaaatttgccacgtggacataatagtatttggtatcaagcacgcctttcaggaagaagggaaaaacagtagattttgggcagcttttgattacaataatttcaaatttctaataactaagaagtacttcatgtgattcttgtagagtaaaagcttaaaaattacccttttctttgtaagtgatatgagtcttacttcgtttgggtaagaaactcagtttgaggctaccaatttttcaaatagtggtcttagaaactaattattgctgtaatttcaataactaaataggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggatcagttttaagaccaggtcagacatacgtacaaattctttctttgtaaatgagaagtggcctttaatagctttcatatggatagatgggtagatgaaatattattctacctaaagcatgacatttcagtaagtactacactttgaaacttgccttgcagggttttaaaaatattcttttctgggttctaatcatttataacgaagagtcactagcattttattaaaacccatattttttggagagggatattaagtgagcagggattgtgggttgttcttgcttttccttaactgtcctgccccaaaaaagtgatgggaataacccaaaccttaaaggttcctggggctttctttttccctagacagggacctcctcctctcccctgctctcatcccacttgttcctgaaaaagggtaaggttggcagggcggggaagagagaaggaaattagggttctagcttaaaactgctgctagagtggctagttctg

SEQ ID NO: 68558 - DNA, 1436 bp, Homo sapiens
cagaaccgtggaagagtccggagcagatgctctgtgggaaaccctgaattagccaagagcaaaagttatcgccatcctactgctctgggaaggctgcctgttggagaaaacctctgtgttcccttagccttttcactgactggaggactttccagacgaaatctggcacttctcagtaaccttgaacttgaacattcagtgacagaagggaaagggagagggtttcagctgctggagctgggtaactgtgcagggctctcgcagcgggccatttgtggctctgagggtgccaagctgcagtgttctgagggtgtgtgaatgagggtgttgatcctggctgcagaaggggcagctttctgagcaggtgggagtggtgaatgaggaggggatttggcggggcaggatgtgagatgagtttactctgctgggaaagaatttggagatgtccatgaagaagaaaatctggatgactattgagggagggctgatgttggagagaagggctcatactacaaatcagaataaaataaaggatatcttagtatcaagaggaaagcactgttaagatactaaaccttctgctgcccaggtatctgaggagagaccatggaagagttctatatggaacaaatgaaaaagcagtaaagtcaggtctagacctggagtttttagtaataccaagtttacataggaagtgtctgggaagtagtgattagagggaaagtatgttggatgagtgaatcattccttcagaaatcaatattttttcctactaggccctccgaatgtcatctttgtagttgcccaaatacatcagtttctctcttatgtaagagagcttgtctcatttttattgctgtattccattttcaagtgtcttcttgggtaatgatcctgtatttgatcttggccagatattatctgtgactgttgttagagtgatccttttcctttcccccgagttagtcaaactgtgtgcgtggtctctagactgagatttggcagtgattccatggctcttgtgagtggagttgactaacaaaactcaggaatggaatggccatattttggaatttggttgaagcaagtaaagtttttattcttctaccaatgcaaatctatctcagggaatttctctttattcagaaagaatgacctccatcccacctttctctaaaaggtacaaatcgtaatgcatatttgacacattagttggcttttaccttggggaccagcagaccaccccgcagatacaatgcacggaatctagcaaacaataaagagcagtgtgctcgcgtggccagatcgttcgcttccttcctttttcgccttcatttttgggaagtccttgcctcgttagttccataggccatgagacatagcaatataaaatgccagaggatgttcaaatgggcgtgtggaggaagagggaaagc

SEQ ID NO: 68559 - DNA, 1010 bp, Homo sapiens
tcagggcaggcatctcatataatttgactcagccctaatacactgattttcttacagccaaggattaactctctccattaaagactcatgtgaggggaagaacagatagcaaagtgtttgctaaaatgatgaactgtccctatttcaccttcaggcagcaaaatcatctgcttagaaactaattagagcattttccccaggcgttggtgatctacttctacatgcctatgatctcttagacagtagttgtaccatgttcaggaactggccataaagcagccctctccctagcctgtctccctctaatagaagaaggctgagagtggctcattccttcagatgaatctcagaccttttatttcagattcatttaagggcatttacttctctgtgatgctccttactttctgttctttaaaatcttctttgcttttggatcccagggtagacaaggaaaatgttgcaccatcatatataggtaggtaggagactttaaggtgctcaaagcctggtcgacattttctggtggcacagatgaagccattttctatggaagcctcctaggcaagactctgtcctgcatcccactgagtatagacctaatttctttctaatatggatggaggaataagcatggtcatttatcatgctgaggcagctgtaagccgtctgcatccgggttccattgcaattggaacagtagcaaatccattgggtttctttgtttttcagggtaattttctttcccttacagtgtactacagatttggggtctgtggtcttaagtgaacatttacataaagttagctatttatgattttaaacaaatttcatgcccctttctgctgtgttgttggtatttttggtttctatgtatcataaaccacagaagttcagtgacttccatggaatgatgtggaaaatcaggaagtaagactgaaattaagaatgaaaatttctgactatatgtgtcatgctcattttcaccgtttaaggtctttcagaccaca

SEQ ID NO: 68560 - DNA, 1053 bp, Homo sapiens
ctggtctcaaaactcctgacctcaaatgatctgctagccttggctttccaaagtggtgggatttaaaggcatgagccactgccccccaccccaccgccccaccttttttctgttcttttttttttttttttcagctcactgcaacctccggctccccgctccccacgccccccaccaggttcaaacgattctcctgcttcagcctcccaagtagctgggattataggcacatgtcaccatgcccggctaatttttgtatttttagtaaaaacgaggtttcaccatgttggccaggctggtctcaaaactcctgaattcagatgatccacccgcgtcggcctcccaaagtgccgacattacaggcgtgacccgcacccagcgccacaccccctttttttcttaataagaaaatgagtagacacatccctgggtgccaatcactcatgtatcaagattgctgagtatgagaaatcagtaaattaatatgaagaacttaaaacacagttctagccaaagtaatgcttaataagtacagtattgtgcaattattgctaaatagcatacatttattgtgttcctccatttaagatactttcaagcattgtagggaaagaaaagcacataagctgtagtctttagctttaacggacttgtagcctagttgagagaagccatatgtgtaagatgacgagtaatagcacaaagcagtgtgtgatcagtgccaaatgcaaatatgtactaaaggagtttaaagcacagagaaagtttgctgtgaactggaataatgataacaatggtagcaacagcagccagcatttactgagtgcttcccgtgtgctaagtactgatcaagtctcttacaggtattcgctcatttattctttatgtcagccatataagaaagatgtttctattagttttcctgctttacagctcagaaaactgagtgaggttagctaacaggcccagggtcccacaccagggaaatgtggagtctgggctgcctgttagagtcttggctgcctgactccagagccccagtcttagccacgt

SEQ ID NO: 68561 - DNA, 1090 bp, Homo sapiens
acctgaccactgcttctctaggcgtcgtttgaatatttaaagacaaagcacagtacatttgctattttattttattttatttcattttatttcatttcattttaaaccatggctaactcttctccagtcttctccaggagaaaaaacttgattgtcatcctggcacaaaaatgtccacagttaggctaacaggcaagcttccgtgagcagatcaaatttgctattctggttccaacatttaactccctagctttttttaaaagaaaaaataagctggcatcaactgaaatttcaggttaggggcttggtttgaggatgtttggggaagcgggagctttctgccatgtcttttgtggacattggatgtatttccgcattctggttggccacatttccccctggggcagattcttcagaatcatttgtctcccactgggagtctttttccctcccccccccccccacccccctttgtctttttctctgacatctgccgcacactctctccagggcatacggtccagaccctcctgggagagcttcatctgcttagtataacttctagcagaagatagaactgatggattttcgtgcgcaaatacagattcacaagggtgttcggtgtcacaagcatggatttatgatgcagtttgaaaagggtcagaatattcagagatgagattaatgccagcccatgagtgctttgtggtgctgaggtaactgaagtgcatctggtggtgtccagagctcaagtccccactgcagacgccaggaagaaagaggtggctcgcagactgagaaggggcgtagggatgcacccttcttgtctccttctgcttgataatttagatagaggatggcaggtgtaaatcagtttgtggtagatgcagtgtgagctgtcctttctcccccttcctcacgtccttacaagacacctgtctgctttgtatcgattccggcactgtgttatgatattcttgtagtttcatttttttgttgtttctcttttgatattggactttatatgcaaagaatgggattagtcataatctttacttcaaaacacattatcttcatatttttatgctgg

SEQ ID NO: 68562 - DNA, 1085 bp, Homo sapiens
aggccaggcgtggtggttcacgcctgtaatcgcagcactgggaggctgaggcggatggattgcctgagcccaggagttcaagaccagcctgggcaacatgacgaagccatctctacaaaaaattagccaggcatggtggcacatgcctgtggtcctagctacccgggaggctaaggtgggagaatcacctgagcccaggaggttgaggctgcagtgagctgtgattgcaccactgcactctagcctgggcgacaggatgagaccctgtttcaagaatagtaataataataaatttaaaaataaaatagaatgcattattatatgtaccttagaacttaggtcttagagagtgcctacctctccttgggagagaagacttacggtggtgggagacagtgttgcatctgtcagataaattagggaaggcacatggggcggacgatttcagagaagttaaaggcatgggagaacatttgccacgcaggccgtggcaagtggttggctttgactgtaacatgcagcgtatgcagttcctggaggcagatgagggaagtcatgcagtacttgtgtttctgtgagtctcttcagttttggggtttgtagacaggtcatgttcacttactcctaacctgtctcccacaatagtcatctgggtctgtgctacttagtgtcatcctctcactctttcccttggtggcatatccagttggctaagaggacaggcctgaccttgtgcccagagtagggagaagatcccgatcacctctggtccttgtcaggctgtttgcttggatggtagagttcacccaagttcggactcaggaacggcctgtggtcatggagtagtttttttctgtccagggtctggaccaagataactccatcacaggggtagcaacagtatgtgctggggcaattctgctacccacttctggtgtccttcagtgctttccctgcactatctctgtccccagctgcttccatccatttgctttctagtgatgaagcactgggggaagctgcagggatggctgctgcacccacatccatccctgcccatctgttctcagagactctatggctag

SEQ ID NO: 68563 - DNA, 1049 bp, Homo sapiens
agatttccaatcatgcccataaggtaatgcaatttggcaagaggatttggacttgacgaaatctcttgttctatttggcatccagaaaaggctgacttgcctaatttgaaaataaattgaaaacaaaaaaaatttaaaaaaacctctggttgttccttgtttgatgaaataccatagaaaactattactctttttccataccccattactatggagaatatgtttttaccactgactcttctaagtatctgtccttagtttcctgtccttccctgccacaggttccaggaaggctgaatcactacagcatggtattaaatcatagaaatacgtgtgtattttgtaccatgtgggtctgcttgcattcctaacatctgcattagtattagttttctattgctgcataacaaactgccacaaatttagtggtttaaaacaacattcatttcttatctcagtttctttgggtcaagaatctggacacagtttacctgggtcatctgcaaagggtctcagaaggctgtaattaatgtgttagccagggctgtgttctgatctgaggcttgactgaggaagaacccactttgttagcagaatttagtaccttgtggttgtaggacagaggattttagtttcttactagctgttggttggaggcttccctctgttccatactatgtgggcctcccaacctagacacccacaacatggcagcctgctccttcaacaactagcaagggagtttaatgttttcctgtagctcatatttctttataggtgtgacctcaatttttcccctaatacctttgtaagatagaagtagggagaaccaagatagatccaaaaaggctgaatgaaatgcctgagattgagctggtggttgcattgaacaatataaattgatgaataacaatttattaattgtgccaggcactgtgctaagagcttcatgtcagtacattcttgtttagttcttagcacaaccctctgagttaggtattactactactaaactatttaacaggtagggaagttggggattagagagg

SEQ ID NO: 68564 - DNA, 1047 bp, Homo sapiens
caggggtcttcttcctgtttgtgaattatgactactccaggtctctccgtaagtggaatctcatttgaccttttgtgactggcttatttcacttagcatgatgttaaaaggtttatccatgttgtagcatgtgtcagaatttcattcctttttggcagccattgtcttaagactcaagagtttaagtgtttttagtctctgtagccagaggtagatttttcttccagctctgtgcttgggcatttcccaaagcgaaacttccaaaggcacatcctgtcttcctgagtggtattctttgaggcagctgagtagcaaaactgaggctattaatgttcgcttagcaactgagcagctactgtgtatcaggggctctgcctgtgaccagggagtacacggtcttgtagaagagaaaaccgggtactcagctaactgtggtaccatgtgctaggtgccaaaggaggaacagagggccctgcgtgatctgctcaggaccgtgagggagaggtaagaagagttcaaaggagaggtcatatttcaaacagaccttgaagctgttcaaggcagagaagaaaaggatggtgttccacgaatggcctgagctaaggcaagtggaaacacgaggtttgttggaagaatcgcaaggacagcctgatgtttatagaaagtggagagagtgtggggaatgacattagggcgtatatgaatgccatgctaaggattggggtacaggtaacttggaggcctcatgcagttagactgaccccgttcgatctgtgggttgacaggggggtgtgaatggattggaatgggagagaccactgtgtggggcaaatgggaagggagcgtggttgcagcattttaggccagagatggtgagggcctgaagcaaggcagtgagagagaagaatttgctcatggtcaggtgcatcgggcctgttgacagcagagtttgttggactgctcccacctattgctttttgtcttctgaagtttttataatttcaattccagtttagaggtctgtttttagaacatttctccgatctt

SEQ ID NO: 68565 - DNA, 1051 bp, Homo sapiens
agtttagtaaagggcagagcagggactagactccatttctcttcgctggaagagcccagcactatcacattgcaagattgtttcttgtaaaacagtcctgcataaaaataaaaaagagtagagagcatgatgtgaatttcagcttttagaggctgctgtctgtttttcataggttaaatagtgaatcagtgtgctccgagcttccatgaggggcagccctccttacctggcaggttactgagttttctaatgacttcagttttaggtgctaggagatagtagggccacctgcactgttttgtgagcaggacagataagaggcaagtggagagggtgggagagcactggcttgcatcatacaccccagctgcccttgcagggcccgactgttacaagccaggtatttctaggacgattgcattcctagccatatctgttttctttcagatggggcgtacaatttaccttttgagttctgtaaatggaatcgaggtgaaatctttactctggtgcacatatgacctgcaggttgatgctgcttgtttggaaagccctctacttcacagcgaacagtttgtactgtcaggtagacctctctgccaggggaccaactcctgtgtatttgaaaaggaagacaaacctgtattttgtagaaagggtctattgttcccagggggtggttgtggccaacttcttggactcctttggctgactctgaagaaggaattgaagtcagaatgctaatcactgacttgcacaggcctcaacaatcaaacctcagggaactcagaagaaagtaaacaagagcgctcaattgcagagtcttgaagaagagcagctgtgtaaaggaggctagacgtgaaaaaaacgtgttggagaggaaaaaaaatcacattccctgcttctcaaatgggaagtcttaaaaataataaagaatcctgagcagcgggctcatttcccatgagcaggcttgctgtggcaggcaggctcacctgctagaggtggtctcctggcttagaatgggagcacacctgtgggaatcgcagcgctt

SEQ ID NO: 68566 - DNA, 1060 bp, Homo sapiens
attctatatgtaatatttgatatataaccaagaagctatgtgagttacaaagcatgatgatacagtgaacacctatgaactcaccacccaacataagaaccaaaatgactgatattgataccctacctatatacctctaccttcttcctcattctacccctgccctcttatcccagttagccactgtcttaaattttacagattttattccgttcctttttttcttttttgaaagcgtttgatcttttcttctctcctcctctcctctcctctcctctcttcttcttttctttcttttcgagatgaggtctcgctatgttgtgcaggctggtctggaactcctgagctcaaatgatcctcccaccttaacctcccaatagctgagaatataggcctgtaccactgcacctggctagatctcatgttttctttggaaatctagtaattgtgatataggatctctgaatgcagaacacctagggcacaagtgatgcttaattttatgtgtcaacttagatgggccacagtgctcatatgtatgatcagatattcttctggatgtttctgtgaaggtatttatggatgagactaatatttaaattggtggactttgagtaaagcacatggccctccgtaatgcgggtaggcctcacccaatcagttgaaggcctgaatagaaccgaagagggaatgccacagcagatggccttcagacttacactgcaccaccggctcttctctgggtctccagcctgctggcacatcttgcagattttgggcttgtctgcctctataagcacataagccagttccttaaaataaatatctgtgtgtgtgtatgcatttatatatacacacaccaccctattggttcactttctctggagaaccctgactaatacagcatatcacacctctctgtatgccacgtaggtagcactgcagaattaatttgcagagtattctcacatcgggaggtcagcagtatattaggcgcatatcagaaaggcatttggatgattctggcctacaccatggaagagaaaccttgattttctgt

SEQ ID NO: 68567 - DNA, 1957 bp, Homo sapiens
tacccttttcctcctacctctgacacctgcccttcacctcccacctgctacctgagatgggagccacacgtgaagtgagaagaagggagaatgaccaggtgggtgatgaatttaaactggaaagagaacagatcctgatgccagtcaggatagaggtggtctagctcttatgtgatcatgggcaagtgaacatgcctcagtgagcctctgatcagtttctgtatgaggataattatatttatcctctaaaatgaggataatgatatttatctgatacagttcttctgccctaacacatacgtgtgcattgcctttgctttcaaatgtttggtaatcacctttttagatttaaatcattactcaaattgaactctccttcagcctttgtgtgtctagactttccgttaagattagattacttgttttactatgattgtaaaccattgtttccatgaagtctcatagcaaatgttcttttgctttcctcttttgttactagtctcttgttatttctcaaacatatcaagcgcacttctccctcagggcctttgcgtgtgctgtttcctctacatggagctcagatgactgcatgtctttttcctaaacttctttgaggtgtctgttcaaatgtcttccactcaggggggctttccctgagcaccttatagaaaataaataaaatgatataatatctgctctcacgttctgttgcacttgccttgctttgtttttcttcatagtctttatctggaatatatatttatttctgtctacatcctcccactaggacagtggttcttaaccttggatgttcattagaatcaccctgggagtttaaaaaaatcctctcctgtgttctagaacaattaaattcagtaatgttataaggaagagactcagcattagtattttgtaaaactcccaggagattcctatgtgcaaccaagcttgagaaccagtgttctagtctagaaccttacttcccagaggatgtggactggtggcatcagcatcacctttatttgaaagctgagtccaattcttctctttggcaggacccacagatgatgcatatgacattaaagcttgagatgcactgcactagaatgcaggggcgtcattttgcttgctgctgtatccttagtgtcagaacagtacttagcacatcataagcactcactaaatatttatcaaatgaattaacgttggagatgagaggaaggaggaggtaataatggaaagaggacaaagaaagagaggcaagggaagacagaaagaaaacagatttggcctccccacattttctgggcacagatataacggctctctcttgctctttgctcccaatcaaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgaaaaaaaaaaaaaaaaaaaaaaagatctgtgatggaagacacttacagacatgtagacagggtggtgtggaaggtctacagtaagtgactgtttcagactgaggggagggagtagactcctggtgaggagggcaggggcatgtgagttgcgtatgtgagtggctggaacacaaggtggggaggcatgcttgtgtgctttggcaatcacaaagacggttagaaggcagttaaagggttggagtatggtcagttctgtgttttgaagagatgactgacagtcg

SEQ ID NO: 68568 - DNA, 1326 bp, Homo sapiens
cggtggctgacgcctgtaatcccaacactttgggaggccgaggcgggtggatcacgaggtcgggagatcaagaccatcctggctaacatgaaaattagccgggcatggtggtgggcgcctgtagtcccagctactcgggaggctgaggcaggagaatagcgtgaatctgggaggctgagcttgcagtgagcggagatcatgccactgcactccagcctgggcgacagagcaagactccttctcaaaaaaaaaaaaaaaaaaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggatt

SEQ ID NO: 68569 - DNA, 1005 bp, Homo sapiens
tttagaattgcattttgtctaaaggaaggatagatagaatactactaataatatcaagatgctcagaaactgttgagaattttttttacaggaagaacttaaatttccagaggcttttaaaaaaaaatttattaaggaaggagtaaataaatacgccgggttcttgagtaaactacttttacccttcagaaccactttgtacgtagactttatcatgatggccaagagtttttaaaatactataggcagagggtatactctagagaaagaagacaacattgggtttaggactgctagccccatccagagcagttatgtggttcattcagggatcttcttagcccttcaacctcaatttctacatctgtgaggtaggttttgtgctagttctagtgacatgactcgtgggtgtattaggaggatatagcagcatgtaattgaagggcttttatcttggaaaagccttagtaggctcaaggtttctagttgtttagggttctaagattttactaactagtcagctgcttggagttcaaggcatttcttcagattataatgagttgatagtgcagtgtgcaaaaataaagaccgaaccatggtaagtagcaaggttactgtaaggaaaaaaatgtgtcccactggcccctttaaaatggcacaggtgcatctctgtagcaaccttgacagccatcatgtgggatcattcccctcacccagggaacagtggttccccaatctccaatctctccattctccagcatgagaaagtggtctggagcttgatcacatgaagatggacagacacagccttttggatgcgagagagggaagggaatgcaggccaaaagtggggtgggttttcctttcctcttccttgttttttattaaccttgtcttgctcctgccacacacaagtgcagccagtgctcaggacactgctccgtgtggagctccggaaagtgaagctgagaagccttccttggggtggacatggggggagctgca

SEQ ID NO: 68570 - DNA, 1041 bp, Homo sapiens
tttttcccccacaggccacatatatccttaatgccttcatccattcccctcttgggaatgtgcatctttgggccattggagaggtcttgcttggactgcggccactgtgatttctgggggcagactcagctccttcttggtgtagagatctgcccactataggcaccaaatagatgttggcaggcttctttcctccttactgcttctatttatctcacctgtacttttagatttgctgctcttgggtaagcagataagaacaagggaaatgtcttccgttgttgttaaagacaatgttaggatagaaagtaatatgtttgtactcaaaaatgcccagtgagatttctagccacggccaagttatcatttgcataagcaacctggaaatgccctcttggtcctactgattgtgtcccatggttaatgtagatccctggataaattcgaatggctactcctgctcaggggtcatgccatgagaacttttctcatacatcagatagagtccccttccgtcagctgaatgcatttacccctcagtctgtgctacccataggataagcaacatgcataagaaggtaggtgccttggcttaggcagctctgttgagtcaccctcaagaatcctgctggaattctgtgaggagtgaggatgcagagcaacgaaatattcgaaggctgctatgatttttacaagcttgaacctgtctcttggaattccccattgtgaagtcattgttgactggttggcattataaagcagttcagagaagtaaagttagatcagtctgcacgcaaataccagccacaccatctcccaagctagtgactggaactgcggttttcaagtcagtttcctcattgcggaatggagataacgatgccttccttgcagggtcattgtgaggctgaaataaaataaaggcttcatgggaacacataccacatgctcacttaatgctagctctctttcctgattgtggcagtgactgtattttccagctacaattgtgacacgtgttctgagaggtgttaagtattt

SEQ ID NO: 68571 - DNA, 1186 bp, Homo sapiens
gcatgttgatctaagctacaaattgcactgctgttttgccgaacccaacagtcggtttcttgccattatttgcggtattttaacttaaaactcacggtaatccttctcaccccatctagtttgttttaattgatctaacaaacactgcttgtttgaattcaaatggaggatccatggaagctctcccaccccaccctttgatacttgataaggggtcaaacagtacttcttttaaattcagataattctttgaatgaactatgaaatacttcagagggaaaggaaatatcgattctgagatggagagtaaaagaacaaggagatattcattattgttgcagataattcctagcaatgaaggaaaaaattagacgttggatatttttggttgtggtggttgtatagtgagataggtggacaatagaaaaatcttccttgtggattgaagttctaaatctagaacttatctttgaagctgtcactttacttgatcagctcactatggaagtgaatctagaatcatactttgattagaagctggggatattgctacagaagagaaaacatggctttaatatagtgatggcattaattatgtgacttgggcaagtcattttttaaaaagttgtctttaagccattctcgcggacgtattttttttgttcccttttgtccctcctttttacttgtacaaaccacagggtgtacacctattgacatgagtccaaagtaaaggctgttttcaacgatggcagagttttgttatatagccccaaggctaggcatctgaaagacaactgtatacagtgtctctacggagagagtaagccggattgcttgggaagctggtactgcccatgccccgcctcccttttgctccccaccccgagatggtctcatacctccattccaagctttcattgtctctctccccctcccctcttcctgcccttatttttaacagcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctct

SEQ ID NO: 68572 - DNA, 1066 bp, Homo sapiens
tatttgccagtgataaaagcaaagtgataaatggagtaaagtgttaagtgctgattagagaggacttgaaaaggactggcaaagaagcctgggcagagtgcaagaggagagcccagggaagaaaggccagaccgtgccatcctgctctgactcactgcccagattaccaggacagtgcccttcaacagtcctacagcagaacccctctgcttaccgggagagcaaacacaagtatgtttgttgagaggatagaaagggcatcattttttcttcttcttcctcttcttccataaagggtactgaattttttttgaagcttgagggtagaagagccgaagtacaattacagtagacaggtgggaaaaaaaaagttgcattctttaaaggaacataagcttttcattgtagcttgaaaacacttgaaagaccaaggacccccaagggtgcccaggcaaggtcactcttgactctacgcagagaagggctgttgctgggagcaaaggatacctttgcccagttctcaccaggggacttgtagtctcgcaagggagggatgttttctgatttgtctacccaaaggccgccctttttctaaactcatgggggagtggctgctgaagggggcagttacagcacctcacgaggtgctgccagcctgctcattggcagaggcttaccttatgaaacactgggcctcagacagtgatgctcaggccccgccttaggataacaatataagtatagttcagattgatggggcagaatttaaataattaaatgtcgttattttaaatttcttttaaacatgatcatttcacatttagttgacattgcgccatttgcccgcagactgtgcattttgcagtgtccatttggccttctaaaatccctgtgaattatatttaaaaatcggaacgtaggactcattcatcatatttaatagggttagggtttatgatgttgcaggttaataaatagccataatagccgctcggcgttttctggagtcagaacaccagaaatagtcccttggctctctttcctttccttgtgaatctttcaaaat

SEQ ID NO: 68573 - DNA, 1033 bp, Homo sapiens
ccactctgaggtcaaccgtgtttaagatcataaagccactctagagaatctctgtggcattgttgtgtggaagaagaaataatgatcactactattattatatatatgtgtgtgtgtgtgtgtgtgtgtgtgtgtgtatataaaagtatatgtgtgtgtgtgtatatatgtatatatgtgtgtatatgtatatgcttcatatatattatcctgaataataacaaactctgcacagtagatattatacctgaggctcaggtaaaccacttgcccgaggtcacccagagaaagtggaggagccccaatttgaatccgtatctaattccaaaacccagacttttattttccacttcaccctattactctttaaaagtctgaggagcaaatgaaagttgtttcattctatctattggttagaaggagaatatccaagctaacaggctgatttttttttccaatttttaagcataatataaattactgacaagagggcccagatggataaaatcagagctataaaccaaattatcttttgaacttgaaggaagataaatttccatatccaatcctgtatgcacactgttatctgccagatagtctcaggtatgtgtgtaaattctggagtgttagaaacaaaactaaatgaagtaaaaagaggttccttgtctattattttccatcttttttaaagagatgatctacctcacagatggttattaaacagtaagaaagatgctgtgattgaatgaagattgtgttactgagtttacaccttaaaacactgaacttcctgataatttgtgttaagccaacacgcttcagaaaaattgcctgacgtttggtgccttagtttacccacatggcatgtgtgccagaacacgctacaacagggtaagagggcagagaacatgctcttgtaggggtcagttccttgagctctggttctacgtggctgattacttgggtcatcccagcagttcattccatctctcaggactgtggtttccacatctgcaaagtgaaatggcctgag

SEQ ID NO: 68574 - DNA, 1021 bp, Homo sapiens
gggctctcaccacttaaccattcacaatatgtctgagagattaatttttgtaaggctgtggtttgagatatctcccccttccttgttttacttaaaatcctcagtgggaaagcgtgcatggggaaaaaaaaaaccaccaccaccctggataaaaggtactttggtaacatacgtgctttaggaactataatttgtcattttattttcttgtgccctcttcatttgaaatgctgcagcctttctgccagaagtctcaagtttgtgtatgagactgagggggaaacgagagtaggtaccttgtgctgagactgtcctgggacagtcccgtggtgggtgtgagcgtctgtgtgatgcaggtatgcttatttcttcatgaaagccgcaggtactggttgcctctcgcagggttaaaactcttggcggctcacaggaggtgatgaagagcaagggcacgggagaatgaagaagcaggaggaaggtgtgggccagggtcggtttcggtggggtccccacttgctgggtgaaagctgaactgtttatccacacatcccagcagcagcagaaagccaaggggtgttttcaggactcagctgccaaagtttcttgaagcagctctgctcaaaggcatatgctgggctcacttctgagggaaatttcctttttggggaagttgaagcaaaggaatttcctgtgtgggcagacagagcttcctgacttgaaggcttcttggaagggaaacagtttcataatgaaatgacaaattaaagacataccagccgggttcacttcaaaacagctattgagagtgcaggcaaagccctattatactccctcacagaacaaaaataaatcccatcctgacaggtttctgtatgccggattatatccgtccccccacacctttcttcacagccttcttcatgcttcccttcctcccacccccgccattagctgccaccagctccatcttgaacagctctcgagagcagccggcagccaggccgggagcctgtttcttgct
